United States Patent 7,745,391 (HUMAN THROMBOSPONDIN POLYPEPTIDE) - sequence listing, part 67

SEQ ID NO: 235237 - DNA, 2094 bp, Homo sapiens
gatcttggctcactgcaaccaccatctcctgggttcaagcgatcttcccaccttatcctcctgagtacctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttgtttctcagtccctgactcttcttccgtgactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacaaccggattgcaaaatagttttttctgaaatttcaagaagtgaaaagtttgatcagaatttattatgtcaaatggagagtttgtgtttattattaaaatatgccttatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatgggttatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacatcatctgatcagcatcatcagttaattagtatatgcaatgttagccttaaaataaaaatgatgatttaagattc

SEQ ID NO: 235238 - DNA, 186 bp, Homo sapiens
tcaggctgaagcggatgcagagatgaaaatttgggtgcaagatgtttattaaggatcaacatctgtggcctggtgtggtggctcacacctgtaatcccagtactttgggaggccaaggggagtggatcacctgaggtcaggagttcaagaccagccaggccaacatggagaaacccagtctctact

SEQ ID NO: 235239 - DNA, 444 bp, Homo sapiens
attatagtccctctgacttaattctagtggtaactgagaaaccaaactgccagtttagttttgtaaaagttcaacaggggcaaaaatgggttcatgtctacagatccatgtactctgatcttaaaggtcctcaatgggatggtactatgataggtaggtggtggaggaaagcttgtagaggcagtagtatatcgtggatgaaaacactggctttcgagctgggtaaacttgggcccaaatctcaaccctgcttctgagaagctgttgatttcatgaacgttccttaacaatctgtgtctgggcttccttacctgtaaattaggattgataatgtaatttcccacaggtgggatcacctgagcctaggagtttgaggctgcagtgagctatgatcatgccactgcattctagcctgggcaacagagtgagaccttgtcccctaaa

SEQ ID NO: 235240 - DNA, 1938 bp, Homo sapiens
  misc_feature (703)..(703): n is a, c, g, or t
  misc_feature (712)..(712): n is a, c, g, or t
  misc_feature (1220)..(1220): n is a, c, g, or t
actatccttgagtgtttcactacgtattaaatttccacaatgcatcactagagcctatattgtatctgtggacactctttaaatgtggacatttaagcaaaagtcgaaagaataaatctagaaataaaaatgaatgtgaaatttgatgagaaggattggctcctgctgcaaataaatttctgttcattatacattacagtcagtggtattctattatagcagcatgaaatggtctaatacatctgatcaagaatggagaatctcagtcctatgaggacaaagaggcttccatgacctactaagttgcctggtattgttcagtctctcctgcaggctctttgtcttgtagcctaagtatctcttggtagaaaaaagaagtctcaggacaggtgggtgaggagatgcactctcatgtcttaagttcagctggtgctatgctgggggctactgtttgatctggagaaacaatgggcctatctgggctgccttctgctactatgtcatgggggaaagaagtactggatatggatggccttcctctcaggtgggaggacacaaggcatcttgatgttgtgttgttgctcaaatcctgggtccccacaccagctcttctatttttaccacctgcagagttctcctttatttgctttttgtaccatttgcagtgcttaaggttgtgcctagtgagagggagcgggaagangtgggtctntgccttcttgtttgagctacagcttacttagatgtttttgatccttgtttctccaatattaatgattaatttttaaaactttaccctaaattaatctgtattaccttttttccataaactccataaagacagaatgtgtttcatttttatataattaaacaccctgcctgcaatttacaaacaaatgatatgtcatttaagtttcataaatgggaaaaagattaatcacagacagtttatttctttaaaaaataacacaaatttcttatttctgtatttgtcataagttcaacctttttgcattatcttgatcagtgtaaaatgcttggatggtcagtgttgtttgacttgtgtctgtatttggttaggatccatttaaactctctaggataatgtcaaaatcaatttcttcctttatactttcttattttcaaagaaatggtgctaaatatttctatgaatatatggaaatatctatgcgaatatgtatctgactaaaaatgttgcnggcatcttttctgtttttttaaccctttgtaatatttttattttgtttatttagtgatataagggaaaattgtgagcatttaactacataatctttatgtttccaccaaactcaattttttagttcttagtatatggcctataatctaactttaatttatcccttttatattagcttattttcttgttaacaacaaggatatctcttctggagtatctcaagtcaaggtagaaaaagtagtcaacaggaaaatgaacagaacagttttggatatgtatgagaatttaaagcaaatgtttctaaatgagaaattgtaactcaggaaatatttggcacattctatcaaaattttgtgaattttgataataaaacattcacaattcaattaggagtaaaggaacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaatt

SEQ ID NO: 235241 - DNA, 815 bp, Homo sapiens
tctttagatgcacatctaactgaaatggagaaacctgggccagctcatgtttcatgtgctgcactcataaacctgacctccaggcagaaaaagtcctttgtgaaagtatgagaggctcctgacccagcactacccagaagagcacgagctgagagtgttctgaaaaggcggtgcttgaacaactctttgggaagcggctctgcagaggaaaccataaagatgacggtgctctatacctgtaagatgaccagagtatactttccagagcacttccaaattgcacatgattcctccatagctcagtcaagtagccgggacagatcttatctccacttttcactaacaaaaacgagggccaaggagattatgtgacttgccaaaaatcaaaacgtgagtacatggcacaggacccaggcccaaaccagtgagattaatctaccaccctgttggctgacgtttcacgtgtatctggtttgtttgttgttttgttgctgttgtttttaagatatgggttatctctttgtcgctcaggctaaagtgcagtggtgagttcctggctcaccgtggcctcgaactcctgggcggaaagaaaccctcaagtgggctctgtctccctcaccacttaccctggcaataagaggaacctagtcaagcaaaattaagccctgtcaccaaattccatttctaatttaatcaatttttaaatttctaagatttggccatattgttgtatttcactgtagttcgcccattttcactgctgtatcatatattcagcacatgaatatatctcagtttatccaattccaaaaaaa

SEQ ID NO: 235242 - DNA, 466 bp, Homo sapiens
aatcttcatgacaattctgtggggttttatggcctcccttttacagatggggaaactgaggttcagagaagttaaatctttttctcagggtaaacacaattagagcatggggagcagggactccaccctagcctgtctcctccaatgatcagactctttccagacaccacaactcctctcttaagaccccagggtcactctccttggggtcagaggcagccacactccatgtttctattgcctgcatccacgtcacagatcagagtttgagaagggtcagagtcagccaggtcagttctctccatgcccatactttgctttaaaggcttttcactcgatttgggttgttaattctcaaagtatgtccgtcaacgtgcaaaagttactgtgcatattcttttcccactgttttcttgtttttctgttgtttgttacctaaggtagctcctgccagtctctgtgtgta

SEQ ID NO: 235243 - DNA, 520 bp, Homo sapiens
atgctcagggcacactctggaccaattaaatccaaatctcaaggagagtgacccaagcatcagtattttttacagctccccaagtgatgataacacatgtcaaggtcatgaccactgggtgagggtaaccaacaaggctgcatctaacagactcctgaaaaattaagcacctgatcctgcgacattctggatcaccatggccatgcatctcggacagacaatagcatcacctcccagttctcagaaggaaactctgggaatgaacactgggctcaaaaccaaggcttttcctccctcccagcagagaaaagaatggttggtggaaggtctgggctctccctccacaacccttgtgagcagccctcaagcgctgcctccagacagctcacgccagccttctttatccacctccctgactcttacaacacttttgaatctggacattcttctcaaaatgaaggatagggcttttgcctgggatataatgagttgaataaaattttatgggtctctctgggaa

SEQ ID NO: 235244 - DNA, 418 bp, Homo sapiens
actgcttgtagttcaggctgctggagcatgggctgggaggtgggtggtgcacgagagaagatgctgagtctcaccacccatttcctccaggggacattttcttccccttcccagttttgctagccaagtggaacggaaaagtatattcttcctcaagcaaagagacaggaagggattgagtagttggtgggtattgagtgaggttgccaggtcgcaggcagcactggggacttgacccagagagtcccagagactggaaatagaggactggagccattttaatgccagtgaagatggttaaaactggttcagaggaacaactctgtagtcatttgttttctttaagtcttcctctttgctctaatttgatttaaatagagttctttgattttcagcctaatttaaaagtagcatttac

SEQ ID NO: 235245 - DNA, 491 bp, Homo sapiens
gaaaaggacttagaaaaataaataagaatggaagaaaatggcaatgttattttctctgacgttataggaaccttcaaggagtctaatgatctgatagatttagtgctgggtatggataataaagtttctatatgttaggaatgggcaaaacattcagatattggataactgaaatgggtttaagaaacccagatatcggctgggtgcagtggctcatgcctgtaatcccagcagtttgggaggctgaggcaggaggatcacctgaggtcagcagatcaagatcagcctggccaacatggtgaaaccccatgtctactaaaaatacagaaattagccaggtgttgtggcatgcacctgtaatcccagctacttgggtggctgaggcaggagaactgcttgagcctgggaggcagaggttgcagcaagccgagatcacgccagtgcactccagcctgggcgatagagcgcgactcagtctcaaaaaaaaagaa

SEQ ID NO: 235246 - DNA, 495 bp, Homo sapiens
tccccagggttactgatctgtgtcacttgcagccccttcagagagcagagaccacatggtctggtctgtgtcctggcattgtgctcatcacaaacatggtccttggcataatgctgagcacccaacaaataaatgtgtgctaaatactgaatacccaagcctggagctgtagaagactatggtctacttgtttctaatgcacagacttttggttgcaccatcatatttgcgtggctgcaatgaaagatgactttagaagaatgggtttggtgaaggcattgaaaggctacttacctgccggacatttgccccacgaaaactatcttctagaaagaattctgaccatctttgttctcaatctatgaacattttataaggcatcctaagggctacagaagcaattcccaactggtaatacaagaaaattgttttgagggcaatttaatggttaagtgtaggaaaatccactcttacagtgttaactaccaaccatga

SEQ ID NO: 235247 - DNA, 355 bp, Homo sapiens
gagaccagcttgagcaacatattgagaccctatttatcagaaaaactaaaaattagtcgtgcatggtggtgtgtgattgtggtcccaactacttgggagctgacccaggaggatcacttgatcccaggagttagaggctgccatgagttacagtagtactactgctgcactctagcctgagtgatagagcgaaatcccatcaatatctctttctcttttttttttcctaaagagaaaggctgggtgcagtggttcatgcttataatcttagcattttgggtggctgaggctagaggagtccttgagcccaggagtttgagaccagcctggacaacatggtgagagccgtctacaa

SEQ ID NO: 235248 - DNA, 448 bp, Homo sapiens
cgggaccaaagctcccccggcttgggaggagggcactggcccgccgtctgtggatccttccagaaacacgggcgctcctgcagggggaggggaggcctggggcagaaacactggaagagtttgctagaaagtgtttccctctgggggtggggccggcctggcgctccccagcacgtgcgcgcggtacctggagaaggtcctgctgggacgcctttccttcctgcggcgccccgagcttgcccggccgctccctcccgcggcagcgcctttcccacggttctaggggagctggggtggggtggggtggggtggggcggggcggggacagctgcgcttgcagggtggacgcggcctcctgggcgccccccagcccccagccccccgccccggctcccgcccccgcgccccaggcctgggacacgcggccagcggggggcgcctgcggccg

SEQ ID NO: 235249 - DNA, 901 bp, Homo sapiens
gggcctttagttttttgtttgtttctgttttgtttgtttttgtatttgttttttggaactgaatgaagtgcactgtgttctctcaaaggagatttgcgttgctttctaggggtttgggtgcacaaatccacagcttccggccttttaagccacttgtcaaggtcactctgactgcagggccagcagcctgggaccagtacagaccatcacggcacaggcttcctgggctagtcggagaaggtgaagctcgcatagtggccagggacttggcctttctgccctcacctccctgaggccacacaaatcctcagcctgtgtggctggaggtgccgccatccacagctcacctcagtttcaatatcttgtcctcattttcttttccctttttacaaaatgaagcacatatttcttctggcttttgtggcgtttctctgtgggagaggccatctgaatacctaaccagtgtgttacccagataatgaaagttagcattcactttttaaatagcagtaccctcaaaaaattgaaaaagtcctatgtagtaatgatgctaatgaagaattgaaagtgtttattaggtaaataatatggtcttgcacattgtttatgtggtaaagactgatttttgtagtcttgtaaaagacattttctgttcatttacttttttcattataagatatgtataaaataaaacttgccattttaaccatttttaggtgtatggttcagtgggattccataccctcacattgttgtgcaatgtaaaaaagcctttttgaaccatttgcttaattaataacaaaggaatttatatgtatatatacatttctagtaaaaaatttttggaaaccttgactaaccaatattaattaaaatggctaatagttggaatcatactaga

SEQ ID NO: 235250 - DNA, 623 bp, Homo sapiens
ttagagatgcggtttcaccatgttggccaggctggtctcaaacttcttgacctcaggtgatctacccactttggcctcccgaagggctgggattacaggcgtgagccaccatgctcagccgcttccctatattcttatcactgagaaatctcatcccccttttgtttttatctgttcataatgctcaaaccttacctatatgtctgacctcctgatctgcctacccaaatgcctttttaaaatctctctacctggatgtctcagatgtatctcctattctccaattccacgactgaattcaacctctactcaaaaggtgaacagaaaccacttgttcctacactatattctaaattctaagtctagaaatctgagtgttaccccaaccgctccccctctaccacaaattaaatcaatcaagtttctccctccttaatatctcttactgtatttgttttaacatcccacaacctataccttgtcagggcctcattatttttggccaggattactgcagtctacttaaaactccttatcttagccaacatggctaagatactccctctttgttccagccagacaaaattacctctggattctccactggcatggttacctctaag

SEQ ID NO: 235251 - DNA, 664 bp, Homo sapiens
gtagcacactcctgcagtcccagctactcaggaggctgaggcaggaggatcccctgcacccgggaggtagagttgcagtgagatcgcaccactgcatcccagcctgggtgatgagagcaagactctgtctcaaaaaaaaaaaaaagaagaaaagaaaaaaaggaaggaagagaagagtagaagagaagggaaaagaagaaaaaaaaaaagaaaggaaaatggaggaaaacaccaaaatagtacatgattatctccagatgatgggattatatgtggttttttttccccttatttttctacagtgtacatatgtcactttcataattcttaaaagcttgagccattatctaaggacaacactgaaataaatatacaggtaagacaaactagaagagaaattctggcagtcaacaccagtgctgagaaaaaacaccctattgatatagtcagtgtgctcccggagagagcgctgggagggctagagtttcctggtaaccaggagcctaaatttatcattcctaagggcttgctgatggcacctgagtaacttaggaaaccaaaggtgtggtcaaaaggtaagcgctcttcatactcggtaaacctactgtgttcaggggttcctgattttccttaaatcctttttattcttggatctcaactcttc

SEQ ID NO: 235252 - DNA, 2040 bp, Homo sapiens
agaatatgatgcaggtcatcaaaatctgagttccaaatatgttttgaacaatagaaaacatgagaaaaactacataaccttccaaaaccattactttgaattgtgacatttatttgaaaataaaacttccagatattttatttaaaggatcttatgttgtttgagtcacacttcgtcattatcagtccttcctgtcagggaaaagtgtgtttgggagaaatacaaagaaaagctttgagttgccaagatagcatttactaaatttggtcataaaaaatgttctgaaacttactttctgtatgctgttctagaggcagctcaagaattacagaaatttccttttttctacactcttaatttttctactttatgtatttctttttggctctttaaaaggcaacagattaaaaaaaattagaggaaaaacatttgttctactaatgtgtcacttgagaatcccagacaatacatagtatcattgagctaaaatgtgttgtagcctatagaacttagcacttctctcaaagagagaaggggagacccaatgagagaggcagacatggggtgaggccaatgaacactcagaaattaaaaagaatagttctaccttcttgacttatgtgtagcaactaaatcacaattagagaaagatacatgtgtgagtgtgtgtgtgtatacttgtgtgtgtgaaggtgtgcatgtgtacaaggaaaatggaaaatgcatttctacctagtgtcataatgaaactaggttttcggccaagatattttccttttgcctttgcatatctgtggcctactggacccttatattgtacctgtgtagaaaggaagcctctaagtctagttgagaggcaaagtgccttgaaggccgtgacccattaaggaaccatattgaagaaatgtaaagccaggcagtaatgaagagcatgacccattaaggaaccatattgaagaaatgtaaagccaggcagtaatgaagagcaaatgaggccagaggtgagcacggtaagtaaattagacccaagtgggcagtgaaatctgagagcaaatgagagtggtgaggaaagaggatgagaacgtaaggcacgggccacatggactctgcatctttagcgtgctgtttggccacagggaatagaaacccaacaaatagtggcctaactcctagatgcctgtttctctcaagggaatggattcagaggagccacttcaaaagctagtgcagtgcttctgcagtttcattaatgcatcaagcccgttccatctttccacttaacagagcttctctttggtcctcatagtttcaagacggaagtgaaaggactgtgggagtcaggacctcacatggaataaaccaggaaggcaggaggtgaagatgagaatggaatgcatgaatttgaagttgaggaaggtacagtaggtattcataatgataaggtctactatggtatgattatggaggtgagtgaggttggatggacaagacccttggagaagaaatcaagaaatggagaagcaggtattaaaaagatcatctacaggtacattgaaacctccaaatattaaaacagaagtggtattttaaatgaattatgactcccgcctccccatcccacattctataaccttccattgtcttcatggtgagtgtagagaaataaatgccttggtggagtcgctataacatgccatgagtcgcttgtttttcctcatgtgcggtttcctcctagcctcttctacagacctcatattgccctgtgttggagagagtgccaccctttagcctgggctgccatgctcctcggctcctgctgactgagacactctggcagaaggctcttccctcctttcttcccataggacatgctctcagctctcctcccaagtcctagcaatcagctacaagaatctgcttcattactttcatcctccttccctccactgcccggaggaccaggcaggctgctctcagctgcctgatctattattggggctcaaaatacatcaaactctcttaaaagccaaaacatttttt

SEQ ID NO: 235253 - DNA, 417 bp, Homo sapiens
tattacaaggaattaatctggttactagaaccagggtagatgatcagaccaggcagggccaccagtaccatccacccatttttcctgagaaaagaaaaatagggtagtctgagctctgtgaggtgtgcagaatgatcaggcccagagaggcaggagtgtgggacttcattcagcgcctcttccaccatagaagcaactgtccagggcaattgtttgatggaatttttgctcctgacaggctgcctcacccattatcttcttgttcacatggaattagtgatgctaagaacgatgcatagccaatcagcaccttctgttattttaatgcaaattcttgctaacaacttagggactgcctcttccttttccttaaaaccccactgtgactgctgctaatgggaacatatgttcagggca

SEQ ID NO: 235254 - DNA, 275 bp, Homo sapiens
tagttaaccctctgtggagtagggttaagaattctttttatgggcccataatcatagcttacactaaatgacgtctccttgtacgccaggcagtgttctaagcattttatctacgttaaactcactaaatcagcacaataactctacgaagcaggtactaccacgatggcgtggcacagaggaatttaaacctggacagtctggctcccaggatggagtgcagtggcgtgatctcagcaattctcagctactcaggaagctgagacacagaatta

SEQ ID NO: 235255 - DNA, 385 bp, Homo sapiens
tccatgaattggaggaggacacccagtgaggagggaaaagggattggactgtgccaccatctctgtaggggaggtgagacaaacgtccggtgcagctcggaagatggcctggaaggcctaacccttccacctgcctgactcctgacaccacgacatacacagttatttttaaagtgtttaaaatataaaccacattcatgggaacttgaagtcaggtctcaccctgacatccatccatctgtgtattttcaaggttgactcaaatgttgaaaagtcacctgtgatgtgttgtaccatttgagcttttgacaaaaactataaagaagcaaattaaaccaggagggaaatttctagctgccacactaatcaaaaactgtcgggtaat

SEQ ID NO: 235256 - DNA, 462 bp, Homo sapiens
agataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctggtaccc

SEQ ID NO: 235257 - DNA, 1877 bp, Homo sapiens
gtttttttttttgtactttggtcactatttagaaagggtgatcagttagacacaggccacatgtttaaggtgatatttctgtgaaacattttcatcttaataattatttcatatttattatgatgaaaggcatttaaccctagagcatgtacaaagctgagtcgcaagtctcagaaatagtgtcctaaagtgatgtattggcctcagagggaattcgtatgtacttatacacaaattcaccataatgaatgcaccaaatcatacttttaaatgcccaaataattcatattcataaatttttcattttgagcccctagatattttttaatcaaaacccataccactatccattcatcttccattcaatcaaatggaaaagagccatatttttttcaaaaatagcaaaattatctaatttcccttctacttctcatgtccataggataagcaaaagaaaaaaaatctgaaacacctgagttggcactttaaaaatttttcccagaaacatgagatgggatggtcagaggtcatgcagttggtgtcatgggggcaccctgcctgttttcttctgtagctcataccggtcacgccttgttggtgctaatgacttcccaggtgcctggtaccaattcttcattagttgctgttgtcctagaaatctgtgtaggtcatggaacctattttctggaaaaccacttaatacttattttaatttctgtaaatgttgtctgtggaaaagaacatttccacattttgcttgccattgttctgaatctgactggcagataacacactttggcatctgtaatgaaattacattaatcgtctgtccttaactcttttcctggtaaaaggaatgggaaatctttgttcagatatgcaataacagtattttaaaattgttcaaattatatagaattctttgcagattatgttagagaattcattacaatttaaattcattttattatcaaaattattctttgttttttggtattacataatggtcttccttataatggagtgttttacttctatttatagaatatagagaatgttgtgtagtttgctgttttatttttttaaagaactatttttaacaaaaatttgattcaatgaaatgtaattctatttcctgaataaaacgtaaaataaaacataattttttaagaaaagctttaaaaaaacgtaatttttttaaaaagctttctgttattgagttgtattgagtatgatattttaatcaaaaatttgaatttaaaaataatcttttctaagattgagtttctcttaagtcataaaatattttactgcccccagatgagcaccataattttaatgtcacaataaattagaaaaaaaatggagaaattccaggttgcaaagccagatctgatacaaattttgcctgatgcctttatcattaccttacacttccacctagcctatgtgcctcaacaggatagacatgtgacatttttctttggaaatttgacttagtcttttcaatggtgtccctagtttaacacaacatggaggcaaaatgttttctagaaggatctcaacttacccagggatgcatttctcttttgcttctctgtttgtttgtgtatgcatgacataatgacctttttagaaaatagatgtttattataaaaatagcatctggtatcctctaacattttattgcataaagataaattagtttaattttatataatatattttaacttcttcccaatggtgatggccttcttcaatatttaataaggtaaaattagcatagtattacaataacaattgcgaataatcaaatatgccctaagcagtgtttttttcaatatcagggctttgtctctcttctcttgctcttttgt

SEQ ID NO: 235258 - DNA, 412 bp, Homo sapiens
ccaggaacaatataactgtagccattttagtttgtatttaatgcatgttcctgtgccctggctattatgaaatcacagtgctttcccgtgctgggtataggttaatttcaatcttcatctgtttttccctgtaggatttcctgaatcttaaaacaaataaataggtggagttttcatttgaatggtggtatttgagataaatatttaggttctaatgaattttaatgaatctaaatctgcagtccaggtttgctaagagagaatcataaaatacataaactagctattgagaggggtgggtaggtgtagagtctgattatttgggagacatttgatgaattaggactggaagaaaaacaaatttccaacaccatgattttatagaactgtcgtaaggaaagaagtatcatta

SEQ ID NO: 235259 - DNA, 455 bp, Homo sapiens
ctggtgacctataaatatccacaaggtgccggaacacatgaacaaagagatagggacaagtattacagatgtttgagagtctggatctccagtcgaagaaagaataaaaagagccctggtacaacactggtagacagagaactggtaggcgaggctgggaaaccagataacaaagcccacggcgattcagaacccagagtaaacaggctggaagtgaggctgagcagctctcctgcctaaggcatggactttgccaggtacatttcaactgctcggagacctggagccaggtcctggttctcaaccccacttgggatagctgcaatgaacatgatggctacaaaatgaacctgtagaagaaagggacttgctgcgatcatagaattccctgtttcacccatttccccagcacatgaagtagataaaaagaaatatttattgaaaatgcaaaaatt

SEQ ID NO: 235260 - DNA, 365 bp, Homo sapiens
gaatagaaactttaacctgagtttaacagtgcatatggctgcctagctagagattaggttttccagtctctcttgcagctgcttacgatcatttgactaaatccttgccaacttaatgtgattagaagtgatgtgtgtgacttcccactcactttcttagaggaaattgcttgtctttacctcctctcattccccttccccacgtgctaaaatacctacaaactgctggtaatccagtctcaatcctcaatcctgaaggcacagactgtaccctggggcacggatcatggtccttgggccaaaggtctcatttcatatgatctttgagctaagattctgttttaaaataattttgaagagttgtg

SEQ ID NO: 235261 - DNA, 366 bp, Homo sapiens
gtttgagaccagcctgtccaacatggtgaaaccgtgtctctactaaaaatacaaaaattagccaggcatgttggtagatgcctgtaataccagctacttgggaggctgaggcaggagaattgtttgaacccaggaggtggaggttgcaatgagcccagatggtgctgttgcactccagccctcaggtgatttttatgcatattaaattttgagactcactgcaatagatcatttttgtggagggcaggattttatctttatgtcttgaaaagtgcctaacagcaatataatatatgaggtcatccttcagtctaatggttgatgggtggagtttttctagacagcgtcattgtgcttattcacaaa

SEQ ID NO: 235262 - DNA, 365 bp, Homo sapiens
tttcaggggtttattgagattcttggacgtcacattaggaatccctgtatctgcctgtgtacctcccattgggggctcgcctgggccactgtgatcatgtgctcttccctggtcccaggctgtctggcacctccctgtcactatcacccctgcactccccatacacgccgtaccgacagggtacagtgcaaaccttccttcatgtgccaacagcagtggtctccagtcgtgacatggaccaaagtcccaggaagcaggtgatggcctctgtggcccagccagcctccttcctgctggccatgtggaaccataacttgttgtgtctctcttgttccagtctctttggctactccacaagttacccc

SEQ ID NO: 235263 - DNA, 144 bp, Homo sapiens
gaggaattcatgagagtagacagagttagccacctccaaatagggaattatggaattttcatggagaaaaataacattaaggtcgaagtcttttttctttttaatgccttcatttcttcatatttacttacttattttcaactt

SEQ ID NO: 235264 - DNA, 486 bp, Homo sapiens
gaagagaagaacttgaaaaccagtgaacattagtgatcttgccacatttgctactttttctttctctctttggtatcacctccctgttctagttcatctctacattgatatacctggctaaggcagttcaggctgctggaacaaatgacaatagactgagtggcttaaacaacaaacatgtatttctcatatttctgggggtggggatgcccaagatcaaggtgctggcagagctagtgcttggtgaggacttgcttcttggcttgtaggcagcctccttctcactgtatccacatatgatgcaaagtagagagtgacaggaagctctcatgtctcataagggcactaatcccattcatgggggctccaccctcatgacctaatcagcttccaaaggccctacctcctaagaccatcatattagtcattgagatttcaacatataaatttggggaagggggacaacacagacatttcataaaaata

SEQ ID NO: 235265 - DNA, 354 bp, Homo sapiens
  misc_feature (276)..(276): n is a, c, g, or t
  misc_feature (332)..(332): n is a, c, g, or t
  misc_feature (341)..(341): n is a, c, g, or t
tcagaaggagtttcgctcttgtcgctgaggtgggagagcaatggtgtgatctcggctcactacaacttctgcctcccgggttcaagcgattctcctgcctcagcttcccgagtagctcggattataggcatgtgccaccgtgcttggctccatctatgatttctttcagtagcgttttgtaattttcattgtagcggtcctttgattcctttgctaggtaataacaacaaaaaaacaaaacttagggctgggactttccatttctaaatctgtganttcactgttggaggaaaaggaaactgccttgggataatgggcaaaaggaaggggantaagagggnccattgcccataa

SEQ ID NO: 235266 - DNA, 499 bp, Homo sapiens
tcagcctctgaagcaatggcctgagctctacattggcttcttttagccacggctgaagttgaagcagctgggacataaggcaccaagtcccaaggctgcacacatcaggggtctctgaacccaacccaagaaaccatttctgcctcctaggcctccaggcctgtgaagggaggggctgctgtgaagacctctgacatgtcctggagacatttgcccattgtcttggtgattaacatttggctccttgttactcatgcaaatttctgaagccagcttaaatttctccctggaaaataggtttttattttctatcacatcatcaggctgcaaattttccaaacttttgtgctctgcttcttcttgaacacgttgccacttagaaatttcttctgccaggtaccctaaatcatctgtctcaagttcaaagttccacagatctctggagcagggacaaaatgccaccagtctctttgcatagcaagagtgaactttactccag

SEQ ID NO: 235267 - DNA, 729 bp, Homo sapiens
aaaagaggtttaattggctcactgttctgcaggctttacaggaagcatggtgctggcatctgctcagtttctggggaggcttcaggaagcttacaatcatggcagaaggcaaaggaggaacaggcatgtcatatgtttttttttttttaatgaatccagacaaggtctcactatgttgcccaggctaggctggtcttgaactcctgggctcaagtgatcttcctaccctggcctctgccacacacttttaaacaaacagatctcgtgtgaactcagaacaaaagctcacttatgactaagttgatggcctaagccattcaaaagggatctgcccccatgatccaaacacctcccactaggccccagctccaacactgggattacatttcaacatgcgatttgggtgaggacaaatatccaaactatatcaccatcctatttcaagcttgctgacagatttcatcaaatgtgaatacaggatttgtaccaaattagtcattaggaaaatgcaaataaaataccaatgagggccaggcgcagtggctcacgcctgcaatcccagcactttgggaggctgaggcaggcagatcacttgaggtcaggagctcgagaccagcctggccaacatggtaagaccccgtctctactaaaaatacaaaaattagcccagcatggtggcatgtatctgtagtcccagctactcgggaggctgaggcaggagaatcactt

SEQ ID NO: 235268 - DNA, 511 bp, Homo sapiens
tttgtagcgttgaatagttttgattagatttggttattatttaaagcccagaagtcattttaaggtatatttgtatgcttttcagctttctcattttatgagcctgtatttaaagcaaatctctctatatagtcacgtgatgcctaatgttattttggacaacggtggactgcatgtataatcgtggtcccatagggttataatggaactgaaaagttctcacccattgacatcatagctgtcctaatattgtagtgcaatgaatatattactcattagtttgtggtgatgttggtgtaaacaaacctattgcactgctgctagtctcacaaaagtatagcatatacaactattacacattctgtgatattcacacaaccacagaattgcccagtgacacatttctcagaacatatctctgttgttaagtgatacatggttatatttgtagtcttactgcacaagaattaattttaatgattataatttttagattaacttccccaccatt

SEQ ID NO: 235269 - DNA, 467 bp, Homo sapiens
tctaggtatcacaatatgtgatcttttatgcatcaggtccattattaaaagaagcaatttgatactgctggaaaaatcaaatcaataaatggatttgaaatctaaaaaaatgtaatagggaaataagctttcaatatgaatacacacacaaacacacccaggttgcttcaggatattgcttcagtgctgctaatttctaaaacatttggaatagttatttagaattcggataaaggtcatgctagaccacattactcagtaaaagcagtaaacatggggaatgacttcaggagtcccatatcatgctgtggctacagcctctgctactcaagctgcaaaggctagctgatgttccgagcctggctgcctccactaaaaaaaggaggaggagaaggagaaggggaagaaaaagaagagaaggaagatgaagagaaagaagaagatgaagaaagaaaaagaaaaacaaa

SEQ ID NO: 235270 - DNA, 815 bp, Homo sapiens
ttatgtaggtcaagctggtctcgaactcgtgacctcaaatgatctgcccacctaggcctcccaaagtgctgggattacaggtgagcttattaaacaagtgtgtaaatgaataaaaaaagaaagccaagcatgaaccaatggattattattatgtttttgaagcattgaagtcaataaaatacacacaagcccagggctggatggttgctcttacttctaagggaaagatttttacataaagaagaaaatggaagaggaccagtgttgagaatgtgtcaggtgataagaattaatattaatccagttctagtcattgagttcattgaataacaatgagaatgaagatctagttgattatctctgtgggtgatgggcagattgacagatgttagttttattcagagtttttgaacagttttctttggattctcagctatggattgtaagggaatgaatgaataagtttatgtcacaataagttaaaagaggacagatgacagaccagtgatggtcataaattttgaagcaagtattaggataatacatttctatactgctgatgtccatgtaaaggatataatgtctggactcctaaatgcttaatgttcacagatgtgttcttgttatagtcagttttggatgctggtagatttatccttcttaattttctttcaaaagatagatatgagattaaattaacctattacaaattaaatagtaaataagcaaatagatgaatacataaagagggacaagaaggatttgtcaattaaataaaattttattttattttaagaataaaataaaacttaaaa

SEQ ID NO: 235271 - DNA, 438 bp, Homo sapiens
caaatattgttggatggatgaatacatttttgtgacaagactaagataaatcagtctttgtagattaaagccaccatttacaagctgtataactgtctaaattacttaatctttcttagtctcagattctttatctgtgaaaaaaaagatggccaggcgcggtggctcacgcctgtaatcccagcactttgggaggccgaggcgggtggatcacccgaggtctagagttcgagaccagcctgaccaacatggtgaaatcccatctctactagaaatacaaattagccgggtgtgttcgtgggcacttgtaatcccagctactcgggaggctgaggcaggagaatctcttgaacccaggggacggaggttgcagtgagccaagatcacaccactgcactccagcctgggcaacaagagcaaaactccatctcaaaacag

SEQ ID NO: 235272 - DNA, 466 bp, Homo sapiens
cagttgacaacaccacctgcttttttgaggccagtgaagaagtccacaagtgcctgccttggttctgctgtgcttgcagctgtcacgggatctgaagccagcccactgctttcacagaatgaagctccagctcatccacccagatgccaaggaccaggacaccctcaaccagtaacacacactctccttcttcaatgacgtttgtgttcctagaatccattttcctcagtcaggccctggccacgaagacccctgcctaccgatcttctgtactagcccagcacgcgtggacacattcatctgcacgacagacatcatggggcaccttctgtgagcaggcgctggggagacaaggccagcccgcctcagttcccacggtactcaagagacagcaagccaggccaccccagcatggtgaggtgggcactgtgttcaccaacaataaaggcggacaaaggttggtgca

SEQ ID NO: 235273 - DNA, 482 bp, Homo sapiens
ttctgttgcccttaggtgtctgaagtggtcccccaacctctctaaagtttcagattgaggaataatcatgagttctgagaagtgcttgaaactggaggatggggtcccagtgaagtcaaacagcacaaccaacactgaaacctctgcagttgaacctcattagagctggtcctcctcactttcttcccatcagtctctctgtctcaaagacattcttggcagagttggaagggaattccagcaagataataccatccagtgcccaaggcaggggatgcagtgtccatgtggccccccaaaagatcactgctcccatgttcctgagagaggaacctgatggatatctgaggtccccatgccagtcctctgatattggccccactgaagagattggtggcttgttgaccacagcctgcccaggataaaggctggactagtcttacttttgaagctgagcaaataaatatagaagcacaatccat

SEQ ID NO: 235274 - DNA, 224 bp, Homo sapiens
cccaccaacctaagtttctgtacccactgaaaccacccttcaaaagtgaaggagaattaaggccttcctcagaaaaataaaaattcaagaaacttgttgccaggagacctgtcttgcaagaaatgttaaattaaattctttagggaaacaaaagatatataactgaaacctggatcaacatttttttaaaaagagcattaaagaaagaattgtggtacaataaa

SEQ ID NO: 235275 - DNA, 485 bp, Homo sapiens
aggctaaggcaggagaattgcttgaatccgggaggtggaggttgcagtgagccaagattgtgccactgcactccagcctgggtgacagagcaagactctgtctcaaaagaaaaaaaaaaggtaaaagaaaaggagcagcagtttcctgagctgcgagctgatgttatctgttatggacaagagtttatgtgaagactggcagtctcccaccacactaggagacacgctacctctgtctccatgcacatgcttcaaggatgtgacgacagcttccttcagctgtcagcagtaagtttaaaagttaaaaactggccgggtgcagtggctcatgcctgtaatcccagcactttgggaggtagaggcaggcagatcacttgaggtcaggagttcgagatcagcctggccaacatggtgaaaccccatctctactaaaaatacaaaaattagccaggtatggcacacacccatagtcccagctccgtctc

SEQ ID NO: 235276 - DNA, 462 bp, Homo sapiens
ttattttttttatcatcttgcagagattagtgtttaaaaaacaatgcagctatagttagccctctgtatcctctgggattcaaccaactgtggatcgaaaatatttgtgggaaaaaataatacaaatttaaaaacccatacagtacaacaactacttgcatttcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaataga

SEQ ID NO: 235277 - DNA, 515 bp, Homo sapiens
aagcctttctatggctaatgctcgaactccatcctctctttcctagaaggcaatctgggataaatttttcagaactccatttgttgcctctgttagaaagaaaacactgggcaagatgaacctgcaagtagagtaaatggtttatttcttatttgcttttaggagtgtgtaaggagattttttggtctcccgtttttactttataaaaaatgagtgagtgtgccaagcgctgtggctcatgcctgtgatcccagcactttgggagaccgaggcaggcagatcacctgaggtcaggagtttgatatcagcctgaccaacatggcaaaaccccatctctgctaaaaatacaaaaattagccgggtgtagtgccatgcacctgtaattccagctatatgggaggctgaggcatgaacattgcttgaaccccggggagacggaggttgcagtgagccaagattgcaccactgcactccagcctgggtgacagagtgaggctctttctcaaaaaaaaaaa

SEQ ID NO: 235278 - DNA, 624 bp, Homo sapiens
catggcatctaaatgagtaactatacacattcctcctctccagcaagtatacagaaatcttcccttactccaatttgacgctgcaaaatcatacatgcacccctactgatctgtgtgttgatctttctcttcccacaaggcagctgctggaggaggtgaagtggcatcgatgtcatctttgaaaagtttctactttgtcccttaatgccaccctgacgtatgagcctctgcttcagaggtttgcaagcctggctgcgtattagagtcacctaggagcttaagtggcttttgatgcatttccaagtagaataaggtaggtcagtagatggaggataacagtaaaatgctagcaggccgggtacagtggctcacgcctgtaatcccagcactttgggaggccaaggcaggtggatcgtttgaggtcgggtattcaagaccagcctggccaatatggtgaaaccatctctactaaaaatataacaggcactcagtagtggcgtatgcctacaatctcagctacttgggaggctaaggcaggagaatcgcttgagcctgggaggtggaagttgcagtgacctaagattgggccactgtactccagcctgggtgacagagaccctctca

SEQ ID NO: 235279 - DNA, 571 bp, Homo sapiens
atatgctaagaccctggcgtgtattggatatgcctagccacaaacgaggcaaccatgattgttaatatgcttctcttacaaatagggaaagtgaggctaagcaaactcggcctccttgtgcagagttccaaaactggtgtggttgagtccggtaggataaaccctagcagtgtgattctgctatctgtgtggaatcccatctgtcgccagcaagtgagcctccgctgttcagggtttcccggctacaaaaagtagaagggctgccttctgtcgggaaattgattgcttggtgatgagtccacagctcaaaattcatacttaacacttttaagtagttgagctgttttccaagcgaagtggtcgagtggggctgaagtacttacttgacgagtctggttcagaaaaggtcaggtcggaacccacccagagacaccggctctaggcagcgtgatccgaacaataatttgttctcgccaaagtgacatttttccaatttgagtccagcattgttcagaagcaaatgcagtcccctggggcgcctcccgcatagatctgcagcagatgacaaact

SEQ ID NO: 235280 - DNA, 414 bp, Homo sapiens
aaatataaatgtgaaaattaaaaagttgaactgttagaaaatatagaagactatctttgtgaccttgaaagatttactgactagtacacagacagcaagaaaaaaagcagatttatattttcaacattcaaaactttttgtatgatgaaatgcatatatactagctaaaatatatcagaagaaaatttacagaagaggaaacccagctgggcaatattcacataaagaactgtacaacctcaagagcagttaaggaaatgcaaagttaaactgcgattccatttcacatccattggttgtggagatatttggaaacataaacctaaactggaactcttacttgtgtttgtatgcagagacactttggaatgcaaattatcaatatttatacaaattaaagatacatacactttt

SEQ ID NO: 235281 - DNA, 535 bp, Homo sapiens
caatgggaaaatcaagcatggtcagcctcaagcactcctcagaaggcactgccgggagctgcccccacagtgccaggaccacactgcccctgccacacaagctgcagcactgaaggcctgcctaagtgagcgcagtcactcctgccctcactgacatctccgcagaagcaggctctcccagccccagctcaggagccagccagagcacgcagcttgccctgcatcctctggcaggccctgccccgacccctcaactggcctgcaaggcccagacagactggagggcgggggcctgcacttagccacggggggctggggggtggccagggacacccactacgagggtccatgccatgccgtctgggcaacccaagagggtgaggactgcatgcccaggtcccgcagggttgctggtgaatcaatgagcaacgtctaactagtcggcatggaaaataatacttttaatccaccaattatcatactcaaatcctttccttttcccccagcaataaacactgagcaaactattcacaat

SEQ ID NO: 235282 - DNA, 595 bp, Homo sapiens
ccttctgactgatagaacatgccatattctttaactatctttccccaactcttcttgtgtttcaaatctcagcttaaatgtcacttcctagtgaagctttccctgaccaccctaagtagatcagctcttcttgttattcatcataacactgcttattttcttcacagcatttttctcaaactatacttcttttgttatttgtttacttattgttattgttaatattattaatagaattaatattacttgtttacttattattatttttgctaatttcctatcttccctactagacagaagacagtttctgaaggcagaggccaagttggtcttgttcactgctgaatccctcattgtctcgtacagaaccttgtatataataggtgttcagtaaatttttgctgaatgaatgcatgaatctaaaggatcattatgggggaaaagtagactaatgtagtataactataaatggaaaatctacatcaattgggagagctccatattaaaaaaaaaacctttctgttagagatgtccaaagatggaaggcactccttcaggagtttcctgaccctggagatatcatgttgaatctggg

SEQ ID NO: 235283 - DNA, 151 bp, Homo sapiens
caatttgcttatgtaatgtttatctaatttcgtgtttaatcatttttgctataggtattcttagttataagataaactttattttgaactagagtgggaaggtgtgtagacttcattgtgttgatttaataaactgtgatcatagtttatg

SEQ ID NO: 235284 - DNA, 468 bp, Homo sapiens
tagatggcgctgtcaacttggacagcatatataacatctagaaatttcgattctgttataatggaagttatggaattgtccatagggttattgtggggagcaaatgaaataatccccataaagcagtgattttaagacttcttaaaatgtttacctatagtaagaaataaattttatatgggacatatgtgtacatataaactataagtttcactgaagaatttttattctactaaatgtaataaactctgctttctattctgttgcattttcataagcctctaggtcatgactgtttgcgacattgagaatactaagttatgaagcatgtgttgttctgcataatatgcctactatgtgtcagtgcctcctactatgtgttaagcatactaggtgctaggcatgcagtaaggaacaagacaaagttcctatccccatggagcttctggattagttggggagaaagac

SEQ ID NO: 235285 - DNA, 2115 bp, Homo sapiens
accggaaaacgttgtcgctcatcctatgacgcgaaagtaaccgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccgacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaggtattggcagaagattttggttgatagacaggcaaaacttaatcagcctcgggaaaagaaaagaggcactgaaaagttaatcaccaagctgaaaagattagactggcaaagactcaacaagcgagtaaacatataagattttctgaatatgattgaaaaaaaaacagttcacctcttaatacttcacaagatacttgagctgttcttgggagattcacttttattatggtagcctgcataattaatgtgtttttaattaaaagaaatatctttgttcctcaacttgtaaataagacttttttctagagacaatatgatgtataccacatttttcttaaacattttatttgttgaaattatcttagatgtcagtgtcaggtgatttagtaaataaatgtgttttgaacatt

SEQ ID NO: 235286 - DNA, 2323 bp, Homo sapiens
accggaaaacgttgtcgctcatcctatgacgcgaaagtaaccgagactatcaggatccggagacggaaatgtccgaaggccgcagtacttgaccctgtattttgggagtcgaacggagactctgccatcgtcctcaaagagtaaaaaatccagttacggaagggaactaacacttgctagatatggtgtgcagagtgcgtttgcaaagaaacttaagagaaaacaaatgataggacacagggtggtggaagatctcaaagagataatctggccctgtgttttaaaaggtacaaagaaactaaagctatgatccctaacatagaaggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccgacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaggtattggcagaagattttggttgatagacaggcaaaacttaatcagcctcgggaaaagaaaagaggcactgaaaagttaatcaccaagctgaaaagattagactggcaaagactcaacaagcgagtaaacatataagattttctgaatatgattgaaaaaaaaacagttcacctcttaatacttcacaagatacttgagctgttcttgggagattcacttttattatggtagcctgcataattaatgtgtttttaattaaaagaaatatctttgttcctcaacttgtaaataagacttttttctagagacaatatgatgtataccacatttttcttaaacattttatttgttgaaattatcttagatgtcagtgtcaggtgatttagtaaataaatgtgttttgaacatt

SEQ ID NO: 235287 - DNA, 497 bp, Homo sapiens
tgcatccagcctgagttggggataagaaattatgctcttactggaggcaaaaccagagctgccagtgtacatccagccagctcggccccagagtttcccttaccaggtcagcagtggccccaggagccctggagattgggcacggccccctgccccagctctctgggacgatggtccggctccagccgctctgataagagtgcccgctacccccagatggctgcctcagtcctttcacagccaattctagagagaaggaaaaggagtgagacgagctggccagcacacagtcaaggcccaggggctgggatgggcggactgtggcatccaccaatttgtcatttgtgcaaagggcccggccttagctttccccaaagggaggcccggcccaaccactccctagaggcccaggagtgtggctgggagtcaggacgtgtgtggcagggaaccaaaaggccggtcagagggacggggtggctgcgctgccaggcttccag

SEQ ID NO: 235288 - DNA, 356 bp, Homo sapiens
ttacccaaaacctatgtagcaataacagtcctaataaaaatgcatgttagattcttttaaaatttaaggaataggctgggcgcggtggctcactcctgtaatcccagcactttgggaggccaaggcgggtggatcacttgaagtcaggagtttgagaccagtctggctaacacggtaaagccccgtctctactaaaaatacaaaaattagtcaggtgtggtggcacacgtctgtaagtccagctacttgggagggtgagacaggagaattgcttgaatctgggaggcagaggttgcagtgagccgagatcatgctattgcactccagcctgggtgacagagcgagactctgtcaca

SEQ ID NO: 235289 - DNA, 448 bp, Homo sapiens
caagaagactgtgatgagatttactgagaaaagaagtctgttagataagctttgttcaggccgaaatgatagtgttgtgggctgtgagttcaatgttaatgaatcaatgatacatacttcatagaagctcataaaacaaggctatgtattgattggttaatgaaaatgttctgaccagaggttcgaggtctgcagtgattttgtagggcgtaagtaccctaagtaatgagaatgggcagtatgtagaagtgcctatatagtgcatggtgtagacgagacgcattgagaagtgctgactcctgaacttggtgagaagatggcagaaagcactccaagcagtttctttccatggttgtttgtgctttgccgggaatttggatcctgtaagagtcaaacaatttttgctcataagtttctgtccctttgcatccattgaggtacagagtta

SEQ ID NO: 235290 - DNA, 421 bp, Homo sapiens
gccaggccctggagctcagcttgcctcccagggttgctcaatgccttccttctccctgtcctccagtcctcctcttcctgagcagccaccactcctccctctcctggcactcaccttcagagccacactggctgccctccctctactcttttgttggaaggactcaactgtgccagcaccgggctttgttggctatgccacacctggatggggcagtcctggagggctgctgcgtagggggatcatttgagcttcctgctctctccatcctccagagagtagcggcttccaggatagtgtgcaggaggaagcagggcagctggagcaacctgtcttcctcctctctcctgtgggcttttcccgtccacctgccagcatcaccctgtgtgccctagatgagaacgtatggctttctctagcc

SEQ ID NO: 235291 - DNA, 533 bp, Homo sapiens
tcaaaccaactctcctctccaggacagaggcaggactcagaaccagcactgatttgggtcctgggacggggctctcagtacctgtcagcaatgttgagcccaagcccagggtcagttgatcccctcccagcctcaccccaacagggaccagggacccagatccctgccaacgttaaaaaaactcccacatggcacagaaagcctcaactagcagcaagctctgctgggacagtcatgtggctggtcattagatgggcaccttcccccagaatctggggcagggcccagcctggacggcagctctaccccgccctggctgtgtcatgttgggcacacaccttaataattctgagcctcaactaactccttgtaaaaagtgcccagctaatagagcaggcagtgagctcatccgtggaaaccctgggcatgtctggtctgtactaagcatcatgtaaatgtcagctgcttgtattattacaaatggcattattactattcctactctcacatcttaagaaactctgaaaaaatca

SEQ ID NO: 235292 - DNA, 300 bp, Homo sapiens
cttgcctcctttctccgggaatactgtggttagactcaggacagccccctggaggctgtgtgctgaagctctgtgcctgagccgcaaagaaaaaatagaacatgggcccctgatggatgattcgaccttttatttcaacttaaaaaaatgtttccaagttttctctgttgtatttttttctacatgcattatttttttaccatccgtaaaaaaataatttgaggcctattttaaatcttactttattgacttccatgattttctcctatcacagaaaaaataaaataattgataactaga

SEQ ID NO: 235293 - DNA, 631 bp, Homo sapiens
tactaccacttcatggggctgttttgaaggtacaggagatgcctgcctgaagtgcttagcccttcctgatacatagcagaatattgatatttattattatttttgctcttctccaacttctagtactagtatctataccactcatttgtactcaagttatgtctgctttatggcagctcttgtccttgcactagcatttaactttgatgtgattattttaatgttgatataagctttctcctaacagataaattgtaaacttcttatttatctttataggtcctaagaataacagatgcttaataagtattggtgaaaaaaaagcaaccacctgttagggctcataacctatacctggtaatattacaacattcaggtcaagaactcaataaaccttgaattagagtaactctaatccccaaacatttttgttttccaggaaagggatgattaggaaaactttacaatttttttttcatcctgcaggtttcgtttaagagaagaaaatgcagactctatcctcttaagaaactacttctgggaaaatgcaatggagacacaaggtctaccttcctaggttttggttttccaaataaaagtttatggtcaggtcaaaaataattgctgggaa

SEQ ID NO: 235294 - DNA, 512 bp, Homo sapiens
acagatgccagaggggattcctgagagatggtggttttactctgttctgtgagtttatgagaatgaattcttatgaacctggaaggtccaggagcaactgctgaagacattcatagaaataggagttattttagaaatggaacttcacttcatctgaagttctgaacctatgagtaagagtaatagggtggagtttttgtgatgtcttatattcctttcctgaaaactgaaaaatatagataatactcatacctcgatttcacacagatgacttggtgatactcaagagacagagacttttatcaggggtgtcaaactcaaatgactaccaggtcagaaaggtaacataaattagtgaagccggctaaggaatacctatcccatatagagaaatttcccatcactcggttacattccaaaatgtatgtcagtattgtaaaatcatccagcctttcaagaagcttttaaatgggattatttttcaaaataaaagtagctaagtaaccaaatgt

SEQ ID NO: 235295 - DNA, 330 bp, Homo sapiens
tgcaatcacggctcactgcagcctcgatctcctgggctcaaacgattctcccacctcagtgtcctgagtagctgggactaccagcatgtgccaccatgcccacctaatttttgtattttttgtagagttagggtctcaccatgttacccaggctggtctcaaactcctggactcaaccgatcctcctgcctcggtcctcccaaagtgttggaatttcacgcatgagccaccatgctcagtcagatgttttagaaaaaagtcttgcactgtttggggcatacctatggtaaatattgtttacggattagctgaaattcaaattgaactgag

SEQ ID NO: 235296 - DNA, 340 bp, Homo sapiens
aagcatgtgcaaaagctgatcatgtgcacgaggaagctctcgagaataaagaattacctctttgctgtttttcacctactacgtcacacactacacaacacacccagggcttacccctactccagtgtcattggcaagtgcctggcctggtataggaggaactgtgacaccagaggaatttggcttgggttacctcactttctaggttcccaagattcccaagttaaggaagctttggttattacatagttgaacattttcttatttcatgtaagttttgtaaatcttctgtgatttcttctcctctttggcacatttacattaaattttattctagtta

SEQ ID NO: 235297 - DNA, 718 bp, Homo sapiens
ctcttaacttgttacactttgttctttactcttcatcttcattgccatgactcagatttgggccctcatgacctaaattgttatcacagacccataactagttgctgaactattctagaatgaatgttttaccgattttcttaaaatacacctgagatcagttcagtcccctgctccaaaacctttagcaactttccattacctgtcaaatgattgttcaattctttaaccagtattttataatttttgttctctgaactcagcctctttggttcagtcttagctctctctgttctcctaaaaatactcaggttgtagtcaaatcccatattttcttgtcacgtcactttgatggactgttccctcttactgaaaagtcttgccaccaactctttgcctaccaaatctgtttttccaggacaacttaaatgccactctttactgcttacctcaactaaccatgacctatcttctgaaccctcataacagtgtctgtacctctttggcacttattactgattgttattggtgtattactactgaactgtattctccttaggggcaggaaaagtatcttttaaaaaacactgtacctagacagtcattagcagagcctttgatatatatgttcaacaaactttttattaagttattgaggttactacatttctactgtaatcatgataatataaaaattataatttaaaacacagttata

SEQ ID NO: 235298 - DNA, 1240 bp, Homo sapiens
ttaagtcaaccatgttgaaaacaattaatatttacaacataagttaaaagaaccaggttcaaggtgcatatttaacgtttagccataaattacatgagagttgcagtgtctattggatttgtttcttcaagaacttctatccaaatcccagtacagtacaccaccatccttacaagcaattactcttttagagctgtttttttttaaaaaaatcaatttgtgaatagagttcaaacaaaaatgccttttttaatttcagcagatgctcgaggatttcttaccttgaagtcaaggttgccaatagcaacaaacttccgcaataaatatggcaaaatgcaacgcacatctttattctaatgccttgtacttttatacagtctttcatccatagattttcttatttgacagttaatatttaatatttaaaatacccgtaaaaggcacacatgtcttatcaccccctctttttgccattgagagatcctagaactcagaggttccaacacctcaagatacttgggcatagagctaaacttggaatctagaatcctgaactcattgggactcatctgtgaagaataatgaaacaagatttgtaaaaactggctgggtagtgtactaagcatttactctatatcaggaatacagttaagtgccttgtttacatttgttcatttagttgattaattttacaaataagaaaattcaagttcacagaggtggtcacttgctcaaagccatattccaagaaaatggtagagctaagacttgagctcaggcccatctaactccaaaactcaggctcagaaccatctaagctgtaagttgtaagagctactgagaatcaaggagcttggctctgggagaagtttgtgattctttggtgctctcttcacgtcactctactacctcactttagccagtaaaagacacatcacagattggcacaataagaggcatattagtgggcagctgaaaactggaaaaagagaaaacaggcctgcgtttacaacccttaagagtgagagactgagaccacaagcaaaacaccaagaattatttggtcacacaaaaacccggctgagtcactggagacaaaagcttaattcccttattggttttgtgtgcttgccttaattccatactatcctttaaatattctacaaataagagcacggcatattctatcgctatttacaacagggctttgctgaagattttatccagggcaaggtcatca

SEQ ID NO: 235299 - DNA, 172 bp, Homo sapiens
ctcgtgcctccctgccagggtgggtggacagtggattgattacgcctgacaactcctacttgggccctgtcactgttgtgctgatatagaccttgaggagtatcagaagggagtaacaaaatgacaaatcctctacccacatgttttaccctcaggacaaaacatgcttctg

SEQ ID NO: 235300 - DNA, 1003 bp, Homo sapiens
  misc_feature (474)..(474): n is a, c, g, or t
  misc_feature (499)..(499): n is a, c, g, or t
  misc_feature (517)..(517): n is a, c, g, or t
  misc_feature (699)..(700): n is a, c, g, or t
tttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgttatgtgagactccctgcccttnccgagctgctgaagaggtgtgctgngtgaggtggcaagccagnccaagtgtctagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactnnaacagctgtgggaatcactttaaccctgatggagcatctcatgggggcccccaggactctgaccggacagggccaagaggaaccttgcctggccagtcctcggggagctcagattcttacgagaactggtacgcacagggagggcactgggtactttaggggaaccaggacgaaggcgtcgaatcagggaatcagaagaatgcggcttcgcaccacgtggcacccttccctataacacctggagttcatcaccaccgcgggaaccgggcaggcgggaaagtgacaggcggccactcagaaggt

SEQ ID NO: 235301 - DNA, 975 bp, Homo sapiens
  misc_feature (510)..(511): n is a, c, g, or t
tttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactnnaacagctgtgggaatcactttaaccctgatggagcatctcatgggggcccccaggactctgaccggcaccgcggagacctgggcaatgtccgtgctgatgctgacggcgcgccatcttcagaatggaggatgagcagctgaaggtgtgggatgtgattggccgcagcctgattattgatgagggagaagatgacctgggcggggagggccatcccttatccaagatcacagggaactccggggaagaaggtttggctgtggcatcatgtgcacgctccgttggccttttccagaacccgaagacagatctggtctgtgcgatgggctcaccaatcttggggaggaagcgaggcggcccaatcgtggcaaggcgcgaaagggagtcaaggcagccccggccacctttggagaggaactcacctgggtcttggtgcgcctccaggggagcctttccattccagagg

SEQ ID NO: 235302 - DNA, 771 bp, Homo sapiens
  misc_feature (474)..(474): n is a, c, g, or t
  misc_feature (499)..(499): n is a, c, g, or t
  misc_feature (517)..(517): n is a, c, g, or t
tttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgttatgtgagactccctgcccttnccgagctgctgaagaggtgtgctgngtgaggtggcaagccagnccaagtgtctaccgtgcagggggtggtgcgcttcctacagctgacccctgagcgctgcctcatcgagggaactattgacggcctggagcctgggctgcatggactccacgtccatcagtacggggaccttatcaactaattgttacatcgtgtgtgtccacttaatccctgacgccacatcataatgtggggccccttcagtatctctgtaccggctacacgccgtatactctgttggttggcccctgctcccg

SEQ ID NO: 235303 - DNA, 214 bp, Homo sapiens
agtgtaaggatgttagccaaagtgttagatccagatataagccaccccacctctctaagccttgtttttcccagctttaaaataggtacaataggccaggcacagtggctgacgcctgtaatcccagcactttgggaggccaaggcaggtggatcatccgaagccaggagttcgagaccagcctggccaatatggcaaaaccccatctctactt

SEQ ID NO: 235304 - DNA, 542 bp, Homo sapiens
cagatggagtcctgctctgtcacccagactggagtgcagtggtgcaatctcggctcactgcaacctccacctcctgggttcaagcgattctcctgcctcagcctcccgagtagctgggactacatgtgcgtgccaccatgcctaattttttaattttagtggagatggggtttcaccatattggtcaggctggtctcaaactcctgacttcatgtgatccacccacttcggcctcccaaagtgctgggattacaggcgtgagccaccatgcccgggccgaagattatacaatcttaagtgttagaagagatgttagataccattccatttaatatctcattcaaagtttgagccctttctatagtcttcctcacttttgatggctaaggtagtcattaagtctaagctccaaaaaaaagtacagcttttctgtcactattttgtactatgtactttccaagcatgctaagcagttcagtgtcagcattaagaaaagtcctaggatctgggctgggtgcaatggttcatgcaagtcctaggat

SEQ ID NO: 235305 - DNA, 593 bp, Homo sapiens
aaccttaacaaactatcccagactcattttaaagcagatgaggaacctaaataaaccctttcataattttaaaaaagacaactgggactttaaaacataacagcaacctatcccagaaaataatgtgagaaattagttatgaagtatttaaataaacttttttaaattaaaactctcatgatctacacaggcaaatatgagcacagctgcaatatgccatgttagtatcattattaatcactttattaatcacatctgaggaaaaagaaatgctttctaaatcattctaaaaggtcttacaaaaaaatgaactaccctctccccaacagacacacataccctgatgaagaaaacaccaacatttcaaatattccagcaattataacacaagataatcctgaaatttatttagcctcaaaacattacgaactactccaaggaaggaacaatactttgaaaacactagtatttttaaggtacaaaaaaaaaaattatggcctggcgtggtggctcacgcctgtaatcccagcaacttgggaggctgaggcaggagaattgcttgaaccagggaggtggaggttgcagtgagccga

SEQ ID NO: 235306 - DNA, 190 bp, Homo sapiens
cagcaggtctggcatcagcctgggctgttttgctgaagtaagagatgtgcctgcacagcatggacccctgggcaaggcatgaagggtactgactggtggccatgggtggagacaagtttcagggtgtctgatatcagcttgtcagcattgtttgagggtcacaatgagactgatgacctgcaactggcct

SEQ ID NO: 235307 - DNA, 234 bp, Homo sapiens
aggggatttagatgtatgtttctcccaaagcagaaacgctcggggctcttccaggctccgcggctctaaccgcatcgggtcccagccccgcgggcggcggcggcggcgccgagggagaggagagcgggcggcacggcccccgcctcccggcccctctcccccgccgctccggagctgcccggccgggcccgagccctgcctcgccggcggccccagccccagtcccagcggccg

SEQ ID NO: 235308 - DNA, 2268 bp, Homo sapiens
  misc_feature (1074)..(1074): n is a, c, g, or t
  misc_feature (1667)..(1667): n is a, c, g, or t
  misc_feature (2161)..(2161): n is a, c, g, or t
catttagttttttatcaatagatttggaccactatgcttaaagctaatcagcaagtgattctgactagcagaacacctttgaatttgagcaaacgtactgtggttccaattgttgtcactcagaggtacaagaagagttgaattaattctcagtggcctgagtaaagatctagaggcaaccactcacatattttagaataataataataattctcttggaattcttccaggtctgttttattaacttcctactttctatactaaaagaaaaaaatagattagtaatattgttaacctgatgatgatagaagacttactctttttaaacaaattttcaccctttctaacagtttagctgaacatcctgaagcaagcgagggaaaatataaagcattgcaaactcaaaagcacatataaatcaagtcacttaaaataatggactcaagaaaaaaaaagaaaacatgatattcctggtgaagcttttgttttcacaacaaaattttccctggttacagaaaaatatttctgaagtataaaaaagtgaaggcataaacatgataatgaatgacaactggcatcttcattatggggatagaagagattggtgtggtctgtggcaaaatgaagaatgcatgccctgtcttatcagacattatgctcagctccagcagatggttatcatttggggagtcagagccggcagttttagattttacttttttccccaaagaagccaaatccagatttttaacatgaaatgtcccggcttataaatgttggctcaatttttttggacagcatgtagaccaaacaaaattgatccataagctatttggcctattggttgtcaattgatgacccctccactgtagattttctaacaagaacagatggaacattttctttgctaaccagggtaataatttagaagggctctggaaccccctcttttgaggaagcagaaccctcatgtcaggatttaataaaaaatgttttggtcattaatttataaaatttcatagaatgcaaaagtttctggattgatgacatatcacttagcttggagaaggaagncaagataactaaggcagaatgaaatgtgtgtttcaatagagatttggacaaagctctgtgacagtaataaacctaccctaggtactagcaaagcttcacaaaggaagtaacaaaaaaatgagactctgaaatattaataggatttttatagaaaaagaagagaggatttgccaagggaggaaaaagtataagcatctctacagttacattgtgggctttgctaagtcttaagatggtgattgattgggtataattggaaagtaggatacatgagaacatataattagggccaaagggacctcaaatatcagtctacacatctaaaacttgattatatagttaggggagccattcaggtttagaccagggaagatacatcatctgatctgagattatctgatctgcatgttcttattccaaatcttggtttgagttcccttaaagtaattggacactttctgtaaggaattggataaaaataaggaccctacctagatactggctaaaaagctatatgatatctggagatactgacaattcttaagaatcgactttacactagtcatgataaatcacatccttgtgatttccanatgaagctagaaagcaatgttcaagaggctatcagaatacctggtaatttcatggaatactacacagccataaaaaagaatgagattctatcctttgcagcaacatggatgaagatggaggccattattctaagaaaactaaactaattcaggaacagaaaatgaaacactacatattctcacttgtaagtgggagctaaacattgaattcacatggacacaaagaagagaacaatatacaccagggcatacttgagggaggtgggtgggaggaagctaaggattgaaaaacaacctgttaggtactatgcttattatctggctgacaaaataatatgcacaccaaacccccatgacatgtaatttatgtataaaaacaacctgtgcacatacccctgaaactgaaataaatgttaagaaaaagaatgcctggtaatttgactggcatgcagaacataatagcctgtcctgcatttgggttctgtgcagagaanattgcacctctattagaatcaactaatataagtcatgaaaacaaaaattgatggaattaggttgaaatagactggaaaggaaatgtgatgaccttaattattttagc

SEQ ID NO: 235309 - DNA, 382 bp, Homo sapiens
aattcccagctggctccctgtacactgcagatacctgaagtggttttgaagactgggcagctaagacctaagtgaagaagaattcctcccctgcaaggatgaccaagaacccagccgctctgtttccttcccgactggagtcctcttctccactgatcttcaggctcgtgtggaaaaaccgataaaatagaaaaagcaatcggaagaatataaaaatcactgataatcccgccacctagagaaaactactgttagtattttgagtgtatttccctccagcttttttctatatatgtgtatgtatttataatatataaataatatactatatattaatcaaatactatatataataaatacattatatatcttacatagaaca

SEQ ID NO: 235310 - DNA, 561 bp, Homo sapiens
gctataaaaaaatagcattcctctctcacttctcttaccaacatcttttgattccctttaccccactagaatgtaaacttcaagagaataaggactttttaaaaactgctttattaccagcacctacaacaatgcctggcatgtcaggagtttaataagtattaaatgtatgaattggttcatactaaatccttttgtgcttaagctagagtcaggactgtgttgtagacaaagcagaattttatagaagattgtaaaaagtactttaaagtctgatatagtctaatgagataccataaggtggtaaaaaagttatgaataaacaaggtgattatggttgactgactttcctcaaagtgtatgaccaaaaaatgtcgtattaagcactatacattatttgtcaatatagaggtggagtccaactatttaaagctcagtaaataaaaacctttaatgtgttatgaagtttaaggattactttctttttaggccttaattagctcaacaaattaaattgtattccctttccattttccttcacagcatcacacaaataaatac

SEQ ID NO: 235311 - DNA, 418 bp, Homo sapiens
cattcataaaattattaatccaaattgcgaaagtagacttttacagagtcacaggtcagtaacaaaacaggaaatgaaatgttccagagccttgaataactcttcacaatattgctttctagaattttagttcctgcctctttttaaactataaactagtattacatttatagccagtatttaggtgtaccctccctctcattagtttatgcccctagacaaattctctttttgcttaagtacacctactttcttccactaaagttttgtacattgcaaactgttgagtctttgcatgtctgaaaatgtcttcatttcccccgtgctcttgaatggtgtagctgatagcaaattcaaggctgagttttctctaggtttgaatggactccaggtgtctactgtagctaactagatgtct

SEQ ID NO: 235312 - DNA, 688 bp, Homo sapiens
agatactgggcagccaaactgaagagaatgattctgagtttaaaaattttttaagtttcatcttgaatggatttgagagcactttaaatattggtagtgatttcgtagtatagagattcaggagaaaagtaaccagaaaagaaatggcatttcaggcagaaataacatcagaaaaattttaaaaactaagaaaatagtaataaccgatttaactaagaaccagtaccttttgtatgtagccactagcttcatgctttgctacatcctttctttgcagaatctgatatttagagtttctgtaatgaatttaaggtcacagaactattgaaaaagttatcagttgcacaaataaaattactgtatttttaacattaaaagtcagcaaaagaaattatatcgtggttgttgttttcctgatattattttaataacaattactacaatttacctgaatcaataactacagtagtatttattaccaaaacgaagattaagaactaggattgtttagtcagccacaatttattacccctagaaaaatacgtatatacttataatttgtgaattttattaaaagatttcacaaaatacccaatgatatcctagctctcaaaggccttgattaggtaaggcccaatgttagtccatttgtgctaatggccaagagggcgtgttaggttttacagac

SEQ ID NO: 235313 - DNA, 345 bp, Homo sapiens
tgcccatgtattccctgaaaagtcttcatgtaaccctagagatgcagacattctagtttgaagaaagcttcctttaactttcttcaactaaagatgtcaacagacatcatcacaattagagtctattttaatttaccaaaggagaaaagttaagcctggcaattactaattattaatacaggttgaatatccctaatccaaaaatctgaaatgctccagaatctgaaacttttgagcagtgatatggtgcttaaaggaaatgctctttggagcatttcagattttggatttttgaattaggattgctcaggcagtaagtatataatgtaagcatccaacatctga

SEQ ID NO: 235314 - DNA, 440 bp, Homo sapiens
cacagcaattctcgtgaacactaaattttaagaatttctggactagtacagggtgacaacagaaataaaatctacaagctgggctgtagtctacaaactgaagtctgggctggcaaaagccacatcagctttacaataactgtgccattactagtcatgaacgggggagggcacagtgtgccaaggggctcctgctgtcctcaggctgccacgacatgccgggattctcctgggcttatagcgaggctacttcccgacaaccccaccatacactgacaacaccgtgaagtggaaaatgcacagaatccacctataacccaccgaacaccatggcacagcctcacctgccttaaatgtgctcagggcacctacagtagctgacggctggatgacatcatctaacacgaagcctattttataataaagtttttagtatctca

SEQ ID NO: 235315 - DNA, 585 bp, Homo sapiens
ggtgatccgtttcactccattgttgtctccaggaaagcatggtttctgtctcctcctgtccttcccccatccccaaccgggggccattcagtagacatttgctgaacacacggatgcgtggagactgaagcctctgcttggctgccttgtgcatttcttcggagtttgaaataagataaccaaagtgagagtaggtttagaaaaagccccctcgaatggaagggtttttgattcctgtcttttccctactctttgatgatggcaaaatgctgataaaatctgagggttggatgaaatgaaatagcccttcagggtcctctgccatctgggtaggtggtgattaaaaatggcaagcctcacagcttcccttggagagctgtctgaggcactgctgaaggtggatgtgcaaaggggcttggcattaggggttggctgaggactggcagggcagctggggaacgcctctgaaagcaacactccccaagatctcattaaaatgcttcctctggccgggatttataggcatgagccactgtgcctggcctggtttgtaccttttaaacgtattattattattattttaaa

SEQ ID NO: 235316 - DNA, 436 bp, Homo sapiens
tttttaccagagacagggttttgtcgtgatggccaggctggtctcaaactcctaacctcaggtgatccaccagccttggcctcccagcatgttgggattacaggcgtgagccactgtgcccagcagcttttttcgtttagatgccaggattcaggtagttatttgttaccacggtataacctagcccatcctaacaaatatgggagtggatcatttgtcctcttgcctggcccctgtcacttcttctctgggactaagaaggattaggaaagagacataaaagttcatatgtaccccgtagggactgctcagagatgggagcagaaagaggagatcttagaaccagacgtgatgactgtcagagtgaagtcccatgccctcaccccaaccctttccttccatttatatcttcatttttttcacacaacaaacacta

SEQ ID NO: 235317 - DNA, 377 bp, Homo sapiens
tgtctcagagcatgccctctctcctgacttttcggggccattattgactagagctgcagttgccagattttttcctaaactgaggcaagaattgagtctacttttttttgtttttcttgagtctctgtttacctcaaatctagagacactctgccctctagtggaaatttcctaaaggtcaggtaatcagttagtcatctaagttcagaggccaacagctataatcaactgtagaagacccatccaacacaaattcaaggagctgatccaaagcaaatgcccacctccttggcaacagttgttacagctgtgttccttttcacttccttctctcctttacttaaaccacatttattatccttcagttctggaggtca

SEQ ID NO: 235318 - DNA, 402 bp, Homo sapiens
gaaatagggtcttaaaggatgagtcagataagaagataggtttaaactagacagagagatggtatatgtaaagaccaaggtcatgaaagacattattattataatggtgagaggtgtgtggccctagatagcatttgccatgtgagaagtaaattggaaccccaaactaaaagtcttgttaggctaggtgtttagcccttatctcatcagcataggggagccatggtgatctgagaactgggagagtattcagggcaatattttttatgtatagcggttaccacattgtattacagtgttctccttcacttgtcattggagctcttcaagtgctgtgaccattagttattaatctttgtgtgctaagcttttggtagagtaactgataaaagtaatgcttag

SEQ ID NO: 235319 - DNA, 500 bp, Homo sapiens
aatgtttgaaaagtttaaaagaatggttgtttctgtactgaacaggtgcatcttcaatgttagctaaatacacctctaacgtattgaaggaaaaaattcaaaccagacagagaggactggaatatataactagcgcttcagtgcaaagacacagacctacatcatgagaaacaacagcccactaggaaccataacctcccccacccaaaaaaaaaaagtcactgaccatagcaagatagcaatatgtgagttctctgaccaagaatttaaaatagaagttttaagaatatgcagtgcatagcaattcacaaatttatgaaagtaatttaacaaataaattgaaataatttttaaaaatcaaatagacatcttaggaatcaaaaatgaatttgctaaactgaaaaactcattggaggctctgaacagaagaatggaataagcaaaggaaagaatcagggcgcttaaacacaggctatttgatattacactgttagagaaaa

SEQ ID NO: 235320 - DNA, 354 bp, Homo sapiens
gtccagaattcaggggtacctttcgtgggggggtctggcttggggtctcttttgaggctgcacatcagctggacagcccacttccagggtgctctcacagggcaagggcaggaggcctcagcccagcaccttgcggcctccccacagggctgcgtgcgtgtctgtgggattgccattcacttttcctgagcaggcgattggagagagagagagagagcaaggaggggtcacggggcctgcatgtcccagtctcgggtgttacaccctgtcccttctgccacactatgttctttccatgtgcgttaccaagtcagtcctgtcttaagggagggtaattgtgcttcacctttttct

SEQ ID NO: 235321 - DNA, 180 bp, Homo sapiens
aagctagagacaattgggaagcaatagtttatagaaaaggtctgtttgagctgctccttcttacctatggctggccataaaaattcccgtgaaaaagatgcagaagggatcctgcctgtcctttctgcctaaagacagacatgcagattatcatccacttagctcggagactggcaccag

SEQ ID NO: 235322 - DNA, 380 bp, Homo sapiens
gcagggtccaaaataagtatatgccgttccatggaaaatctgcatcttaatattgccaaggttttgctccagggtttcatgcaaaattaggtttttaagggtagttttagtaacttattgagatcatcaagaaacattactttgtttggaggtgtgagagtagccaagggcaagagtaattctttttaacgcaacttatttaacatccatacgtttgggcaataatctgaactttaatcagatcttacattactcttcacagtcaacccagtattgagtttcttgcaaaactgtagagaatgaagaatcctatcttctgctaaacagtttattatgctatcatattaaaatattaaaataaaattaatattattttaata

SEQ ID NO: 235323 - DNA, 618 bp, Homo sapiens
cagagaacaggtgagaggagcccccggtgaagccagattggcaagctctgcctctctccgcactcagtgttctgtgacttgtgcctggatgacttgattgctttgtccttcactccggcacagtgattcttgggtacagtacctcagtccttggaagggcagcatggagcctcagaattgattgccacactacccggtttgctccttgagaaggaaacatctttgattcccctcccctacccccaatttcagaaaatctggttgtatccttagaaatgacactatccgttcatcagttcatggatattttggtttctagtttttggctcttatgaataatacctctgtgagtgcccacacacactttttatgtagaaatgtttccctttctcttggcatatgcgtaggggaggaatttctgggacattcattatttatgttttaaccttttggaggaactgccagactgttttacagtggctgccccattttacattgctggacatatgagggttccagtttctccacatctttgccgacaattgttgtttgtcttttagatgatagcaaagattccttttaaacctaccagagattgacagtttgttggtttttttt

SEQ ID NO: 235324 - DNA, 523 bp, Homo sapiens
actgggagtgagagtttaagtgccatcccaagatcacacagctggtccctgcattagactgcctttctcattcacttgcaccttttctagtaggaacttgaccatgtacttttaaagtgtattaaatatggggtcaggcacagtggtttatactcctgtaatcctagtgctttggaaggttagcttgagctcaggagttcaaggctgcagtgagccatgattgcgccactgcattctagcttagccaacagagtgagaccgtgtctctcaaagaaacaaaaaacaagcatcttaaatttgggtgttgcggacatataatttaaagaggattaaatgaaactctaacctaaaaagaggattttgcaacaagttataaaaataataagctaattttggctgggtgcggtggctcacgcctgtaatcgtagcacttcgggaggccgaggcaggcggattgcctgagctcaggagttcaaaaccagcccaggcaacaaggtgaaatcccatctctactaaaatacca

SEQ ID NO: 235325 - DNA, 238 bp, Homo sapiens
agagaaagaaaaaaataaatacaaaataacatgcttaactatgtatttctctctcaaggaaatccaaaagtggacagtctaaggctgctacggtggcccttaaggacatcagagatccaggctccttttatctgtctgcttcaccatacttagccagagagggtggcctcatggtataagatgactgctggagtaccagccatcccacaaacattctggagaggaggagggaaagaac

SEQ ID NO: 235326 - DNA, 520 bp, Homo sapiens
cagcactgggcaagaggagctggcttcagtcataagcttatttaggatctgagattaaaacctacccgttggattgctcctgcaaataacctttcagaatcccaatatgcattttataagtttcatttctcttgctgttcaaagctgacataagctggcttgttttcttattcaattttcagtcctttcttggacctcatgctgtcttttgggctgtattcttatagatggttatatttattattttaggctcaaaatagagaatttaaaaatctttttactgaaaggattgactgaacagtgatcgtcattcagcaagtatttgagcatctaccagggccaagcattgtgcttggcattggaaatctgatggggagcaaaacagatgtggttccttcctgcacaaagcacattatctagtctagacaacaaacaagtcaatagacatatgcatcatatatattggattgtaatatgtgtaaaatctccttcctctgaaggaaaagaacagggcaccaag

SEQ ID NO: 235327 - DNA, 425 bp, Homo sapiens
agccatagaggggctttatttttatacttgtctgtacacacctttttttggatatatgatttgcaaatatttttccccactctatggcttgtctttttattttcttaatggggaattttgaaaagcaaaagctgttaattttgataaaaatttatcaatttttaattttatggatcatgcttgtagtggtttacctaaaaatctttgcctgtcccaaggttagaaaattttacttctatgttttcttctagaagttttatagtttagcctttacatttaggtatgtgttccatttaaatttttgtgtatagtgtaaggttatggtctatgttcattttgttaaatatgggtacccaatttctctattaaattgccttggatcctttgtcaaaaattgactgtaaatataaatgtttatttctgga

SEQ ID NO: 235328 - DNA, 253 bp, Homo sapiens
aaacatcacctagttctgttttcaggcatcagaacatgtaaaccactactggaatctgtaagaagacccagagccaccagcccagccctctgaccccaactccccaacaagtccaggtcactccagaggcccccagggcctgtttaacagtggccaaacaattcaggaaatggtctagcctcactaagccctttgtgctattttattttcaagacctctcagcacggaggtgaggagtatgccggacaacaga

SEQ ID NO: 235329 - DNA, 423 bp, Homo sapiens
aaaggaacaagaagagggactgacacctgtccttgaggagagtggggggtgagctgaagttgaaacactggtgaaaattggatttggacaactcaaaggtggtcatgacacttaagaaatatgcttgtctaggctgggcgtggtggctcccacctgtaatgccagcactttgggaggccgaggtgggcggatcacctgaggtcaggagttcaagacgcgcctgaccaacgtggaaaaaccccgtctctactaaatacaaaaattaaatgggcgtggtggtaggtgtctgtaatcccaactactcaggaggctgaggcaggagaatcgcttgaacccgggaggcggagattgcagtgaattgagattgcgccactgcactccagcctgggtgacagagcaagactccatctcaaaaaaaaaaaa

SEQ ID NO: 235330 - DNA, 536 bp, Homo sapiens
ctctgttgaagagtagcaagactctcgcgagttcttaaaaatgcacttgtttggtatgagaatgaaaagcagtggctgaagaaccaatcttcaatgggcaagccttctctgatgccttgttggtggtatagtgtgaatccattagcactgaactcaggaccagcaatggtgtgactcaggcctgaaggaagcttttctagcacatggatttcctctgtaaggcacctcacagcctctcgtgcctgggaactctagccagcactgtagcacgatgcctagggccattataaatgtgaaatcaccaaagaaaccccacaaaaatgtgaaaatcacggcactaaatagaccacaaaaaggatgcttgtttgcagtatgagaactggaaccagaaagtaggatgtcaccttgttcttccttagcactggatgactcaaatttctctccactctgccagtgtctttgaatgaccaggaaattgctgggaatattgattttgggataacaaataaattttatcgactagctgaatttgcaaa

SEQ ID NO: 235331 - DNA, 536 bp, Homo sapiens
tattgcctgggggccctgtgtggacccatcccttggagctgttaaacacaatcacacaatctttattgcttgctgaattgcaattatcagattatataggaaatgtttaaggattttatgtatgtgtatttttatttgttttgagtcaaaaatcaaaagggaagaatggtcattggagctagaatatacttgtggctgtcccagtgaactcctagaaaaagtaatccctccacttgcctttgctggagcacatggttcagggatagtttaggatcccctctctcctttcccaaatcctcccatgcatgagcttatctgctgtgatgctgatgtcctggatgtgattgattacccaccactatcttggggacctgggaatgaccttctggatgcatttgtaaggaatcagcttgggaagaaaaacaaaaacttgaaggcatcctctagttggcctgagataaggggacctcagagtcttctttcattagcctggcaaaacaatccaaacaataaaaaatccataagaaaatattctg

SEQ ID NO: 235332 - DNA, 910 bp, Homo sapiens
actggaggcggcggcagcggaggcgcgagctgcccgataatggcggcctgcagagcccatgagagggagaagcggcagcgtctaccctgagaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcatcaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaat

SEQ ID NO: 235333 - DNA, 431 bp, Homo sapiens
tgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacaggtatgtgttgttgattgggaaatagaaatgatttgaacatggcattggccagcaagaagaggaatgaaagggtcagacgaacgtttccctttaaatgcaggtgtttgtagttagaagtagataagtgtctgccaagaattgagtagatgtttgctttaaaacaaggttttatttaaacctgtgaggcacatacctaaaaataacataagccacctgttatgcaatggtacttgccagtctgcataggaatggggcaagataggaactagagaggtgcttgaga

SEQ ID NO: 235334 - DNA, 1157 bp, Homo sapiens
actggaggcggcggcagcggaggcgcgagctgcccgataatggcggcctgcagagcccatgagagggagaagcggcagcgtctaccctgaggaaggtgctcttccccatggggactgtaccaggctggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaat

SEQ ID NO: 235335 - DNA, 678 bp, Homo sapiens
cagcctcgatctcctgggctcaagggattctctcaccttagcctcctgagcaactgggactcaaggcatgtgtcaccaagctgggctaatttttttattttttgtagagatggggtctgcctatgttgctctggctggtctcaaactcctagcctcaagtgatcctcccaccttggcctcccaaagtgctgggatcaaggcatgagccaccacacacaatcttcagtgtttattttgtcctctctgatttctcaacatttaatattaatatgtaagttggatatctccactcctacctacggatctgatccctgtgcttaatccttttacagtgttgccaataatcaatgatggtcatttcccagttccagtgaggtagtggtatcttatccaaagagaagagattaatttgggggttggatttttcttttttctttttttttttccaagtcagggcttccctctgtcacccaggctggtgtgcagtggtacaatctcagctctccgcagcctcaacctctcagtctcaagtgatccttcctcctcagcctcccaaagtgctgggattataggtgtgagccaccaatgcccagccaggattttaagacttctttgaactatggtttaggttttcgttgtaggattcttactgatctggtaaatgtaggctctgatcac

SEQ ID NO: 235336 - DNA, 483 bp, Homo sapiens
ttcttagggcttagactcatatggggacacagacactaaacagataatcaaaaatcactacagaattagaactgtcacgaggtctatgacggcaaatcacaaggtgctgtaagtgtgtacaaaggaatctcacctagtcggagacattatactttcaggtgtgtatcccacagtcaaagggttgaaagggattttttaaaggtcagagcatacaaagtagcaggtatgtaggatgaacaaggctagaatctactgtataacatgaggactgtaggtaataaaattgtactgtatgtggagttcatgctaaatgagtagattttagctgctcttgccacaagaacaaaaaatctaagggaactgtgagatgatggatatgttaactgcttcatcatggtaaccatctcactgtctatatgcatcccatagcatcatgctgtatacctgaaatatgtacaataaaagttattgttttaaaagatg

SEQ ID NO: 235337 - DNA, 433 bp, Homo sapiens
atgagttaaatgttaatcgcgttgaatgtgccttcccagcaatacctgggactgctggttaatctcgcagttaatctagttgggtgctacagcctagccaaggggacacataaaatgaaccatcacacacagaaagtacaaaagagagtgaagagagcaggaaagtctgaatgcatgtaataagagttccagaaaaagtaatggaacaggagagatatttaaagagatcacaactaagaatttccaagacaaacaaaaagcatccaaatgcagatttgaaaagcacattgtaccccaagaataactttttttaattctcatctcagtggttaaattgctgaaaaacagagaccaaaaaaatcttaaaagcagtcaggaaatgaaagacaaactcacttcaaaggagctaaatcagactggtaactgattctca

SEQ ID NO: 235338 - DNA, 398 bp, Homo sapiens
gcttgttgcctttgagggtctgtgggagagaatcataagcctgtccagatcttatcttctcaggaaggggcaggaaaacaacacagcaaaacagctgcccggacgagaacaccatctagtgtcttcacacaacacacccacatttggtggtttctgtttcccatgaagatgaaagaggaggggagaggcgtgtcagggattccctgagccctgataggagggttcaactgggcgaggaagggaccatcaggccaacccatgtaggtggacccactcagctctcaggactcatctcctccacctggaccgctctccctggtggggcattgagggactgagggctctggttttgttctctagaagaggtgatccatcattaaaaatctattaaacatgca

SEQ ID NO: 235339 - DNA, 787 bp, Homo sapiens
ctcgaagggaaccatcagcgcctcctgtccacggagctccaggtctacaatggcagcggccgccagccccgccttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgagga

SEQ ID NO: 235340 - DNA, 578 bp, Homo sapiens
aaactgagctctggaatgtttgataatatgccaacatctaaacaatcctttagctatatgtattaccttgaacatgctatttattcttacttaattcaaagaaagttcagaggtctgattattttaattgcaggaaaaacaaagcagttttgaaaaaacagtacctgaataaaactatattaaatagataacatttaaaatgacaatttattttccattcttactctccaatagaattaatgctgaaggactgttaaacagaattttggtttcatactgtctctttctgtttatgctcataccccattctactaagcttcctctcattagcttcacatttatatcacttgtaatagcaatagctgtaatttctacagttcctattatgaactatgcactgtgatttataagaataattgaaaaatcagagttaattcatattcagcattaaaacaaatcttaagtatagtcacagtcatataatccaatgaaataaaattgttcatgttgtaagtctatgttttttatatgccccatgtatttaaaaaacaataattttgatacatataaagttttaa

SEQ ID NO: 235341 - DNA, 333 bp, Homo sapiens
acctctgctgaagtctgggcttctgtgtgttctacggtgacaagccctcatcaagcctcaccttactctgaggctctgaaaggggacgcacaaggtgacagcatgtgcccaggtcatcctgctgccaggagcgaacccacaggtggggctgaggctaggtcagctgggacctggctttgtgggacacctagctcacaagacgatggggcagggggctgtccagagcgtccctggatgtccagcccagggctgagagaagtcatccgtgctccaggatgctgcagttagaaccatgtttgaaaatgaacatcttgccatgccactcctaacgca

SEQ ID NO: 235342 - DNA, 261 bp, Homo sapiens
tccagttctgatatttcatgtctcaattagaaaagacatggttggtagtgtttttgtttttttaatatgttttatatcatttttagttaatttatacaatggaaacacattgagttaccacagtatgctttgatttatagttctagatagcataggacaattaatgagtgcttagacatcatccagatatgtgaagtctggcaggcttgacatctacttttatcttacttacatttaattcccaattaaaattttttatta

SEQ ID NO: 235343 - DNA, 381 bp, Homo sapiens
taataacacacatgagaaagagctcacagtgttttccagaaaaaaacactttgattctataaaagaggtcagtagactacaatatgaagaatccttctgttggcttaacttttagactatatgacaagttctctgactataaagacactgatcaaaagaactcagtttagcacaatatccaaagtccaaagtacaagcaataaaagaagaatcaggtaaattagactacatcaaaatgttaaactttttgcctcaaaggacaccatcaacagggtgaaaagacaaagcatggaatgggagaaaatatttgcaaatcatatatttgataaagggttaatatctagaatatataaagagctcctacaactcaacaacaacaac

SEQ ID NO: 235344 - DNA, 217 bp, Homo sapiens
aatgcagagatgtgggaattttattttaattgtaggtggcttaattaatttacagactagagaaagggatgagtacagaaggaaaaaatgaaattacaggattaacagcacacatattgggtgactttaagtatttagtggccaaggaggtgatgacaatgggttttcttttcatatctaaaacagttttcattgagaagataagaaaaaaaaagaa

SEQ ID NO: 235345 - DNA, 459 bp, Homo sapiens
aatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatct

SEQ ID NO: 235346 - DNA, 292 bp, Homo sapiens
tgaatgttgtggagggaaactgtttccagttggaggtggggcctgatttcttggcaaacgcgtaatagttgtcaaagcagctactgtctaccttacagatatctttgagtatctcccattgattatctcacatgatcaatgtgcagaatttttactttatggtcagccatctacccttccttgcatgctcttgggtgcctagcatttgtgccctcagcaggactaagtcggaggggctctatttccttccagggtatcttactgggagaagtgggacaaagaagggggaaga

SEQ ID NO: 235347 - DNA, 349 bp, Homo sapiens
agagttggagcatcgtaagggtatggaggagaggggaggagagtagtagaggtctcagcagttgtcagatgacaaaaagtcttgcgttactaattttatcgtatgaaatgaggatattttttaggtttttaagcagagagaatggcaaggtcatttggttttagaagttagtccgagctaggcatggtgacagatgcctgtactggacaagctgaggcaggaggatggcttgagcccaggagctggaagctgcagtgagcagtgatcacatcactgcagtccagcctgggcaacagagcaagaccttgcctttaaaaaagaaaagtctgaaatacccctcacaactgtt

SEQ ID NO: 235348 - DNA, 411 bp, Homo sapiens
caggcttcctcccttcagtcagtccatgttttcctaccatttaccatgacacacaaccagcatctgttcatgaacctgcagtgagctcttaccactgcaggcgccaccctctgcttggctgcagcagatgcagagtgtggcgaaaagtcaggagcaagggggctctgtctgttgagacacacactcctactgcaagcctcacccccagaccaactcactctactgtgacagggtttctccaccgtggaccagctgatttgtcctcatccccaaacctggagttggacatgttttcattgcaaatgcagaaagataaatctttgctgaggggaccagtagttgcccagtccagagctaaaaggaagtacatgtttttgtcttctataatataaaacggtcatattatttcat

SEQ ID NO: 235349 - DNA, 767 bp, Homo sapiens
gggcaagactccatctcaaaaaaaaaaaaaaagaaaaaaaagaaaaattagggcagcttttagacatgaggccccaaagtgccaactagtgctcctaaacttcaactctcttttgagtgttttatgtatctactcagcatccagttgtaaatatgcaaaaatcaatgcctactgtatttaaaaattactaaattcacaataaccacacagaatctataataaatagaatcaatgtaataatgactcagatccaggggaagaaaattataaaattttggaaaaaatgatgagctattaattaagaaaatagtttgttccttggtgagaagactcaatgtaaatatgtcagttttctcctgacttaagtcttcaacacaggcctaataatattgcagtggcaaatgattgccaggggcaggaggggatttggggaagtggtaaaaatgatctgtgtcttggtagtggtcgctgcacaactgcatacatctgtgaaaactcactgaactgcgcactttaaaagggtgaattgtaatatacatacctcaataaaccttacttaaaaattacagtgtcttttttttttgtagctcaacagaaagattctgagatttggaaaaataaatgtgaaaaataagaccaaggaggaaagacctgccttatcaatagtaatctatattgctgagccataatactttttttaaagtgtagtacttatgtagcatttaacagaaagatccagttggaaataaaagtatggaatagatcca

SEQ ID NO: 235350 - DNA, 659 bp, Homo sapiens
gtgaaaccccatctctactaaaaatacaaaaaattagctgggcatggtggtgcgcacctgtaagcccagctactcgggaggctgaggcaggagaattacttgaaccaaggaggcagaggttggagtgagccaagatcttgccattgcactccagcctgggaaacagagcaagataccatctcagggcgggggaaacaaaaaggggggaatctcccctgcagatttccaaataattcgtgtatgtacgttttcctctcacagtagtagagcataatttcccctaccttcctaacttgtctccacctaggtgaagttattatattattatcacacaatgtagctagacactaagctagttttacaatggacagaaagtaatttcattcctgcataccttgggcaaataaaactttctgtgtatctatgtcagaaaattcataatggggaaatgaagattaaaaaatttaaagtaggcagggtgcaggggctcatgcctgtaatcccagcactttgagacgccaagatgagaggatcacttgagcccaggagttcaagaccagctggggcaacacagactaggccctgtttccacaaaaaaaatttaaaaattagctgggtgtggtggcagctacttgggggctggggtggaaggatggctt

SEQ ID NO: 235351 - DNA, 953 bp, Homo sapiens
aacccgggaggcggagcttgcagtgaaccgtgatcgcttcactgcactccagcctgggcaacagagcgagaatccatctcaaaaaaaaaaaaaaaaaaaaaaaaaaaaaaaaagaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaattacagattatccagaacaggtgggctgtacataaacaggctggtgggctggatttgtcctgtggactgtagtttgctgacatccaggctagatccttaatatacaatgaagtagtaaaacacatgtaaaagtaaaaagcaggcgaaatagaataaaatacacatttgcacaccacagtatccaaaaaggttatgtactggggctaaagatttggcttggagtttcctggtagtcaaggcaaaaaagggaaacaaaactagttacagagtttctcggacctatgagcaaaaggatttccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctg

SEQ ID NO: 235352 - DNA, 329 bp, Homo sapiens
acagggtgtgaggagggtggcagtgggagatcagacaagagaggcaggtggaggccagattgtagaaggtcttcgattccatccctaggagcttgaatgaatctggtaaatgaaggggagccattgaacatctctgagcaggggagtgatatgatgtagcacaacaggggttatcattctggtagcaaagtgcaggaacagattgaagggggctgggtgcaatggctcatgcccgtaatccccgcactttgagaggctgaggcaggaggatcacttgagcccaggaggtcaagaccagcataggcaacatggtgaaaacctgtctctga

SEQ ID NO: 235353 - DNA, 511 bp, Homo sapiens
gcacgagccttgctcaaatgacctgctcacacagaagtctctactcacccacttctttctagctcacacccagaggcagatttcagttctgcacagttccttctgagctgtggggcctcccaccagtccctactctctccaagactcaatttcctcatctgtgagatgggggtaagaagaatcagtgggaataagaggagataaaaatctgtgtagtacttgggcggggtgcggtggctcacccctgtaatcccagcactttgggaggccgaggcaggcagatcacctgaggtcaggagttcgagaccagcctggccaacgtggtgaaacctcatctgtactaaaaacacaaaaattggccaggcgtggtggcgggcgcctgtaatcccagctactcaggaggctgaggcaggagaactgtttgaacctgggaggcgcgggttgcaggttgcagtgaactgagatcacgccactgcactccagcctgggtgacagagcaagagtctgtctc

SEQ ID NO: 235354 - DNA, 769 bp, Homo sapiens
tgagagcaccgcggctacctggcttccctgagtcccggctgccgggaacgggcgcgggggtgaataggtaagttagcgcctagtttccctcgctcatccaagaagcgaagcttggaatcgatctttggtgggactcttccccagatgtaagaagccatacactaaaggggaagggaaggaacattgagtcctgctcatgggcctggaacgtttcaacgccagttatcccatttaacctccacaatcgccattgcagaggaaacgcaaaaagatttgaatgatttgcctaagtcacgttatcaaattagatgagtttctaaatcgttacatgaaaaatttaaaactcaaaatagacattacttttgtagcctcctttcctcgatgaacatgttacatccctaaatgcttatatatcaccgttttttcccagtgattcatggtggcatggtggcatgaatcctggtgtgtagatatctcgcccattctgctattgatatttagatgataatttaaaagataaggctgggctgaatatcttcatacataaatctttgtgtatgtatgtatttataaatgcatcctgcattttcgtacggctgattcctagaggtgtaattactgaatgctccctttattaatttgccttctgcacaaagcctcaccggaaaagtaccctccttttgttaccctcagcagggctgaattctattgtacttctaaacatctttgctcattttgtaggtaaaataataatactggcatttccttg

SEQ ID NO: 235355 - DNA, 3421 bp, Homo sapiens
ctcccagcgtgctttgcggcgggccggcccgctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtag

SEQ ID NO: 235356 - DNA, 729 bp, Homo sapiens
ggtgatctgcccaccttggcctccctaagtgctgggattataggcgtgagggtcaggagttcaagaccagcctggccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtag

SEQ ID NO: 235357 - DNA, 3265 bp, Homo sapiens
ctcccagcgtgctttgcggcgggccggcccgctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggagaatcgcttgaacctgcgaggcagagattgcagtgagccaagatcaagccattgtactccagcctggacaacaagagcgaaactctgtctaaaaaaaaaaaaaaaacaacaacacaacacaaggttttcacgcctgtaaacctagcacttggggaagccaaggtgtgggaggatggcttgaggccaggagttcaaggctgcagtgacgctatgatggcacactggtactctagccggggagacagagtgcagacacttgtctctaaaaaaaaaacactaaaaaaatgttttggaccctaaaaatctttggtggaattccaaaacactcttccaaaaagacgacgtaaacaacaggggcaactgcgtccttggtgtccacaggctatttaactataacaatacagacgggtttattctacgagcacgcggaaccaccctcggggctggcgcaaaacatctcaccctgggtatgctcccaattactcttaaggagaactgtgttagcctgcctgaacacattctgttctattacaaacttctaactctcgcagtcagtccatgcaacattagcccgaggaatgccctatactgtgacccaagacctgtgtcattctgaacaaatacgacacac

SEQ ID NO: 235358 - DNA, 3280 bp, Homo sapiens
ctcccagcgtgctttgcggcgggccggcccgctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtgctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtag

SEQ ID NO: 235359 - DNA, 1294 bp, Homo sapiens
ctcccagcgtgctttgcggcgggccggcccgctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaaggtatctagagatcaggttctggacaatgctgcagttcaattctgtgcccgcaaagtctctgctgtttcaggagatgttcgcaaagcactggatgtttgcaggtgagttacggctctgttgcattcttttatta

SEQ ID NO: 235360 - DNA, 1645 bp, Homo sapiens
actgtataggttttcgggaatatctacagaagcctgttcaaagattttattgaaaagaggaagaaatagggtattcagataagtttttgcaaacccagactcaggtttcttaaatgattaaaggctataagcaatgtgacttttaagcagcgtttgttctcccttgtttcctaccagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtag

SEQ ID NO: 235361 - DNA, 415 bp, Homo sapiens
agatgaattccttatcattataattttatttttcttgttatgtaaatgttcaactttcttacattaaatgctcatagttcatgacagctgaaatgaggtgttcatataaatgagcataaggtaatatggtgtaaaaaacaatgactccataaaatattgtcttctaggtacattgcatcatatataacaagggtcaaaactcaaatgtctaaaagggccagataggttcataaatggattatgaaagctgggaaaggagcatggtaaagagaagaatgctccctctcgaagagaagacttactcactagttcaccagcttagtgccatgaaggaaggcagactgagagtggttcaaggacagtgagatttacatgaaatctgacatctaaacattgacagctgttttcatcttta

SEQ ID NO: 235362 - DNA, 449 bp, Homo sapiens
agtggcaaagaaatgacatgcttccgggtgagcagactactgcaaatgaaaagaaggcacatcctttgcctagaagaaaacagaacaacagaatccctcacaaccatctgatgctgccgaacagctggaacacggatttcatccagaggaagagcccacagatgaaattacaacactgaatgagattgtttttaaaaaactgtagatacaactaaagtgtatttgaaagagcaagaagatttaaaatgaaagtaatggcataatggaaagacctgagataatctcaatgcaagcatatttaaaaggcaagagatggaagcccccggaaaggacctatcagtatagaaaatcgtcagcagtgatcaacacaaggataattactgctcctgaattagaaaattaaatggaaaagacgattgttcaaaagcatataacattcatctattaaa

SEQ ID NO: 235363 - DNA, 945 bp, Homo sapiens
aactcttcttcctccacgagaccgtagcgtaggttcgagacacaccctgtcagtttgtgggacttaagtggatacttgcatttgctgattaaaaattgaaagacgctgtttctgtggtttcagatcttgacattggtgatgttgaacctgctctaatgcgcctggtcctggtgcattttctagatggtgcttctttttagtctctggatttttctattggaagtcatttcagctttaaacatagctcactattgtatgtggctttgtagcctagagtgcgtttttgccatagtaccctgtgtaaccctcaccaccctgggcagggtgtggtgatgacagccatctcgtggatgaggcggctgagggacttgcccaggtcattgtggatggggccagtccagaagggctgaaggcctgactccagttctgaacccagacagggcggtgaagagggccgcttgccctacagtagctccaggcgtgtgtgggtgtgctcttgggcacacaggaggtttctggaaggaggtgtcagtgcctgggaggtctcaagaggaccctgcgtgttggagcagtggctatggtgggctgtgtccacgctcctgaggccgtggcgggctgtgtgtctctgtgttgccgaggccgtggcgggctgtgtctctgctgctgaggccgtggtgggctgtgtctctgctgctgaggccgtggtgggctgtgtctctgctgctgaggccgtggtgggctgtgtctctgtgctgctgaggccgtggcgggctgtgtgtctctgtgttgccgaggccgtggcgggctgtgtgtctgtgctgctgcctgagctgcttgctatgtgcatattacttcatcgatcagaaaagcagcacaaccaccagagaacaccgtatcctcccagtgcagtcctgtggctcatggtaccactgtcatggaaaaatg

SEQ ID NO: 235364 - DNA, 447 bp, Homo sapiens
aattagccaggtgtagtggcgcatgcctgtaatcccagctactcgggaggctgaggcaggagaatcgcttgaacccaggaggcggaggttgcagtgagctgagattgcagcattgcactccagcctggacaacaagagcgaaaatccatctaaaaaaaaagagttcaagttttggctctggcttggcacagtggctcatgcctataatcccagcactttgagaggccaggagttcgacaccagcctgggcaacagagtgagaccccaacactcaaaaactaaccaaaaaaattagctgggcttggtggctgtagtcccagctccttcggaggctgagattgctagagtccaggatgttggggctgcagtgagccacagtcatgccactgcactccagcctgggcaacagagaaagaccctgtctcaaaaaaaaaaaaaaatctcaga

SEQ ID NO: 235365 - DNA, 647 bp, Homo sapiens
tggctgcaggctgccttgggggcaatgcaaccccttctccacaactggagtccttgggggctgtgtgaccccttctccacaactggactccttgggggcagtgtgaccccttctccacaactggactccttgggggcagtgcgaccccttctccgcaactggactcctgtgtggccgtggctcaagtgaaaggcggtggctgtgaggcctgaaccaacagcacccacaggcccacgagtcaacttggggccggtgaagcagccgggtggggcagcagtgcccctgccatggatcagggcccgaggccgcaggccacagaggggccagcttggagaggaggctgcagaaacagttatggggggagggcctccgtcctgctgggtgaggaaggggtacctatggcaccaccaggggataataagctcaccgcactgtctcaaggccccacggtgagttcctaatgcagcctgcgcaaatgactgttcctgttgggaaaaacattcttcatttgagagcaatactttgaattgcatggtgagaccagtatcgctttactcagctcgcagagtgctgaatgagaagtttgggatgctaccaaaatgcaccagtagaatgtgaaatgcggtaggagaggaaaatctatctgc

SEQ ID NO: 235366 - DNA, 1686 bp, Homo sapiens
  misc_feature (1024)..(1024): n is a, c, g, or t
  misc_feature (1460)..(1460): n is a, c, g, or t
aaataagtatatctgtcaaaaatcatatttttatgagatgtgtcaatactggtctcgtgtcatttaggctacttggaaaaaagataaaaaaaatcctgtttggctccaaaaaggaaaaatcagcccctcctgcatgagtgggagctgcaaccctttagaactgataatcacaaacccctcagaaccaaagtgaaatgaaggaaaatatgtaacattaggcattgatggaagaggactagatcctagtgtaagcatcctaataaaaggaggggttcaaagatgctctccagaaccagtatttcagacttcctatgataaactaaatgtgccagtaccagagactccaggaaaaaccagaaatttgtttttgcaattagccgagcatgtagtccagtctttaaatgtcaattcatgttatgtttgtggaaaaactgtagtaagagtttccataagaagaacttccataagaagcccaagaattagttcctacagacccagttcctgatgaattcccagcccaaaagaaccaccctgacaatttttaggtcctaaaagtctgaattattagacagtgttgcatagctagagaaggaaaaggattcactcatcctataaggcggcttagttgtcttaggcaaaagctgtataatggtaccacaaatacagttacatggtggagttccaattacacagaaagagatccattcagtcaatttccaaggttgcagactgcttgggcccacccagaattccaccgggactggacggcccccaccaggttatactggatatgtgggcacagagcttatgctaagctgcctgatcagtggacaggtagctgtgtaattgacaccattaaaccatctttcttcttactgcccataaaagcaggggaacttctgggcttcccagtctatgcttcccgcaaaaaacaaagcatagccataggtgattggaaagatgataaatggccccctgaaagaatcatacaatactatggacccaccacttgggcacaagatgnctcttggggatatcggacccccatctacatgctcaacggaatcatacggttacaagctgttttcgaaattattactaatacaaccggtcaagccttgactgttcttgcccagcaggagactctgatgagaaatgctatctatcaaaatagactagctcttgactacttgctagcagctgaaagagaagtttgtgaaaaatttaactttactaattgttttctacacacaggtgatcaagggcaagtagttaaaaatatagttaaagatataacaaaactggcacatgtacccatacaagtgtggcacggactcaatccaggatccatgtttaaaaattagttcccagcaataggaagatttaaaactcttataataggagttataatagtaataaaaacctgcttactgctcccttgtttactacttttacttctncaaatgataaaaagcttcattgctaccttagttcaccaaaatgcttcagcacaagtgtactatatgaatcactatcaatctattgcacaaaaagacataagtagcaaaaataagagtgagaactcccactaataaaaagtgagagtctcaaagggggaaaatgaggaaagagagcgaccctctcatattgttctatattgttttatactcagtacctgttttaagg

SEQ ID NO: 235367 - DNA, 493 bp, Homo sapiens
tgccctcctcctccctattttgttagtttgctaacaaatatttgttgtgtaacaagtttgtatacagccttgttttgcgcatgtgtgaggctaaaaaagattctagctgaggacacacaactagaatcttcaatacattcctgaaacaactggaaaactttatgcctgagtagaaagacccaggccctacagcctgtcagagctgagcccaaaccctggctttggcacttacaggctggggactgtggacaagttacccattgcctcagtgtccaggttcttcccttgtagatgggagtaatgatacctaccttgcttctaataatataaatgaggtatacaaggagcccggtcccagcagacacttaccattttatcatcatcttaccaagatgtggcagcacagtgtgcaccgtggggacagacagtgcaagcgccatcaggacgtaggtgggagcctggccaacttggtgaaaccctgtctctattatta

SEQ ID NO: 235368 - DNA, 357 bp, Homo sapiens
gcttttctttcttctattcttggaaatttcctctgtcttcgctgagtggtcagctccacgctgctgtcaaaacaagacatgatgacagatgctgcctgaggcggattgggagagccagggccagtacagctgaaagagggtttatattttcatccagaaacctgcattagggaaagagggatgcgactgtcttcatctttgcaccatcttatccatccttttctgtctctggctattgcagtgttgatttgaagaagggaaacggaaagattcctcaaccataaagtggacatgggaactactttcacaaagttgttggaagaattaaataaaatgcctattattgtttaaaaatta

SEQ ID NO: 235369 - DNA, 784 bp, Homo sapiens
tgttcttatggcaacagatggacaacagcaactggaccagtgtgtcccattttgttctcttgggcatttccacccacccagaagagcaaatcccactcttccttgttttctcactcatgtacgcaatcaatatttctggcaacttggccatcatcacactgattctctctgctccacgcctccacatccccatgtacatcttcctcagtaacttggccttgacagacatctgcttcacctccaccacggtccccaagatgctgcagattattttctcccctacaaagaaatggaaaagccaatcctgaaattcagatgaaattgccagaaacaatgagtagccaaaactatctggaaaaaaaatgaacaaatttgtagaacctacactttcctatttccagaattattacaaagttatgaaataaaagaggatacaaacaaatggaagaacattccatgcgcgcacgtaggaagaatcaatatcgtgaaacacagcttgctgaactcctgcctgaatagaactgagagcggtcactcaagacgctgctcgaacagtcactgggagggtttatattttcatccagaaacctgcattagggaaagagggatgcgactgtcttcatctttgcaccatcttatccatccttttctgtctctggctattgcagtgttgatttgaagaagggaaacggaaagattcctcaaccataaagtggacatgggaactactttcacaaagttgttggaagaattaaataaaatgcctattattgtttaaaaatta

SEQ ID NO: 235370 - DNA, 404 bp, Homo sapiens
ttctctggctgtttccaagcgtgaagcagcttccccaaggagataatgacctaaatggggagaattaggctggattgaacgactcattaaatgtcacctccgtaaaagcaggagggacgagagctgggagtgcagagccacgcggggatcagcgtgaggggtgcaggtggaaacagagcttgaagctgttgctttctgccagccacccccatctgggctgcttaacaacagcctggatcggagcatgacagaggcagaagcaggtcctcagaaggtatttgttgaataaaatgaatgagggaggtggtggcccgccaggtaacaggtaacatgcccatctggctcagcctcaaggtctcggctggctctcctgggggcacagcctgcatccatccgaagggccc

SEQ ID NO: 235371 - DNA, 293 bp, Homo sapiens
acccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttc

SEQ ID NO: 235372 - DNA, 363 bp, Homo sapiens
ctcagacttgtgatgtggttggacttctctcctggctatgtgcagttgtcttgttgatcatcccagcctgattctccaggcttctaggagattgaggaactatcaataatcctctttatgtttaagccagctagggaagtctgctgtctgcagatagaaattgggaatggtacagctactataaagctgagaaaatatgatgcttcaagggagctaattgtgtttagtactgtttaaaaatggaaattgaaaagtgtttattaaacttagtgataggctcatttgtgaccctggagaaagcatggttttttggtttggttttgttgttgttttgatggaagtggaaatcagttacaataaata

SEQ ID NO: 235373 - DNA, 510 bp, Homo sapiens
cagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttt

SEQ ID NO: 235374 - DNA, 502 bp, Homo sapiens
atctcgggaggctgaggtggaaggattgcttgaccccaggaggtcgaagctgcagcgagtcgtgattgcgccactgcactccaacctgggtgaaagacaagaccctgtctctaatatataagaaatgaataaataaataaattcgattgccaaaattcttgctgttcccagcatattccactttcacctttcagcgcctttgcttatgctgatctgactgtaactgcattcccacccttctccttctgggtaaagggcatcttctttccaaactcaactcttagcatcagaaagctgtccctgatactgcagttgagtcgcatgtgatactgaaaaaaaaagaaaaaaggaaaaaaaagagagctctccctgaatcccttggtggactatgttaggtaaacttcatctttgcctgcatcatattatgtattggttcttctctgccccctcgattgtaaactcctcaggggcagaggtaacagctttgcagccctgggagtta

SEQ ID NO: 235375 - DNA, 338 bp, Homo sapiens
tatctcattccatgattatttgtccatatgtctaacctctagaatactagttcttatgtatcttcagtacctagtacctggcattcggtagacattcagtaaatatttgtttaaccaatgaatgagtgaatgaatgaggactgcaaaatagctaaccttcacacaagcaagaacagttgactggctaacttacagaatctcattaaaaatgcacacttgtcttaaacgttgcaaattgagaaattgaaaatcttcctctcctatagtcagtcagttagtattttgatgtcaatgtgaatttttctctatatatgataaacaatacaataagctataat

SEQ ID NO: 235376 - DNA, 435 bp, Homo sapiens
tgcaacttcttgtgagtcataaactcttccaagataagaagtattttaaaattccatattaaaaagaagggggcttgaaaaccccattgctgagtccttaggtcctatagctgggcttttttttttttttttctttttaaaaaaagggctgggcacggtggctcatgcctgtaatcccagcactttgggagggcgaggtgggtggatcacctgaggtcaggagttcaagaccagcctggccaacatggtgaaacctcatctctactaaaaatacaaaaattagccaggcgtggtggtgggcgcctttaatctcagctactcgggaggctgagtcaagagaattgctggaacctaggaggcagaggttgcagtgagctgagatcgtgccattgccctccagcccaggccaacaacagcgagactacctctcaaaaa

SEQ ID NO: 235377 - DNA, 466 bp, Homo sapiens
cagcgtggtcctgggttacctggtgtgcacctgactccaggagtcccatccttggtgggtcctagctgcaacaatgggtgctcctctgggaactgctgctgctgccccgtctggggtctggaagcagtgtggctagaggccattcggctctgaagttggcgagatgccatcttcctccttccggcctctgagtgaggatggggctagctcccaccttcctttctggccgctctggggcagcccagcgtggccagtgtggagggtggcactcctctatgagggaccccacggagcatgtgccatctccatttaggagctatctgtctcctggatcctgtgtttgagaaatgagttggtgtcttcacagaatgaggatccccagagccatcttgcccggtgctggctccccgcatgtctgtccctctctgggtgggggtcgcctggtggcggtgggactctgcggccg

SEQ ID NO: 235378 - DNA, 332 bp, Homo sapiens
gcccttttagtgatcaagcgtgactagtccatggactctggctggaagatgcaagatttcttaaccagctgccccagactgcctcggagaaaccacttaaggaatgccctgctgttgttaatgatcaacattagccagattgcagtcctcattatccctcaccccaataggaaggtagaagctatcctcttctaaaaatgcttatttagttattgactagcagttgtccctttggaagtctagcaatgttcagtcaagtcaagggaaacctttggttcttttgaagaactcttggatattctgtcaaagatgttattaaattcctggttctg

SEQ ID NO: 235379 - DNA, 332 bp, Homo sapiens
gggtgggtggcaggggcgggggagaagaggacagaagttattgacagtttcagtttgggaagatggaagcattctggagatgggtggagatgtttgctcaacagtgtgaaggtgcttgatacccctgagctgtacccttaacaatggttaagatacagccattatggaaaagagtatggaggttccacaacaaatcaaaactagaactaccgtgtgatccagcaatctcattgctgagtatgtatccaaaggaaatgaaatcagtgtgtcaaagagacgtctgcactcccaggctcagcacggcaccactcacaatagccgggatgtggaac

SEQ ID NO: 235380 - DNA, 334 bp, Homo sapiens
cttgaaaaaaatattgcttgtcctgtctgaattttgctgattgcatctttgtgttcttctatcccttttattttctgcaaattggtagttatatctggagggttgcctgagttcagttttggtgtctttggtaagaatccttcgtaggtggtgttgaatgtggactttcattgggaggcacagaaggtctggttgtctcccttttggggtgatggttgcccggagtatggtttactcttaactcctgtaatgtaaagggagggaggaaggaagaaaggaggaaggaaggaaggaaggagggaaaaaaggaaggaaggaaaaaaggaaggaagga

SEQ ID NO: 235381 - DNA, 300 bp, Homo sapiens
tgaagaaaaaaacatatgcacaacaactgacatcctgttggtagggactcttggtcctaaatttactatgagatttgttatgccagcccagccaacactggctttgatcaaatgcgaagagggaatagagccagcgttcccaactgtttctgcttccagtcatcctgggaccgaagccggaaaacacacacacaagaagcaagctttcattcctgcaaattctaatggttcttccccagcagtctccagcttttcaatgcttccgaaactgagtgctaacaggggcaattagtgctggta

SEQ ID NO: 235382 - DNA, 342 bp, Homo sapiens
ggcatcagagacacttggtggcagcccaggtagtagaagaacattggcatcaggggccagttgcccatcgtgatgttccctcgtaggtcccacctcatttaacttggcatctcagcactatttggccatgttgaccaagctacttcatttccaaagacctcagtttttacaaatgtgagtgagggaggttggtttgggtgattcattcattcagcaagctcctgtggaacgcccgctgtgtgcctggctctggaataacagcagctgccggttgttaagtgccagatactgtgctcatcatttcccatacattatctcattaaatcctcttgtgagcctctg

SEQ ID NO: 235383 - DNA, 436 bp, Homo sapiens
ccacaccagggatttttaacttgccaaatgtatgtgattgatttgaaggcaataatccatcctagacctgcgttttaactctcactcctaaaacagagtaaaatatttcatgacaaagatttggttttccttcaagtttttcagcattaattttagacatccagctcaaatagctacaacaggtttgcgtaccttgtcatgattttggaatgcactgttcatcaaaactattatctctgggagaaattacaaactttagaatctgtgtaagaaaaggaaacagcagattcttctccatttacctaaaccaaggccttcaaaaaatgatgaattgacactgtattctgtgagcattataagtttggttctattaatgtaagaataatttcattttctgtaatttaatgttttctcttaaggtatgccttgacaatct

SEQ ID NO: 235384 - DNA, 409 bp, Homo sapiens
cctgtcattcaccctcctgtgccgacacctgcccctgttgtcctgttgggaccttaacattctgcagccaacctttggactaagtgtgtgcagagtctccatgccgcgtcttgcccccgaagactggccctgcctccgcaggcctggctgccgtctgggttggtgtccagggagtgggtgtcgagctctccctcagctgccacagcccagaccttcctgacattgctgcttggagcagaggcctgggcgcgacccctctgtcttggcagagggggtgactctcacttcgtgtttgtcagggaagaggtgaagtgttgagaatctggtccttggagtgggcacatctttggggagcagcagggcctgcttcagagtttgtttcctaaataaaacaatggctctccagtga

SEQ ID NO: 235385 - DNA, 674 bp, Homo sapiens
tataaaccaccataaaaatcacattaaaaaatttataacccttcttgaaaagtgtcatttagagaaatgatgcctacaaaaatttcctttacagtacataacatcatgaatgtattgaatttacctcaaatctggatatgctgctgctgcttaaaagagggtacctcatttcctgattattattttaaaacgcagacctcttttcagaatgccgctaagcctgagatcttcattttcaatgaaagctagcttagaacttttttatttttttccctaaccactcttaagtggaaaccaattctggactataaatgcagaaacagctataggagaagcagttattaatatagattctctagtgccacacagaagataccagtcagcttttaactgagcacttcacctttttcatttttttaaatatatttgatcatgtttttatgttctagtcataaaacaataccccaatacattatataaagctttagtgttacaaaacagaataaatcatttccctatctcctaaacaacaaaattttctcctatatctaggataattttttttcatattttaaatttgtcaggtcagaatgtctcctgtagttggtgatttctcagcaccattttctcagcatatttcttcagtaagttacataaaataatgatgtatctta

SEQ ID NO: 235386 - DNA, 373 bp, Homo sapiens
atcagtcaccactcccagcctacgtatataatttctaatagaaaaaattaaaacaacccaaaaagttaaaacaagcaaaaaaaccaggcatcaaaaactgcttggcagctgaattctgcatctaagagggtgtgaatctgcctcacctccgagtcctccacaggatcagcaacatttcagggtcactgatcactgccgctacctgggcagcgtctcctccttgccactccctttctcccctccaccctctggggaatctgtccacacgtgaattgtaggtaaaggcctggcctgccttacacatgccagcagatctggggtgggccagcatctgcaggaaggggcctgcatgcagcttcctggggaaggcgat

SEQ ID NO: 235387 - DNA, 1443 bp, Homo sapiens
tgaacaagaaatcttttttctttagctgggcatggtggcttacgcctgtaatcccagcactttgggaggctaaggcaggagaatcgattgcgcctaggagtttgagaccagcctgggcaatatactgagacctcatctctacacaaaatacaaaaatcaggtggttatggtggtgtgtgtttataaccccagctacttgggaggctgaggtgggagaatcacttgagcccaggagttggaggctatagtgagtcatgattgtgccactgcactccagcctgggtgacagaacaagacctcgtctcttagaagaagaatttttgtctctaatgctttgctaaaagaaaagcaatatctaatatcttttctttgttcaaagaaaagcagtatctaaaagtgcagagttttctgcattttctaaagggaacttgttgggaggtgctctctcctgatgcgctgttcttgagtgccatccatgatcagggttaggtttggaacagagagggaggagaagacagagaggctcttttgggataagtgagcaagaggtgggatggatgaggaaatgaggttaaacgagacccgttcttgtaagagcaaggagagtgcctggcgtggctcctggttttccatggtgggtggagggcccgggcagccgctgatgccctgtggggaggaacggaggccactctgcaaaggggcctctcgcttccccagtgtcttcatctcgaaaagcaggcagtcagtagcccccaggatgctcttcccaccaccagggaatcccaggaaattcacttaaacacacaagggagaaagcatcctggccagaggtcatgagtgtaagagagtttggttacagtagatccataaaggaagagctgggtggggggccctgaggggggacctctgtcatcctgatagttccagcgtcccggttctagtgtgttctagaagtcttatgtccttcccattttctaactgacgttgtcccctgggaggacaggttgttaaaactaccctataaatggatttcctggcaagcccagtgcattttaaaagatataacaaggatatttgggtccattcaatacaattatttggaaggatcatctgctttgaaattttgggaagttctgtgtagctttaagagatagatatggccgggcgtggtggcttacgcctgtaatcccagcactttgggaggccgaggtggcggatcacaaggtcaggagatcaagaccatcctggctaacacagtgaaaccccgtctctactaaaaatacaacaaaaaattagccaggcatggtggtgggcacctatagtcccagctactcgagaggctgaggcaggagaatggcgggaacccgggaggcggagcttgcagtgagctgagatcgtgccactgcactccagcctgggccacggaacgagactccgtctcat

SEQ ID NO: 235388 - DNA, 648 bp, Homo sapiens
ggacctcagatgatccacccgccttggcctcacaaagtgctgggattacaggcgtgagccactgcacccagcctaattttcttatatggtataaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagggtcccgctttgtcacccagcctggagtgcagtggtgcgatcttgactcaccgaagcttggatctcctgggctcaagcgattctcccgtctcagcctcccgggtggctgggactacagccgagcgcggtggctcatgcctgtaatcccagcactttggaaggctgaggcgggggaatctcttggaggccgggagttagagaccatcctggctaacttggtgagtctctatgtggtggcacacatccgtagtcccagctactcgggaaggctggggcatgagaatccgctgaatctgggcaagtggacggtacgcagacggagggacaatgcactccagactgggggacagagtaacgactccagcccaaaacaacaaaaacacaaaacaacaacaaca

SEQ ID NO: 235389 - DNA, 652 bp, Homo sapiens
ggacctcagatgatccacccgccttggcctcacaaagtgctgggattacaggcgtgagccactgcacccagcctaattttcttatatggtataaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagttgaactttcaaaggaaaaggaggctgcctttacatctgacacatgcttatagatggggattatcaacacgcctccagagacatggatggacattcctcccctaccttgcagagatccgggtagaagcctctttgcgctggattaatctggctttgtatttcgtagtgccgtcactttcctgagaagtcttacctttataccttggcacacgtcatcgtcctgagattctgtttcctttgatttattgatgccagagtgactaaggacatttcatttattaactttctttttttctatgtgatctctatactttaaaaaagactggggtgtcttcctggaaacataataggaaggaatgtctgtttcatgaataaatcatttgtgtagtcaaaatgtatatt

SEQ ID NO: 235390 - DNA, 260 bp, Homo sapiens
tcctcaaggtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctgtttgg

SEQ ID NO: 235391 - DNA, 4515 bp, Homo sapiens
  misc_feature (1986)..(1986): n is a, c, g, or t
  misc_feature (2502)..(2502): n is a, c, g, or t
  misc_feature (3010)..(3010): n is a, c, g, or t
  misc_feature (3594)..(3594): n is a, c, g, or t
tgataatgcttcattgttgaggctgttcgtgcattgtagactgttcagcagcattcctggcttctatctgctaggtgccaatagtgttttttatgacaaccagaaagtgtccagacactgccaaatgccgaggcaggggaagtgcagaatccttagttgagagtcactgctctagggtctggacccttccactaattaaatcttcttgcacctgcatacttagcttaccttggtatgcaggtgggtgaacacctgcctattagtagtgcccgtcgtcaaatcctgcatataaactggtaagaagtggtgctttctcttttcctggtacagatcctagcccagaggtgatgagcagtaaagctgcagattggaagggaggggctggtgaaaacagtggtgcggtgcagatggggagggattctagtagtaggcatcttagacttcagttggtgttggtggcaatggtatctgtacccctctaagaccgcatggcaagaatacaattttatatttaatagtgatcagcatggatgttggtgcgtcacaaacattgactcagcagtgtctaaacctgggcatttagaacaaggcctcacagaatcttctggaagtgcttcaaactcctttccaaacctagtcgtcagttgttttttgtaaccttcccatgttaggcctgggtggatcccctcttaaggctgtactttagggaaatattttttatcttcatatcactttatctgtcattcattctcctattccctgttggctgcatggggcagattaaaacagactctgattggactaattagaataattacttcaaggctaattgcttacttgctgctatctttaatcactgctacgtggtctgtggtgtggtggccacatgcccagagacccaggcctaggccagccgtctggaaatgactgtatcacccaggcacggggcatgcactggtgagctcagcctgtgactcttccagttaacggttggtattgggtggagtgggcacccctgtcagttctgggatagtctgatcttgttcagctggttgaaagcaaaatttagctttctggcttaaaatagttgggaaagtagggcagataggtcctgggccacatctcttgtgtggactcttctgattccactggagggggaggaaccacaggatgaagtcagggctgtgcaccgtcaggaggagctctgggccaggggggttggctgcccttgctgctgccagagcctgacaaggcagagggcagtaaaagaaaggaagctaacagtgaaccatggtgttaatcatgaagctcagagcaagcagagaataaataggccataaaaatttcagagctggccaggcttagtggctcatgcctgtaatgccagaactttgggtggccaaggtggacggatcatgaggtcaggagtttgagaccaacctggccaacatggtaaaaccccatctctactaaaaatacaaaaactagccgggcatggtagtgtgcacctctaatcccagctactcaggaggctgaggcaggagaatcacttgaacccgggaggcggaggttgcaatgagccgagatcgagcccttgcgctccagcctgtgctgtagagtgagactccgtctcaaaaaaaataataaaaaaaaaaatttcaaggccgggcgcggtggctcacgcctgtaatcccagcactttgggaggccgaggtgggtggatcacgaggtcaggacatcgagaccatcctggctagcatggtgaaaccctgtctctactaaaaatacaaaaaacaaaattagctgggtgtggtggcgggcgcctgtagtcccagctacttgggatgctgaggcggcagaatggcacgaacccgggaggcggagcttgcagtgaaccgagatcatgccactgaactccagcctggcagcctgggcgacagagcaagactccgtctcaaaaaaaagaaaaagaaaattcagagctgnctggccagttggtggatagccttcactgatacagtgctagctctctgggggatataggttcatctctgcaaatctctttcatggggctagtgggtgtacgtgtgccctttggtgaggccagcaaggccccctggacaggcttgctaccaggaaacacagatgggcttttcttcctaccgcctccacaacaaaatccagaaagtttgacagcagacttggttggagttacagcaccaccattttaactcgttgacttcggggaaattaagctttttgaggcctcagttttcctcatctgcaaaaccagtctaatgatgctatagagttgttatagaaagttgaatctttgtcatctattgaatgcttgaaatttagctaaaagtgtctcaggagatgggctaccttctgtgtttagtactgtctatcttggtgtgtacagaattgggacttggcaggttgaccttccctctggattcagaaagccccaggacttcttataaagttaggccatgggtngtcttggaggcttgggtctggtaaataattgagcctgagctcacaatcctgcccctgggtccaggtggctggtctgctgcccccaaaagcctgaccttcttggtcctgtgggtctgtcagtaaggcaggtagccatagctggagagagacagtcaccaggctgggatcttggacagtccctccatctctggttcatcctggcctaggcagggcatggagtagatggaaaatggtggccatcttggaaatgtgtcataacaactcagtttccaagaccgtcccctagaggagagatgtacagtcctgcatagtttctttaaagaatttttcagggccaggtgcggtggctcatgcctgtaatcccagcactttgggaggccagggcgggtggatcacctgaggtcaggaattcaagacaagaatggccaagatggtgaaagcccgtctctactaaaaatacaaaaattagccgggcgtggtggcaggcacctgtaatcccagctactcnggaggctgaggcagagaattgcttgaacccaggagctagaggttgcagtgagccaagattgcgccactgcattccagcctaggcaacagagtgggactctgtttccgaaaaaaaaaaaaaaaaaaaaatttcagacacctcatttaatttgcacctaatcttctgaggaggggcttgctgtgatctttgttttgcagaggcagaaacaggttctaagtggtagaatagttcagctcaacacacatttcatttagtgtccactgtgcagggatgagtaaggcctttgaagagctttgtcttgaagggaagacacaatttccacaaggccagatggaatagcaaagaggcatgagagggtgtggttgagcaatgtagggggaacccagcctgggcagtcagggaaaggcccccaaaagaggagatagacatgtcagctccttcgagagtcactctgaggtataggactagtgggtgacatttgcaacatatactggtcagtgcctctggggctggggctgggggctcagcccagagagggagcaggcaagccagatggcataaggttatttcctcttctcctttcnctgtgaaaacaaaaaagcaggaggtcctggaacttttcatgccagcagtagggctggacccaagggcatattaagttgcaagctggccgactgagactttcagacaatttattttgtagcaagtaggttccttaatagtaaataataccctgtggtctctgctcgacattttgtgagattggccaggagagcttcccttaatcaggactttgagctcatgttgccagagcagccggatattctgaggaaagggtcagtgggctgtgtcatagctgctaggaagttctagaagaccagtactaataagccttccaggttgggtcagtgccaaagtcatttttgtgggcctgtgcagccctacctccatactagttcttccaaggcctgggctccgtggcaggaacctgacatggcttattgtttgttctagagccctttgggggatggggtcagggagcatgcgggcagtcaagctttgacaaacatctggatttgctccagaactgcattaagaaaagtggttccttgttggagatgggaagtcagggcccttggttatgcatatagccaagtcaaacagattgataacacttgtcaatggcagggaaggttgcctgtagccagcactgcagattcaggacttagaaacgtgcctctggggccgagcatggtggctcacacttgtaatcccagcactttgggaggccgaggtgggtggatcacgtgtgatcaggagatcgagaccagcctggccaacatggggaaacagtcttcactaaacatacaaaaattagcctgtagtcccagttacttgggggtctgaggtaggagaattgcttgaacctgggacgtggaggttacagtgagccaagatcatgccactgcactccagcctgggcaacagagtgagactctgtcttt

SEQ ID NO: 235392 - DNA, 2432 bp, Homo sapiens
  misc_feature (423)..(423): n is a, c, g, or t
  misc_feature (1677)..(1677): n is a, c, g, or t
atgatcaaagtacagtaggtaagaagtaaattttcaaaaacgtgttgtggtccccctttaattaatgcttcacgcgcagagcaaagccataaaccatgtagcgggggcgctgtctgtgcgccctgcagtcacctccctcctgaaggtgccggagcgccctgatggcactcgcaggagaggctggtgcttctgggcaattctgaaacaggcctttctaaccatgcagtcctctgctccctttgtctcggaatgtcaggttgagacttgtggctgctccagtccctggagatcccttttggtgaatggaatgcaagtccattcttgaattattgtagtgtttgagctgtacctgcagaggccaggtctcagcacgtctgactcacctcagttggaacaccccgattcagagagggaacagattcnaagtgagagattgaccacgccgcctctaactctgtcgccgttgtttctttattaaaagtcagattgatggtaaattaggatactacccgactgaatactatccttgctgttaaaaatgattatggagatcatgcggctccatggaaaaatgctaatgattctgtgccaagtgtaaaaagccaaattcagcatggtactcttgctgtgcttacagttatataaaagtcatgcatctggactggaagggaatttggaaaaatcagatttatgggataagttgatttatggcattgtgggctaattttcagatttccttttttaaaaaacaataatgttcctgcagtaagttttaaaattgtgggtaaaagaatagtaaccccacaaggagtgacaattgagcttgcatttttacctcccctggctccagcatttgaaactttagacctggtcaccgtggcccgccaaggagaagctgcccgtagtgggagccaggccacagggtgggacattggagtggaaacggccagttccaccctataaaactttaatgcggttgttttatttttctggaagaaatgaaacgctcagggatgggactgaggggaagcagccgtgggccacctggtgcttttgaactggtcaccggagggtgtcgacaagggctgtcaggccatcgggatttctcctggttcccctccagggcatcctgacctgcatctccccagtgtcccagcacacagaggagagcaagccttgggcaggcacagcaccgcagctctgcatggatctgtgaaggagtggaaggatgaaatgcccctgggctgcaagccttctttccagaagggctgaaggaaagaacggattattggcccatcctttttgccagcaaagtagggtttttttgtttgtttttcttccccctcttttgatgtggggctgctctccctgtaagccgactgaaagggaaaacggtgtgctagaaccaagccatctgttgccaacaggaagggtattagcaggtctgttatgagttgctcttccgttggtagtattgatgtgcctcgtaagttaacttgcaagaatccaggagaacaagccagaaaggctcacggagcccatgctgccagtcatctgagccctgctaaccctcaggtccagcaggggcagtccatccctctccaggtgttccaggaacattgcagaatggcctgatctctccaactctgtgtgggcccggtccagaccaggagggcnctatggaggcagatggggttttgggccctggaccaaaacactcatctgcttacctcgcctcgccccaagaatggggactttggagcagaccggaataaaggaaatgatcttctggagtgggatctctgagtgccagtgttggccggtttcctggacatcacctctgccagcagtgagctctgggcctcacaggtgtgtctgttcatccagtggtccttttcctctcgtaggaaaggatgcctgtgctgcacctggccagagccagacccttccccaccctgcgcagtttgaccagcgatgggctcagcatctgacacctgacgcctccatccgacaggtgttccctgagtgacacttggttagccagacagccctgccctcatctgccctcctgtagactcacccgtggacacaccatggtgtactcggtttgagagcttaatcatagtgggtagtgctggagaggggaatgggacaggatgtggtcctgccgcaggggctggccgcagcctgcctgagggagccctgggcagggggccaagggtagcccacctgagtatcggccccctggatgctccgcaggtctgcgggttggagtgagggcagaccagccagggcaccctcattctcctgggaggatgccttgctttcttggtctggtggtctcttagttacattacactccggtgtattcgtgtactgatttttcacaaaagctttttagtttggaatggtatgacttactgtaaaattgc

SEQ ID NO: 235393 - DNA, 811 bp, Homo sapiens
atgatcaccattttgtgaccctcaatgaaataattccagcaaggatcagcaggtgaaaggtttttggggaacaggatatttctagggtgtctaagtagcatccttagattaattctcattgtaaaaggagaaccactttaacatggagtgaccttatagtctccacctattccaggtgggcaaagctagtttcactgaaaatggatcaagcctgtattacgtgctcatgtagtgcagtctgacattatcaccatcacctgtggtatattctagcaaaaaatgtctaacctgaatttagtccattggattccctatttacaggaaatatgggggataaaagaataagttagacacaaaattgtggaatactttatgagaatactgacttcacatcttctacagtcattgggtagctgggagagaaaggtgggacagactgctctggattactgagattggccgtaaacaccatgcatggaacttggtttgatcttgggtaagaaggagaaaagctagaaaagatgttaggagccaggaacagtggcacacacctgtaatcccagcactttgggaggctaaggagggcagatcacttgagctcaggagtttgagaccagcctgggcaacgtggcaaaacctcacagccactaaaaaaaccaaaaagttccaggcgtggtggtgcgtgcctgtagtcccagatattgaggaggctgaggtgggaggatcgcttgagcctgggagaagttgcagtaagctgagatcacgccactgcactgtagcctgggcgacagagtgagaccctgtctcaaaa

SEQ ID NO: 235394 - DNA, 426 bp, Homo sapiens
tagctggtgagctaaaaaataaaaaaggtccgtgcatcaatctcataatgttttaagagagtttacgaatttgtgttgggccacattccaagctgtcttgggccacatgtggcccatgggcagaggattggacaggcttggtccgtcacaatcaataggaacccaaagagacagaacaactaaatgtcctgtggtatcctggatggggtcctggaacagaaaagagatactaggtttaaaaaaaaaactaagagaatcagaataaacgatggactttggttgctaataatatatcaatattggcttattaattgtaacaaatgtaccatacaatgtaaggtgtttataacagggaagcaagatggtggggctgggctgggaactctatctgctcgattcttctgaaataaagaactgctctgaaaa

SEQ ID NO: 235395 - DNA, 320 bp, Homo sapiens
ctgacagcaacccaatactcaggtataggtgggtcaaggaagtagcaaaagaggcgagcagcatccccagcgcagccaagatgcctccagtcatcaccacgggcctgggcccgaacttcgtgctcagggcactgcctaccgggctcccaaactgctgcaccgcgattcctatggaggcgatccaggagacgcgcgctgcctgctcctcaaacgccgccacaaactccacgaagaagaccccaaaggagcggagcaccccaaacacaagcgccgactggaagaacgctgagagcaccaccaccaaccatccccagcccccg

SEQ ID NO: 235396 - DNA, 245 bp, Homo sapiens
  misc_feature (164)..(164): n is a, c, g, or t
ctgacagcaacccaatactcaggtataggtgggtcaaggaagtagcaaaagaggcgagcagcatccccagcgcagccaagatgcctccagtcatcaccacgggcctgggcccgaacttcgtgctcagggcactgcctaccgggcctgaggaagtggaaggggcngctgcgagaagatctcaggggtctcccccccagcatctcccgcccctcgcccttccacttcccagtcgccgcattccctct

SEQ ID NO: 235397 - DNA, 998 bp, Homo sapiens
tattccaaaggttcagagctcatctaccaggagccagccaaggccagttttgaagacaagtctttcttgggaatatgcagggtttgagcaactcagtcctgctgagttaaccctttcttgtacagcaagttagctcttcagggagttagctctgtctatcctgcccctgtctgcctagccactccttttctaggtagagtggaccttgctgttcacgtcatagatggccattccggtgtacctagactcctttttattcctttgccaacaagtaattgggaatgtttgggatttaaggaacatgtctgtgctttgcaattttcatgtggaccatgggtgaaattatggcacacattctatcattgtgatttcaacaagtatttttttgaatgctgctgtgcatgaggcatggtgttagatggcagattgacagaaatgactaatacaggtatttggcctcaaggagtttacagtttcataggagaaagaaaaacaaaactagcaattctggtaagcagtatgtgttttggagagcacttaacttcatcagagagcatggttgaaggtgtatctgtgtgtatgagaaggtgttggtgataattagaaggcttccctaaagaggtcactcctggggttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaa

SEQ ID NO: 235398 - DNA, 167 bp, Homo sapiens
ttttagcactgggacatcatgccaaaaatggagcagccactatcacagatgtaaccttctgactagctatgtcctttaaagacacggttcctgcccaccataccttatggtagccctccccaggtccctctggcaggcagtgcttgtgagctcagtgtaccacaatc

SEQ ID NO: 235399 - DNA, 485 bp, Homo sapiens
caatttacagattcaatgctattcctatcaaactaccaatgtcattcttcacagaattagaaaaaatctattgtaaaattcatatagaaccaaaagggagtccaagtagccaaagcaatccttagcaaaaagaaatgaactgttcttgactgtaacaaagcaatgagaagatatcttctaaatgtattcttagttcatcataagcagattgatttgtatttattttccaaggcattaaggaaaaactcttctaaaatgtcattcaaaaatgtttctaattttgttcagttgctgaattttgccttgcatacaatgactttcaaatttttagtaagctattattcaatctcttcttgcaactaagaaagatttgctcactattctccctgtggtcaatgttgttcaacattcatcttttgtttcagttctcttttatttacaaataacagaaaatcacttctaactgtctaagtaaaataataaaa

SEQ ID NO: 235400 - DNA, 427 bp, Homo sapiens
cagtgtaatatcatcagtccaaaactgcattacttttgtaaaaaacactggttaatttgtataagatatcatataactttttatgctttagaggttaaacaatgtctttgggggggaacatttattgtcatcactctaaatgtggtggtagctcttataaagtttgttgttgttttaatcaaaagccaactgaacagcatataaagactgataaatattcaggctgagtagtattttaacgcttgtcttcaacttgatttgtctgtttaattgaaaagggttgtaagagttaccgttgcattttctggcctactacctttaaaattcctgttgtgtttctttgtatttacaaggaaaggtctgaactttttcttgtcaaaactagcttttttccgacaaataaattatcaggttaaacttgcactaa

SEQ ID NO: 235401 - DNA, 193 bp, Homo sapiens
catctgtcatgggaggtgttgtgcaggtaacgaaagaaggaaaagacacatttggtttcactggaacttccccccactctcttttaatgtcttgcttcttcctccaagatccaaaggctgacatttaatgataccagctccaaattaaaaataaatgtaaaatgcatgtaaaatcaattctctagtcagcaca

SEQ ID NO: 235402 - DNA, 254 bp, Homo sapiens
caccaagtggctcctttccctccctcctgtgtctgttcctaggttcccagtgctctggggccaaataaggaggagctggagtgaagccatcccgtgccctgctttccgtttaggacagtcccccaccgcagggcaggctcccaagtcaccttccagggaggaaccagactgggtaggagagggctgagaggctgactccttctcagacaagctttccacagctttcctatgtcaaccgtatctctactgcctcc

SEQ ID NO: 235403 - DNA, 783 bp, Homo sapiens
aaagatagcattggctttgctgaaagaaaatagaaaccggtcctctaaaacctactgctgtccctcaaagagttaacggagtcagttccaaaggagttaggcaacggctgaaacaggataataaatgtgacactctcagattatcagtagcaaatatttgatcttatcaaataacagaggaagtagtttagttacaaataaaccaatctctcataaaacaagttttcacacaggttcatttcattgagctggagacagttagaggccacttgtaggcagaactcccactctgtacactctgtaacagcccctcgtgattaatggacagccagggggaggctgcatcctgcggctccaggcttcatatcagcagaacagccataaacagcatctcaggattattgcgaggaagtgactcctcctctgggaacatagctgggcttgtgctccttctccctcaccacccgccttctttctgtcccgctcgctctttttccctgtagagcagagaccatcgtgtcctagaaactatagtagatgtcactgcttggcacttgctgtgcaaagagaggacaagtatgtgggtgtgagggggaggtggaatgctactcttaaagtaacagggactgtgctagccagggcctcgatggaggcttttttgttccagtctttgaaaccactttggtgaaggcatccaacttggagtccagaaaaaagtacaaacactgttttagagtaggaaaaaaaaagttagagctccttctttcaaagtaaaattctcat

SEQ ID NO: 235404 - DNA, 855 bp, Homo sapiens
cgagagaagtgtggggagcgtggagcgaaaggcctaagaagtcaggcctttaaaaaaaactctttgaacagctttatttaaggcataattgggaaagagatttttctgctgccctggtgataaagttcagtcgagagtcggtgttaataaaccttccttagaaccaaggtgacttggaaagttgagttctttaggtctgtggtcaaattaacaaaattatgtcaataagccccaggtgagtagggtcaatttacatatgacacacacaaatatttgattatacctcaatgaatgaataaaccttcagaatcttagctaccattttcattcttccatcttgacacaaaaggtgggagttccattattagacacttgcaggagttcaacatagtatttaaatttaagtacagtttgttattaaatgagaagtgttgctaacttagttgcaattttgtatcaggcgggcggtaatagtttgttggtatgacttccatacatgttgccatgtgaaggatgctttcggggtagatttcttaaacatacaagaatcaacaagtcccacctacaggagataacaaatcattatgatgtactggaccattattcactggggctaagaagtaaattatccccttttgaataaaagcacagcaaaatcaaaatgacctagtacatatctgagagcagcagaaggccaaggggagccctagagaatcagctgccctttgtcaccatgttgcagggtaggggtatggggcaatgcagcctgcccagagcagacgttgcagtgagctgagattgcaccactgcactctagactaggcaaccaaagcaaaactccatctcaaaaaaaaa

SEQ ID NO: 235405 - DNA, 759 bp, Homo sapiens
  misc_feature (5)..(5): n is a, c, g, or t
gccanagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaagatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagacatgtggaaactgctctctcacgactctcaaagatgaagacttttgtaaaccgtgtatctttggctactgtggataaaacagttgaaactccatcgcctcattaccatcatgagcatcatcacaatcatggacatcagcaccttggcagcagtgagctttcagagaatcagcaaccaggagcacc

SEQ ID NO: 235406 - DNA, 583 bp, Homo sapiens
aaggtcgatctaaggatcccgggcagtacggatgtggttgtctacttgatatgtgctctggtgctggacgctggtggctcacgcgttgtatcccagtcactttgggaggccatggctaggcggatcacggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaagatacacacatcttaagaataaggtttcagagcatattcctgtttatcaacaagaagaaaaccaaacagatgtctggactcttttaaatggaagcaaagatgacttcctcatatatgataggtttgtacatacacacaaacacat

SEQ ID NO: 235407 - DNA, 722 bp, Homo sapiens
  misc_feature (5)..(5): n is a, c, g, or t
gccanagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagacatgtggaaactgctctctcacgactctagagatgaagacttcgtaacgtgatctttgtactgcggtaaacaagtgaagtcatcgctcatacatatgagctatacatcatgcatagacctgcagatgacgtcaagatagaccagacacaatgtctatatctgtctcaggctatacactagccaggcagtagcagcacaggacg

SEQ ID NO: 235408 - DNA, 714 bp, Homo sapiens
aattatctacctataaatttggtaaaaaagagaaaaccgagagggctaagtgatataacaaagttaagttactgaacaaaatagtgaatgtgagaataaaacactaatcaccaatgaaagaaaattatatctataatccccaaaattatgtggtcatgatgaacatttgacaattattctcagtacttctgttcatattgcaaaaaataagagacatctgggccacttcaaatcattagaatgatgaataaccttcagacaaatctcatccagaaatagtggaaactaattattttgacattctttaagacttctaattcaaaagtaaagttctcaatcctttggatatcaaataggttttcactgattttgctcataactactacttctcgaacaaatttgtctcttgaaccacctagaaatatctctgaatcctgaaattgctcctaataggacttatttctaacctactactcaatttatgtgctaccccattctttttttgtttttacaacattctattttaatctacatattgttcaatgtttctagttgtccattacacacatgtgcaatggacaattacacacacatgcacacacacctctaaagaagtttgtataagtcagatactcaggtgactttaatgatgaggatcaaatgaggaagatgaatcatttaattacacaatataaactatgatgataatgtcac

SEQ ID NO: 235409 - DNA, 446 bp, Homo sapiens
aaaaaagaaattatcgtttttgtgctcataccttgatatttacagttttatgcttgataccagcttcctgaattgactaagggatatttcagattcttacttaaaacttgcctttttttttttttttttttttgagacagagtctcgttctgtcccccaggctagagtatagtggctcagtctcagctcactgcaacctctgctcccaggttcaagcgattctcctgcctcagcctcacgagtaactgggattacaagcgtgcgccaccacacccggctaattttttgtatttttagtacagaataggtttcaccatgttggtcaggctggtcttgaactcctgacctcaagtaattcacccgccttggcctcccaaaatgctgaaattacaggcgtgagccacacacccgaaaacttgccatttttgaatgagacgtttaagtgg

SEQ ID NO: 235410 - DNA, 292 bp, Homo sapiens
tttttctcctttcattgggttgacagtgtttaaaattatatccagagctgtctaatttgcctattgctctaggcatactgatcctcaggaggtaagattggatgggttaaagtggacaggctcaggggctgagactgtccatctctctgagagtcgggggcagcatttatcaggggcctgtggtcagccaagcttggcttgggctctgtgggaagataaaaccaactggcccagatggacttctgtggggcctggatactgttgggaagataaagcacataagcccggtaag

SEQ ID NO: 235411 - DNA, 447 bp, Homo sapiens
gttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaat

SEQ ID NO: 235412 - DNA, 262 bp, Homo sapiens
cactttgggttcagaagtcatgaggtgcagtcctgagcctcagagggcttcccaggctgtgttctcatgggttccatagcacccaggcctcccactgtggagccaggactttaaccatctcccttggggtccatagggtggcctgtatcatgctaacagggaaggaaacgtttgttgatttctttatgcatggctgaattaccaagaacacctaatgactggtaatgaagtgtcctggtttggtctctgccatgtctcagtg

SEQ ID NO: 235413 - DNA, 616 bp, Homo sapiens
agaggattaaacagggtcttttttttttaaatgtgtcttcacataaaaaagaggacttgtggctgagtctttattagcagtggtttgagggaaagtttttcttaaaacatgtttattctgtgataggtagaacttccttgacaaggtagcctgtgtcctagatagtatacttatattagatggttatgtcccgcaaaaataactctagatgtctgaaacaaatgtattcctccaggggtcccctgagagcccttaaaagattccccattgaaagactggattagctagccatccagttaaaggcctttctttattgtctagtgtctttctcatagcctgaatttctccagttctccctccctctcagtcatcctccttatctctctacccatccaccctacccagtgctgttccatgccatctttgtcaaccccaaaatgattattcaacctttgaagaattattgttggacaaacaatgcagggaaagcttatgatttgaaaaatcatcaggggcctgcctttaaatgctgactgcaatctaattcacaaatagcattcgtttacagtgacaagagttcttgaaattacaattttgggatgatgctccatttttt

SEQ ID NO: 235414 - DNA, 562 bp, Homo sapiens
agaggattaaacagggtcttttttttttaaatgtgtcttcacataaaaaagaggacttgtggctgagtctttattagcagtggtttgagggaaagtttttcttaaaacatgtttattctgtgataggtagaacttccttgacaaggtagcctgtgtcctagatagtatacttatattagatggttatgtcccgcaaaaataactctagatgtctgaaacaaatgtattcctccaggggtcccctgagagcccttaaaagattccccattgaaagactggattagctagccatccagttaaaggcctttctttattgtctagtgtctttctcatagcctgaatttctccagttctccctccctctcagtcatcctccttatctctctacccatccaccctacccagtgctgttccatgccatctttgtcaaccccaaaatgattattcaacctttgaagaattattgttggacaaacaatgcagggaaagcttatgatttgaaaaatcatcaggggcctgcctttaaatgctgactgcaatctgggatgatgctccatttttt

SEQ ID NO: 235415 - DNA, 415 bp, Homo sapiens
agcaaaaattgcaacaaattattagcacatcaaatcctgcaatacataaaaaaagaataatatgtaattacaaagtgaaacataaacctggaatgcaaagctgattaaacacttaaaaatcaatgtaatatgccatattaacaatctgagaagtaaaaccacatgatcatgtcaattgatgcaggaagaaacatttgacaaaattcaatattcatggtacaaactctcagaaaactagaacaaaagggaacttcctgaactcgataaagggtatctacaaaatcctacacctaaaaatcatacttcacagtaaaagattgctttctccctaagatcaggacaaggcaaggatgtctactttcaccactcctatttaaattatacgtgaagtcctagcccttgcaataaggcaaga

SEQ ID NO: 235416 - DNA, 281 bp, Homo sapiens
aagaaacaacaggatagaaaagacaggaacaggatgctccagctaactccatttcctgggaaataggatttccccagaagactttgtattccagtcagccctctccacagctgcttcctggaaagaacccactttgctcccagaagataccttcctgaatcatcttctattttgaacaattatttggggttttttgttttgttttgttttgcttttaatgtattaatggagaatgtagtaaagagccttggctaagggtcagaagacctgggttcatgtct

SEQ ID NO: 235417 - DNA, 544 bp, Homo sapiens
ctttttctctcctaagaccttgtctattttcgagcaaaagtttttttgttttgttttgttttccttctcagttgactgaattctgttttcacctgatttttttttaactaaaatagttattgcaacaaaggctacgtggttatttaagaaaaaaatgaagtttaattttatttttaatttggctaaaagaaaaataaaaacatctccttctatcatcaccagactttttctctctgtaccttatgttgtaaattttactatttgattttcacctgagttgtttcctttaatgtgcaaatttaaggctatttttctgacagctgcctagggttttgaaacaggttaccaagaatctgaaattctaagatagaaaaaaaaagtggggtgatctttataaatctataaaatgtacttccgttggcatgcctaattcatctttatatgtatttatgtattgtatacaaaatatttcactactaaaaatatataaagtgttctaattaattgacttaaagaaaaaacaaaagtgcttaaatgcgatact

SEQ ID NO: 235418 - DNA, 492 bp, Homo sapiens
taggtcttctgaaagaaaggagtgtaaaatgaatttttggaaatgtaatgcttcttaaagcactaaagaagttttcttctgagcagagagtcacaccataataaactgagtttataattatagattttcacgtatggagtatttgccaataatatttgaaaatttatatctaatcatctagttatcatatattccctttagctcaccattatagatgctatttttatacttatattcagaggttgcaaactggccatgggccataaagggactctgaaagcaggtaggttctgtttggcctgcacagctaaaacattttgggttgccttttggaattcatgcactctccagccttctacatgactactgcttcttactgtgttagaatcaactccctacacctacctggccctagaaagcattaagtttgagatctttgtcacaatcaaactccatccctccaaaacaatttaataacacaagaggaagaaa

SEQ ID NO: 235419 - DNA, 369 bp, Homo sapiens
tggttctcaacccctcatctccctgccacgtgcccggtagttccatcacgacatcaaggcataggcccgtccataaacctacgcacacaaccccaaagcgcaaaaacagcgacagtctggctacagcaatcacacgttcattcactcatccactcagctccagaaatgcaggtgggttgaggggtggagagctggcctatgggttgaacaaggcagaatctttgctgacctgacctcaatccatctcagaaagagggggcaagcaaagcccaagtggagtggattcgaaagaggaagggacttgcgggcaggggcttgtttagtttatgttggcaggagcaatgcaagagggcaggaggacccgggtgc

SEQ ID NO: 235420 - DNA, 117 bp, Homo sapiens
ggagagggggccgcgggtgtctcgtcctgtcccaggcccaaacccccaggggtcctgtcctcaggatctgcttgagccgacttccaccgagggagggggagcttcaggacgcctgct

SEQ ID NO: 235421 - DNA, 452 bp, Homo sapiens
tctcttactcttattccctagacagtcagttcctctctttagaaataattagttttatcagtttcttgagcagccttgtatgtagtgcacatatgagtggtttcacacaacatgagagagtgtgtgtgcattttataacaatacctttttttgttttttttacctaaatagtggtagcattctttaccataaattttttacttaacatcttgggatatcttctcatatggtacataaaaagtattttcattcctttttaaaaagttgctgcttagtggtccattgtgtagttgtaacaatttgactagtaccttattgatggttgtttttaatcttttgctattacaaatagttctataatgaatgcccttctacaaagattattttgcgcctgtgtgagtatttgtaaaagaaattcctagaaatgaacttgcagaataaaaccatatctg

SEQ ID NO: 235422 - DNA, 326 bp, Homo sapiens
ttgccccacataataacaataataataacaataacaataataacatcagcagcagctgaaaactatgtagtgcttcccatatgccaggcactgttctgagtgcttatttcacagaaacataccttctacactaatcctcctgcaaggttattgagttgtacgaaagaattagctcaagagggctttacaaaacacatccatactatgtacaaacactatatatttgataagacactatcaatagaaaatgagcctaaacactatttacttaaatatatgtttaaagtccttctgtttggtttgtaatattaaagtgttttttctat

SEQ ID NO: 235423 - DNA, 510 bp, Homo sapiens
agccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaggagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaa

SEQ ID NO: 235424 - DNA, 391 bp, Homo sapiens
atatatttctagaaatatcaacttttaaatttatctttccactttccttggagtagtttttaggaaagctacattcttaatttttaagtttatcaattttaaaatttatagtttataccctctatgtccactttattaagtttttccctaacttgagatttcaaggatagttttccaataattcatctggaaagcttttgcttctgataactatttcattaatttgcttgaaagcttttgcctttgataactatttcattaatttatcagaaattgagttttaaatatggcgttagtttgaaatatttatttcatttaaatatttttgtatttgcatactttaaaatgtgttattaaacaaaaaattaataaactaaaagtaaatctgcca

SEQ ID NO: 235425 - DNA, 537 bp, Homo sapiens
tgcatattagggatatagactcttaatcatattgatgcaaatatttttccacacttgtttgccttcccatgttcacttatttgatgtactaaagtttaaaatttacctgtaataaaatgcattgctcctttccaggtggtttttaatataataataaagactaataacagcagctaactttagtgtttattagggatcttttaaattcaggtccttttttaagtatgtaataaactagttagcggtagaactggtattttaacctaggtctacctacctgaccttttaactatgctatgttgccgttgttctggttagaactactaacttccttggatctatacattaaataatataataagcagcacaaaaggaataatattgaacttcatttttgactgatttctagataaggttcataatggaatttttttattgtggtaaaacacaacatgaaatgtatcatttaaactatttttaaatgtatagttcaatggcattaagtacattcacaatgttgtgcaaccatcacccttg

SEQ ID NO: 235426 - DNA, 319 bp, Homo sapiens
agtgtatgtcaaactttctttgcatgatgggaaggtttacctggctgacctttaatactctttgtcaactgtaagattgggattctaattgagtgagaatcaccagcagttgccataatactctttagcgttgatagtcatgaggcaagagactgccctgttctcatgattgtttaagaccttgtgatctagaaccacgtggtgagtcagagtaggcaaggatgcaagccatcagagaggccaagatttgagcagtagctgcctgggcctccttgcttggtgctctgcaaataaatgccttactttctatcactgcaaa

SEQ ID NO: 235427 - DNA, 365 bp, Homo sapiens
tcccaaaggtctcaagaggaaagcatttctcagtatcacaatgggatatgctgtttcagtgattgaataataatgctgattcctcactgaattccacttagatgtcacagaaaaagtcacttgctggctggctgcattcacatttccatggccagcttaggtgagtgcttgggtgggtacagtggggcagtgggccgcctcctgtctgctctggacacaatcagcttaacctgagagcttcaggacagctgcaggggtcatttctagagacaggaaaggagtccaggaagccccctctcttcccttccactctccaggctgtaagaaagcacacacccagggaagggatcaaagggagaactgaa

SEQ ID NO: 235428 - DNA, 416 bp, Homo sapiens
gactttgtgaatggagcgcgcggcgcctttcgccgtctacccgcgggcccagcctgcgccgcgcctccagcccgacaccggcacctgtgccgccgctgcaccccgccgctaggcgggcggcgccaaaggaaatagccggctgaggaggccagggctcgggtttgagctttcatcccttggcaccttcgcgcttccccgcgtgacagccccgtaggtttttcccggttacccaagtggagaggggaccggagcgctgctgcccacccagcggggcctgacacctcctagccccagactccccgtgcgctttcggcccggccagtcctttctgaatatgcgattcctgagacgttagcgtatgcattagcgtgatcgattttcatctaaagccattaaatcagttttatagcttcccc

SEQ ID NO: 235429 - DNA, 574 bp, Homo sapiens
cactcatcatttccgacggatgggccggaggggccgccggccgccccagccagggtctcggtagcctgcaaggagagaaagaggtgggagcagcccgcgcggggccctgcgtcttgcataggcgcttctggtaaaatcactcctttatctcagataatgagttggcgctggatcgctgcgtcctcaggtggggctcgaatcgtgacttttagagaaataggttttctttctttttttttttttttttaacaacatggggtttaaagggcgcggaattggaagcagtcgtcacccggaggcctgggcgtgcaagcaccgaagctctggctggccctgagcctccccaccccacccgctcttttcgctggaacgcgtgtactttgggcagttgctgacgtggagacaggacgtatgtcttcatattttagtaaaacccaatgccctctgcctctctgattatgttctttaagttatcgccagttccaatttgtatttcttggaaacggttgggtcttccctcacttttcagtattttcatgtagactcaaatactctggattaatatttgtatttg

SEQ ID NO: 235430 - DNA, 438 bp, Homo sapiens
cactcatcatttccgacggatgggccggaggggccgccggccgccccagccagggtctcggtagcctgcaaggagagaaagaggtgggagcagcccgcgcggggccctgcgtcttgcataggcgcttctgggcgcggaattggaagcagtcgtcacccggaggcctgggcgtgcaagcaccgaagctctggctggccctgagcctccccaccccacccgctcttttcgctggaacgcgtgtactttgggcagttgctgacgtggagacaggacgtatgtcttcatattttagtaaaacccaatgccctctgcctctctgattatgttctttaagttatcgccagttccaatttgtatttcttggaaacggttgggtcttccctcacttttcagtattttcatgtagactcaaatactctggattaatatttgtatttg

SEQ ID NO: 235431 - DNA, 503 bp, Homo sapiens
cagccagcattctgagagacaagtggtagaagatacctgggggtctcactattttacatttctacgttaatcgattaaacttcctgagtttgggctgaacacatggtgtattaatttattcttgcattgctataaaggactaccagagactgggtaatttataaagaaaagaggtttaattggctcacagctctgaaggctgtactggaagcatgcctgggaaggtctcaggaaactcacaatcaagacagaaggtttttctataatgtaccaccagcaactatggtgatgacagcttttggaacatcctttcattatttcaaaagtaaataatcgaatatggtttaattacttgagcctcaacaacaacaaagaagaacataggttcctggctttttttgtttgttttttgagactgaaacttttggggaaactctgtgtatagtcacatagaatacagtgcaaataaagtaataacttgaccccaaacagaaacttcaatg

SEQ ID NO: 235432 - DNA, 834 bp, Homo sapiens
tgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacata

SEQ ID NO: 235433 - DNA, 2283 bp, Homo sapiens
ctttaaatggtggacattacaaagacaggaaaaagaattcttgtctttgtttgctcttttaacaatccaaaggtttaggaatttactttgctctaacaaccctctcgatcctcttgtgaccccgttatactcagtgttgctgaaaaagtccattttaaaataatggcacctaccacatccatttttccgtctttaggccagaccctctgatggttggtggattttagtattaaagcttgtgttgaaagtggagggggtgttactactgttgtgtctgaaacaagagttaaggttatattttatgaagcagttttggctttttcaacagatgttggccactcacttttatggatttcacattgagtagtaatgagtcataatcactacttaattttcccaaaccagagggaatatacattttattattggaccctccaggctgtcaatgaagagagaaaacctttctttggaatcaagttgaaaacctgttgttaacacctctctctgggccttctttgctctccttagcacgttcattgctaggggctgccacttccatcttctctgccttggaagcatagagtcgtttctcagcctcattctcacctttatgagttcatttaataatgtgattagaacatataaagtatgcaagaataaaatgtgtcatgatgaccttaaaacttttattattcaaagttatagaaagttacgtattttattgtagactcataataggtgaacctttctgatcttggggatttcttgtatttccttggagagtcttacataggcataagccagtgactgattttttttttttttttgattgttttctcatactatcataggccatttgaggggaataaaacaaatactcgttgggaatctatatgtagaagatcattcaggcaaagattctggtcttaaaggtgttaaagtctactggagaacataaggacttaattataacagcagccacagcctccaccagcccctgtgataaaagcatactatgttatctcacttaatctttatgacagcccatggagggtaggtctcattatcttcatttttaatgctggagactgaagatgagagacctgtggttgcctaaggtcatatagctggtaggggcagagtttgtgtttttgccactgttcttgatagcatatttctgccatatgggggcttctcccggttccgtgagtgaggcatgccctcctgccatagcctccgttccttctgccttcaatgaatacaccttccataccactccccccaacccctcccattaaattctaatcatcatttaagtttcatctttggtggtcttaggtgtcactgttgcagacaggcatttttctggcccctgcaccagcttacagcacccccactccttgacctctataacgctcagctttatacttggttacgtttatggtgtttgttgctctgtttgtctggtgtcctggactctaagctccgcaagggcaggaattgtctggcatcattgctgcacatgacacctggtggatgtacatatttattaaatgaataaatgaatggatgttcatacttttgtccaccatgttttatgctaaatacacacagagtagataatgagagaggctctaatagcgaggtgtgtatcctttgagctatggatgacaaacttaaaaaattgcccattaagttagaaaagaattgagtatatctttttaatatatgtgtttacttaatgtacacgcatattgtaaaaatacatgatattggcattttaaaaaggatgaaaatatttaaaacaaggagtttctaatatgtttttctgtatgttagaggaccagctggtatccaggacccactaaacttggagctgggggtgccagggcaggccctgtgggaatacatgtaactaaacaagctccatggccacagtggaaccagactgcagttgatcaaagcatggttgagggtgggaagtgctgggctcatgcgagggtgtgtgagtgattgtgcatcaacatgaaggatcactgggggagtggtggggtgtaaggttcattggaagtctgggactcagctatgattgaggtcagatacctagttcaggggataagaccatatcatcttgaaatgatgggctgctgaagggtcttaaagaatcatgggtacagtggctcacggttttaatcccggcacttcgggaagccaaggcaagtggatcacttgagcccaggagttcgagaccagcctaggcaacatggcgagacctcgtctctt

SEQ ID NO: 235434 - DNA, 603 bp, Homo sapiens
cccaaaggttgggagggggctcgaggccatcaggctccaggccgcacttggcgctgccccctggcgccagggaaacaaagtgacgggggtcttgctaggttgccaaggctggtcttgaactcctgacttcaagcagtcctcccacctcagcctcctagggtgtccggattacaggcatgagccactgtgcccggccccctatcgcgatatccataagatgccaggatgcccaggaaccgagtttgaaagacattgtgctgctgatcccacctcctgactttacagctgctgaattgcagaagacaaattggtagctaacaggaggctccatcctggatcctgcccctgtccgtgagattcagccttgattaactgtgttcccatgctggtcgtgagcagggcaccatcctaggtccttctttatactcattttccatctccagccaaaatgggttgaaccgaggaacaaggacataatctgtaaagagcaagtgcaagtctctgctctgccattaccagcatcaggctaatcaagcccttggaaactcaatttcttctcctgtaaaatgtgaataactgttacagacctggaaaggctcttgt

SEQ ID NO: 235435 - DNA, 437 bp, Homo sapiens
gcggccgccccctcgcccgtcacgcgccgcacttggcgctgccccctggcgccagggaaacaaagtgacgggggtcttgctaggttgccaaggctggtcttgaactcctgactttacagctgctgaattgcagaagacaaattggtagctaacaggaggctccatcctggatcctgcccctgtccgtgagattcagccttgattaactgtgttcccatgctggtcgtgagcagggcaccatcctaggtccttctttatactcattttccatctccagccaaaatgggttgaaccgaggaacaaggacataatctgtaaagagcaagtgcaagtctctgctctgccattaccagcatcaggctaatcaagcccttggaaactcaatttcttctcctgtaaaatgtgaataactgttacagacctggaaaggctcttgt

SEQ ID NO: 235436 - DNA, 413 bp, Homo sapiens
gtcaccgcggccgactggccaagggcaccagccctggagagggcacagggctcagcgtggccagctcggatgtgagctcattcccccgagaccaccagttctagttcctgcccctcccccaaaggctcgggtcgcaggctggtgcctggcacccaccccaaaggttgggagggggctcgaggccatcaggctccaggccgcacttggcgctgccccctggcgccagggaaacaaaggttaggggcccagagggagttatctggccccaccgccaccgggtgggggaaggggaccaagagggggcgcagttcccctccactcccccagccctactgattcttcgagacactttcacaggcggaaattcccagaggtcagaggagggaaacggttaattccttttattcaatggg

SEQ ID NO: 235437 - DNA, 451 bp, Homo sapiens
ggcttggtggttgaaagctcggagtccgaactctctgaagacatttttcccgccttgccactttctagttggtgaccttggcaagcaaggtactcagccgctgtgtacctcagttttgcggtttgtaaaatgggagttacaatagtgcaccccttgtagagtggctataggtttaagagttaatatacgcaaggtctttaggacggtgctgagcgtacagaaggccctctcttgagtggtcgcagttggctgctctcggcctcatctccgtttgtgaaaacccgtccagattccggtcctcccaggccccagctgaagtttggagagaggctttgctgaatagctgtttagtctcccccaacccccttggccctcggagctcctggaaaaagttcttaatgaagtaatgttgagagcgtccattaaaaatgcaatgctgggagatcaaagt

SEQ ID NO: 235438 - DNA, 453 bp, Homo sapiens
agggtctttattgggacagttggtaagttctgtcccaagcacacagcatgccagcttttgggggctgtctgaaccaactgtagatatgtgggtcccctggggtggagtcctgagttcttcctgaatgttttgcttcataataaagtcaactttaaatgttttaaatgtatggtgtttaatgctttgtacaacttttcatggtctcattatctgagctgttttactcccatgaggtcacacagcattgcatagtgaggctgaagcttgtcacctgggttatccttttgaaatttctccaagctggacttttgccattcttccctaacagcaggttagagctctccagctggcagaaagcacatatccagaatcccaaggagtgccagacccttccttccccagtacggtcggcaaacttagcacactatgccattttccttttctgtcacgtca

SEQ ID NO: 235439 - DNA, 1708 bp, Homo sapiens
  misc_feature (1013)..(1013): n is a, c, g, or t
tttatatataaggaatgcaattacctctcaaaatttatgagaacaaactcaagtccatagaaacctctggagctgagcatcctcagttcaaatgctggctctgccacttaccagctgcatgatcttgggcaagttaatctgcctcaaggctttggcaagatcaaagggttgctatgacctgatgcacacatggtacctgacttcaggtaggtactgagtgcatgtcactggtggcagattgcattgcccaaaggcgtctgaacaattaaagatgtcccagacctcctgctctaacaacatgactgacattgctctcactgagaggtggcgtctatgttcctcccgtttaatctgggaagagaggagttcccaggctaggtcatagaaggtgatgcaggttccactcagctcacctgtgctcactccctcttcttttttttcctctctctctctctctccctccaactccccatacctctgtctctctctgctcacccttgaatgcagctaccatgctgtgaggaaacctggactaggccagctggaaagaggacatggacaggcctatttggggaggagctgagtgaggccccagtgacagcaaacatcagttgtcagatgtgcaatggatgagccttcagcaggctctgctgtgcccttttcaaatgcatatttattatgcagccagagttggcagcaagcactaagctgtgacagtgcatgaagtaatttaattggtgaggcccattcttgcaactacctctgtgactagtggagacaactcagatcccagataaaggatggggtgctgggtcagcatgccaaacccaagctaccccagggggctcagaggaagaataatgtgctggaaagtgctctgtggcatgtaaaaatgggtgtcttctcaggatctagcagtgggactagatttgggtagaagtgccaaatgagagaaagcaaagaccctaaggatgagatttaatgaggttgctgccctgtgtctggcctgtccnccgctggtgctcctcttccaagggcattcctgcccatggggaacagaggctttgggtaaggaacacagccatcatattgtatgaacagccacacagggaggctggcatgaagctaatacaggctagaagtctctcctgggaggaggctgccacgtgggggtcacagagtgctgagggccacttggaaagttgtggatccaacaaggatcctgggccctggaagctccacagcatccctcagtagcaggctgtgaagtatctgacctgtgttatcagtagacggtcttggtcttgactgcaagttgtccaggttcttggtgttttgaacaaagaattagataaaatgcacagcaaagcaaggaaagaatgaagcaatgaaagagcaaaaacagatatttattgaaaatgaaagtacactccacagtgtgggaatgggtggagcagcagctcaaggtccaggatatagaatctacagagtccaaatgccccttagaggtttcccattggccacttggtgttcacccggtgtaaatgaagtggcggcctgctttctgcaaccaatcagaggctgaagtgaagttacaaagttacgctcctatgcaacatctgattggttgcacaaagcaaccaatcagaggtattttcagtttcgcatctgctgcactccagcctgggcgacagtgacactctatctc

SEQ ID NO: 235440 - DNA, 339 bp, Homo sapiens
tctcagacactgctgtatacttccagtgaatgttgatgaaattttcagggttgctaagctgtggatttcagatcctggattgtatgacctaaaagagagacttccctaggagtgagggtccctgaacagtcaactggtttccaagaatgggctccctctcatcaccttatgacagtaatcctctgtccaacagccaaagaggtcctgtggggagggcttgcagatgggagtgcgcagagcccagctcaaagctcctgactaggctcttgttgagtattcctttgattcctgcttctgtctttttaaatcaatggagacaggggagggttatctccatcc

SEQ ID NO: 235441 - DNA, 247 bp, Homo sapiens
aggtgctgcacaaaaccccagactcaacgccttctccatagcacgccgcgcccttcctgctgccatctttgtggggatcaacaggatgactgcccttccttccagcgggcctggtactggggtgccccaggagagggtgtaccagggtgtggccagccagtagatgcccacgactgtgatgccacagccctcggtccccctctgtcgcgtgtaagatgggagcaggagccccaaaggagccagggct

SEQ ID NO: 235442 - DNA, 2280 bp, Homo sapiens
attgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttggagagtctctacttgcattcctggctaagcccttaatattctcgcacccctccttgcaagactagttccttttgaggtggttcttggctagcttttgagaggctgcagtggctgtgtgcccaggcttaagtcctagctttctccccactctttacctcctaggaaccgggcccatcctgggggaggcagggaggagctcctttttatagtccacatgtaggctttgtgtataggctctgctgcttccttccggccctggcccttcctggtgttggccggtggccctggcttcagcaagactcaggatgcagagtaaacggggcagggcgttctcctacagaagactggcatccctttttactgagcccaggcctggcacagaggaggctggagttaggaagcaagaaaacgaggtgacccagtccttgatcctgagaagcttgtgatctggaccatgcagaaaaccgctaatgcccagggctggcaggagacagctgtgcctaaagtgctgtaggctgggcctgagggccaagatggaatcgcttttctccctgtagcagcccatcctaccccctggggtccctccacctgccagctggcacacaggtgttgggtaaagcatctgtacaaaggctgtgaggggcctgggcgcaaggcagcaaggcttgggtacggaggagagtgggtggtcttactgatgttctgggccctgacagtgaacagctggccaaactggtgaggagttgggccatggcgagtttggccacttgtttgtgtgtgtttagttcttcctgggcacaggtggggagttcactttggggttggcttcctgttttcttggacacctggggatatggttgagttaaaatgttctgagggaaatgattgttgagggcatgggcttgggtcatagtgtccttggcttggccttgcccatggtaggagtcgggtattgaccacactgggttctggctgtgtaggtgtggatgtgtggtgggagaattccaaccccaccttgacttcagcctaaggcccagagagtgtgggcctgagttcacagggtgactaaccctaggaaggagtgaaggagagctccagttggccataggtcccacaggtttctcagcttacttgggggcaggaggtgagctaaggaatacaactccattccctcagttgggaggttgggcagcgatgggggcaggggtgatggtccttctctgaggcactgaagacccactttatggtcaccctattctgcctgatagtccaccacctgtttggaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacactggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaaccaggcgtggtgtcaggcgcctgtaacccagctactcaggaagctgaggcaggataattgcttgaacccgggaggcagaggttgcagtgagccaagatcgcgccattgcactccagcctgggtgacagagcaagactctgtctcttt

SEQ ID NO: 235443 - DNA, 433 bp, Homo sapiens
agtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacaggtatttttcattctttttaatgcttttttctttttctttctttagacccaagaatattgaaaaaata

SEQ ID NO: 235444 - DNA, 561 bp, Homo sapiens
aagaggagggcttggtgcactgctggcaggacctttgatctgggtaccacagatcatgatgtgaccaaggagcctcagtcacgtggggcaccagttaagggggttggcccttcctagctgactcccagccacactgcagcagcttctgttcacttctcagcgggctgcagaggcagggagggggaggccaggtggcacaggactgaccccagtggatgccacctcatcaccctgttggtgagagagcaggcaagcagggcacatgggcctggggaagaccacaaggccaggtcctccaggcagggaggctctggcagaaacctctgtgccaaccccctccttcctgtccccgaatgcagaggcctgcccctccccgccccagtgcccaggaggccagggtcaggaagcaaacagaaatgcctgcatgcctgcaaatagactccaaccgatctcaggagaatttccagccagcaggcctgtggcgccctttgctgaaagggccttctgaatgcccgagtcttctcttttgtgctcacaaatgccacccaatcgcagcggccg

SEQ ID NO: 235445 - DNA, 596 bp, Homo sapiens
tgcccgaggacccccatgtcctctatgtgtgggattctgcagtttgcactcacaacccagagccttttacccaactaccctgtttgtaggaatgtgtccaaaataagcatcagacaagtacatgaagatgaatgtgcaaagacgttcataacaggattgtttataatcatgaaaaatgatctgcagatttcctgtctgctgtgcaggatgagttagacggggatgcatccataaaatcactttgccctcatttaaaattatatcatagatctatgtttaatgacatagtaaacggtactcaatgcattaagtgaaaaaagcatatacatatcaggatgtatatgatcaagtttttgttaaatggatgcatgtatgcatgtcagtaactgtctgtgtttgcaaacaaaacgtctagcaagacgtgcatcaaatattaacaatcattatctttggattctggatttattgacttctatttttgactttgccctttgtttttctatgttatctgacacttttacactgagtttatattatttttacaattaaaatatcaatccatcaatctacctccatttgggaagtagtaaaaagta

SEQ ID NO: 235446 - DNA, 759 bp, Homo sapiens
ttttttggtccatgaaggctgaatgccagagagtcactgtctagggtataccacatttaacgggcatatctgtggcataattaattgaaaagctgagatgttcctgagagactgccagggtggatgagaccccaagaccagcccagcatttagcagatgctggggactgctgggaccataaccattagatcttagcagccgtgtggcagagggaacatgtcccgggattggggaggctgttttggctgtgactgttcaggtggggcgggacgcagtatcctaggatcctctcggacatcagaccatttacctgcattcctgctgtgtggtacttcctcctctctgtgagagtgctgtgctcctctgggcactcttccttacttcccttctgtctccatctctcgtagctgactttggggcttcctttgaattgtctgcttgcagttactttatatcatcctgtaaggaggagattatcttgggttttccatcttctttccctgctcctcactctttttctctgggctttgtcggtggggagaagggtgcaggggaatccctcagaaaagaagttcagcattttagggctagagacaggtcccccagggatgggccttcctgccctaggaggcggtgactacttctctgggtcctaatgtgaggttggggcaggttggtagtagctgtggtcttccttcctagttccaggaagactttagaggaggttgtttgatttcatattctttttacctgagtggt

SEQ ID NO: 235447 - DNA, 738 bp, Homo sapiens
ttcagagtgtcatttattagagcacgtttgaaatcgtgggaaccaaattatgacatcaatttatgtaagccccttttacataatacacagtagaaaatagttctagcatatccaaatatcagaaatgtaccttcggaaaaggataaagtagcatcttcagaatatgcagtgataagtgctgtttcatcactgtgccattgcaggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235448 - DNA, 1496 bp, Homo sapiens
gaggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235449 - DNA, 251 bp, Homo sapiens
gttgccaggctggagtgcagtggcatgatctcagctcactgcaatctccgcgcaaagattacatgaggagtggttgctaagagagcagaaggcacaagaagaattcagaataaagaaggaaaaggaagaggcggctaaaaaacggcaagaagaacaagaggtatggtaggaatcacgtaactagtgaacaaactgattacttcaccataataactctcatgaagagttgcctatcttgggaggttggagtg

SEQ ID NO: 235450 - DNA, 167 bp, Homo sapiens
  misc_feature (5)..(5): n is a, c, g, or t
  misc_feature (146)..(146): n is a, c, g, or t
ttgcntcacttcatcgcgtctgagagactcagtgactctcacagaaggaggaagaggaggacacttttattgaagaacaacaactagaagaagagaagctattggaaagagagagcaaagattacatgagaattgcttgaacgcgnataagtaggaggcacgggtac

SEQ ID NO: 235451 - DNA, 1067 bp, Homo sapiens
ctccaccagtaaagtcatggttattttcaacagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235452 - DNA, 662 bp, Homo sapiens
ttcagagtgtcatttattagagcacgtttgaaatcgtgggaaccaaattatgacatcaatttatgtaagccccttttacataatacacagtagaaaatagttctagcatatccaaatatcagaaatgtaccttcggaaaaggataaagtagcatcttcagaatatgcagtgataagtgctgtttcatcactgtgccattgcaggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235453 - DNA, 407 bp, Homo sapiens
actccgtctctacagaaaatacaaaagttatccaggcgtggtggtgtgcgcctgtagtcctagctactcggaaggctgaggtgggaggatcacttgagcctgggaggcggaggttgcagtgagctgaggtcacgccactgcactccagcctgggtgacagagtgagaccctgtctcaaaaaaaaaagagaaaagtctcagctatatatcctttgaaagcttttcaaaagatctgtgattcaaaagaaaactagaacttgtgtgcgtgtgtgtgttttaattgttccacttgagattcttaaccagagaaaccagatgtgacttacctgacttctgggtttttattagtcctgtgtttgcaccattttaggaagctttgcagaagatgctggatcaggctgaaaatga

SEQ ID NO: 235454 - DNA, 345 bp, Homo sapiens
gagcaggcgagcgggccgatcgtgggcatggaggatgtggtggcaggaagaaaagagaagctgggccaagctaagtgagccaccgcggcagctccattccttcctggtgcgcgctctggtgccctccccggacttgcacgggcggctgtggctcaggcaagcgaggagaggatcaggttggcggatggagaagaactgtctgggagtgggaggatgaggcgatgatagatggctgttctgtaattaaaatacaggaagcaaggtttctctcctcagcacccgaactatttcctttcattgggcacagaggagcggggagctcgggcagcgctgcattgtagccgc

SEQ ID NO: 235455 - DNA, 409 bp, Homo sapiens
tcagaagtggaaaacgttagtgttaaatctgggtagtgcatatataggctgattgatatcttctgtatttttatggatgtgtgaaacatttcatatttgtgggagaaaacagacctggaccaacagggatcaggcacgctgccatgtgccaagtacgccttaaatagatgcaagagtcagctagtatctctattttgcaatctttgattggtaactactttggggaatgttagcctggacaaacaacatttgatgaatggctggtttcttttcctgaattttttatgatagcattcttcattgctccctaggtcagctgcaatttggaacctcacctgaggggcaatgtatatgttcagtaccagtcgtaagtattctgcttgtggatgtcttcctgatttgtcacagt

SEQ ID NO: 235456 - DNA, 1565 bp, Homo sapiens
gaggggcggggcggtgccggcaagatggctgcgcccgagaagatgacgtttcccgagaaaccaagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235457 - DNA, 1489 bp, Homo sapiens
gaggggcggggcggtgccggcaagatggctgcgcccgagaagatgacgtttcccgagaaaccaagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaaaaaaa

SEQ ID NO: 235458 - DNA, 859 bp, Homo sapiens
gagatggagtctcgctctgttgcccaggctgaagtgcagtggcacaatcttggctcactacaacctccacctcctgggttcaagcaattctcctgcctcagcctcccaagtagctgggattacaggcgcctgccaccatgccaggctaatgttttgtatttttaatagagatggggtttcatcattttggccagactggtctcaaactcctgacctcaggtgatccacctgcctcagcctcccagagtgctgggattacaggcgtgagccactgcatctgactcctttgactctttttctgggcacttggtcagatataaagactataatttttagcttcctttgcagctaggtgtggcctcatgatacattctgcccagtgtgatagaaatgagcaaaaagcatgcgcccttcaaaatatgaccttaaagagagaagtaatgcccttctcctttgttggctggaaagactgcctgtagacttgatggctggagctcaagcagccgtcttgaactatgaggatgaccccacatgcccatcacatctgaaaggcctcaaggcctttgggcgagacggtatgggccaggcaaccagcctcatgatgtgtcccacaccgcctaacagatgagtgagtgtcccaggtctgggttcccttacccctctcttgaatctacagaagagaagtttcatgatctcagatcacagccctatggaagctcttgccaaacactggggaagcctaactctaataaaagtgttcccatgggaagtccaacacagctctcattctgaatgacctgtattgttggtccaagcagggatacatcaaagagactggtggtttattagcattacccag

SEQ ID NO: 235459 - DNA, 500 bp, Homo sapiens
tctgtagaagaagtaatccattctactgagaagaagtaagaagaaattaaatgagtaggattgtggaaggtagatgattaaagggtggaagacatttcaggtggagagacgagttgaactctagtcagaaggtgaaactacatgggaatgtttggggaataattgtgagtatgagcagagtaagcaatggaaagagggatgatgttggagatgtgttggaataagagagtaagaccagggtatcctagaattcagatacatggatgctgcacagttgttggcgacccagtttttctagatctgcaaaatatttaacttgagttcttatgtaaatggataaaaggggaaaaactagaattggtatatacaattgtttcaagaagcatcaggaggaaaattccgttcttccttcctgcttgtattattctttgtctcttaattacatgtcaggcattatgctgaattttaaagatagcaagaaaagtgaaacagacatcttg

SEQ ID NO: 235460 - DNA, 523 bp, Homo sapiens
tgagttctttcaggcctttatggtgtttcctgtgtcataaatttggcctcccatttaaaatattcagtgtctgccctactggaggagatccttgtgaatgtgaaccaccatgtatgtgagcacacatgtattatgttcagggcaattacttcccctttctaggtacctttgaatacatatgaaggcttttaaagtagtttgtaaacctaaacttctatacagatgtaaagttgtactatttttattattagttttttaaaacacagatgtaagtagttgatatttttcagaatatgtcatgagctatacacacttcacctgtaacatttatatgtgactgttttaatggcatatgctgtaaaatctgtcatacatctgtacaaaatacatgagtaaaagctgcatgttccaatagtgaaacgatcacagggatatctgtgataaaaaagaggtatgttaaaccaatcttgggcaatattttgctataaatatttaaactgttatggaatcaaatcctttacta

SEQ ID NO: 235461 - DNA, 445 bp, Homo sapiens
ttttatgtagcactacattcttactatttagtgtggcagttaagctttcctggttatgaaaccatagcctctcagttgttcagggccttgctcaagtgccccttgcaaagctatcttgatcggcctcagcagataaagggcttcctagaaccttttaaaaatttctgttttggcactaatcccattgtattgtacttgattgttttccacttacttatgtttgactttagcacttaacttttaccaaatgctcagttaactttttgaatgaatgaatgaagttgaagaaattaagaataatttagtccttccacataagtattgctgtatttgaaacaactctgttccttttgggtttcattctactatttttatagggtatactgtacttggaacataataaatatggaatttaataaatatgtgatgaataaaaattgaatta

SEQ ID NO: 235462 - DNA, 182 bp, Homo sapiens
ttgcccactttttgaggagattatttgtttcttgctgatttgtttgagttccttgtacattctggatgcttgttttttgttggatgcataatttgtgaatatattctcccactctcttgattgcctgtttactctttctttccctccctcccttccttcctccctccctcccttccttcttc

SEQ ID NO: 235463 - DNA, 533 bp, Homo sapiens
cccgtttcccaatttgcaggatccagggccacgcggctttttgtgcccagactcttggagctcaagaacggagccgccgaggctggacagcttgggaaagggaacccaagcagcattttctgtgctgctgctttattcataacttagggttgccactgggtattaaggttgcttttttttttttaatgaagacagaaaattgcctttatctttgtattgcttcattttataatgcaaacatccaagagttggcagttagaatatttgccattttattaaaactgtgatttgttaccattttgatcgagacctaccaaaagctgtttgttctgccctttttgccaagaggcagtaatgagggctgcctactgcttgttaggcactaggagttcagagaagagacacgcttccagctttcagagatctctggtatctctgcaagagtgattccatgttttgcatttcagaagtgtttttccccctttaataattgtatacattgtcggtttagaaaaagaaatcgatttttaaca

SEQ ID NO: 235464 - DNA, 357 bp, Homo sapiens
caaattgttgcaatgcatagtgtaatggccagagcagacgaatgtgtagagaggatgggcccaaagtctgtgcaaaagttttgcagccacaatttaacttgagctcaaaactgttttcacaccctgtaaaaagagcaggtatagatgaaagatgaacaatcagcgatgaccattaattatcccttcctatttctacgctccacagtgctggtgccatcagctctctgagccctggctctgttcttaatgcatttttttttccttaatattgggtgctggccaggtgcggtcactcacgcctgtaatcccagcacttcgggaggccaagacaggcagatcacttgaggtcaggagttg

SEQ ID NO: 235465 - DNA, 137 bp, Homo sapiens
gtgtttataattacataatcattaaccttttcacctcaaaagcactgctcattcaatctaggtcaatattctctataaggacttaccaatcttactaatatattttagaggaaaataaatgtcttgaaaaacaaaaa

SEQ ID NO: 235466 - DNA, 372 bp, Homo sapiens
gagacagagtctcctctgtcccccaggctggagagcagtgatatgatcttggctcagtgcaccctccacctcctgggttcaagtgatcctcctgcctcagcctcctaagtagctgggattacaagcatgcgccaccacacccagctaatttttgtatttttggtagagatggtgtttcaccatgttggccagaccagtctcaaactcctgacctcaagtgatccgcctacctcggcctctcagagtgctgggattacaggtgtgagccactgtgcctggcctgattttctagtttgaagtggttgttgaaaagtcttatgccattcaaaatcttcatccttcatatgtgacctggccctacgatcttttgtc

SEQ ID NO: 235467 - DNA, 430 bp, Homo sapiens
gctttcacagacaaatctgcacagaggctgccaggccctcaaagcaaccacaggggttaaggcagagccaagggccagcatttctggagctcccaggcaaggctgtctgggtctggcacagcaggagagcccacgtgggcttaggagactgtcagatctgtttcctaacttggcctctaccacttttccagctggggaccttaggccaggggccttgggctattcacctgtaaaatggggacagtgataccaccctcactggaggatatgctatagcacaacaaaaagtcccattgtcctaaggcagctagacacacacaggggtcgttggggcaggaatgggggtaaggggtctttccattcctgacttggcaagctgaataatgatggtaacaagaaacaacgcaaggcactttataagcatcttgca

SEQ ID NO: 235468 - DNA, 333 bp, Homo sapiens
agtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgtta

SEQ ID NO: 235469 - DNA, 418 bp, Homo sapiens
caggggcgggaaacactgaccacagaagacacgttgagctgtatattctttgagatacttgagatctttctggttcatgccctcatctggaaaatggaaataataacatctctgcatggagatgacaaagtgtgggtacaatgcctaccacactgtagctactcaagaaatggaagtcacaatcattctcatgccaccagcctactgagcagatcaatgttctggtgatgttctgcatccagaccatctttcaagaactgaatggttactaccctgggtcttctaccgaaagaaagaacatgggtgtgggcattcaagtatagcctctaaaaaaagaacacataagtggttgctgggtgctgttatataatcacacacatacaaggcttaaatcatgaatatttcctttttgaagggg

SEQ ID NO: 235470 - DNA, 204 bp, Homo sapiens
ctaaatgcacaaagaccaaagtaggatgatttgacactttccccacacactattttacattgagaagattttaaacttatcaccttgattcttctctttactttttgctccaataatgaataagaaattggtactaagtgtgaaagctaataagaggaataccatacaaatgaatgagaattcaaacataataattccaggcta

SEQ ID NO: 235471 - DNA, 582 bp, Homo sapiens
tctgaataatcagttattgtctttcagcctacccagcaacactttattcacatgatacttattactttatatctgagatattttccacttattttaagagactgaaacctaactgaaaaggaaaagcgacttatctaccattatctgccagaatagtgtggccttccaccagtcaaagcccttgtgcaaagaaagcatcttactcctgagataaaggtttgggaatgcatgatctcatctcattagtggaaagtgatttatcatttcgcctgaaattgtatcaacagtgtctgcacagggagttgaaattgtctctgaataactcttgtgaaatggctattactgaaactattaatgacgattatgtagatatccaaagaaagtggcaaaaatagttatagagaaacatatttgtgataggaggaaaaaagctaaggttgtcctggaaccttggacacactcaagtttggtgtccaaaatctgattctttttcaaacttgaaaacattgtgcattaacagcttgaagggagaggtaaagactatatattaaaagagttaccagaaaagtaaagctgaatagg

SEQ ID NO: 235472 - DNA, 455 bp, Homo sapiens
atcctggttcatagcaagagaccagtcaagaaggcaatccccgttttgttctttgatgggaaaacatatagttaaaaagaaaataatgaaagtgacgtgtctattgaaatgtgatttgaaaactttacatggaatagactacattttaggtaatatgacccaatcttccaaatatttctattaggcacactaaggtgtatcatgctttaggagagtttataaagataaaagtcagaataaaccaaggtttgttatgggacttggaaaaactagaaccaaaatgaaaatgttcatgccggctacaattatcctattgataaacacatactgatagccatgatcataaggatgtgttgctagggctaccctctggattacctacttgtttattatggctttgtgtgaataatgaagttgccaataaaaccaattgtattcgataccaagaaaaataa

SEQ ID NO: 235473 - DNA, 444 bp, Homo sapiens
cgcgggggtgctcccggccacctgcagcttccgtccctgggggccgagcatggtctgattgaggggaagatgaggagaaaagagcagctctcagaagccaggtctcgaggtgttaacgttcttggtaggtttccaagtgtgatgaattcagctgcgaaactattttaatatgtgaaatagatctaattttcctttttgaacaaaaccccttatttacattttgcggttattttgagcctttgccatctgttcggccggcttctgcctcccgctcttgggcgtgtgggggcggagcccggtccatctccagggcagaccgccgcccccggcccgcgccccagatgtggaagatgctgactgctgccggctcgcaccaggtggccaagagcacagcctcctgtggccctcggcccaagaagcactatcttgttttcttcctaaaaa

SEQ ID NO: 235474 - DNA, 810 bp, Homo sapiens
gaaattatatatttagaaaatgaacatttttttcttttgagatggaattttgctcgttgcccaggctggagtgcaatggcctgatctccgcccactacaacttccgcctcttgggttcaagagattctcctgcctcagcctcccgagtagctgggactacagactctgtctccaaaaaaaaaaaaagaaaataataaaaaatgaaagacagaacaaagttatttttcatgatgctagagggcagaactaggaactaccactagaagttatagggaagccacgtttgactcaacgtaaggaataacgttctaacaactaaaattttctaagcaatgaatgacctgccttatgaggtaatgcgttttgcattattagaactctaagcaaaggctaaacggtcacttggcaaaaatatatagaacagacttatgtgttaggagattaaagagaagctcttaatgatccttttctactttaagtacttataatttcatagaaagttttccatttgcagggataccagaaaggaagttgttggtatttctttttaagtgtattataaaaaaaaaacccatggggcactaaactaaagagattatacttacattagaataatggagttgaggatgatttactttgttacattctacatcaataatatatacattattgataaagtgaaaagagataactaacccaatggagaggattcaaactgaactggcaagaactacatttgaatctactccttactaaattctctgtggctgaaaacctgaagaattacactttttaaggttaaatgcaata

SEQ ID NO: 235475 - DNA, 450 bp, Homo sapiens
atctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatc

SEQ ID NO: 235476 - DNA, 475 bp, Homo sapiens
ttccagacccccagcttctccttactaactaagccacatttctggaaggtcatgcccagtgaaggtggcagtgagggcagaagccccatgtcagaggccttggagccgtggggagcgcgtccagccgcagatgcattgccagcttccctaggatgtgccccaatcggtgagtagggggtgctcaccttacaattctcagcctggattacaccttaaggtttaaaacaagctaagaggagataccttcagaaagactcagtaacaccttggaaagacagaggcctgcccaggtctctccctggagtgacctgtaggaggtctgctggggacccttccaaccacacccaaagcctcagagcacagccgccctcgcgagccaccccacatctggcttcccactggggagtctgtagggtccaggtctctgttgacaaaggcagagattttgaggcagaacaatggctaacataattta

SEQ ID NO: 235477 - DNA, 311 bp, Homo sapiens
ctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctggcgccgagttcgcggccg

SEQ ID NO: 235478 - DNA, 463 bp, Homo sapiens
aaaactgcttttctgaagtttaaagtgcacattttgatacatcttgacacatatatacacccatgaaatcatcaccacaatcaggatagtagatctatccattaccgccaaggtttacttgcactcctttgaacttttccccactcctcaccccctgcctatccccaatccttaagcaatcactgatttgctttctgtcactatcagttaatttgaatttttcagaaatgtatataaataaaatcattcgacgtgtatgctctttttctgttcacccggtacaatttgagatttagccatgtttttgcatgtgtcaatagtttatttttttgttgctcagtactaatccattttatggatacagagaaatgtattaatgcaatcccatattaataggcatttgggttgtttccaggtttgggctgttacaaataaagctgctatgaacatttttgtgcaagtc

SEQ ID NO: 235479 - DNA, 408 bp, Homo sapiens
cagggtttcaccatattggtcaggctggtctcagactcctgacctcaggtggtccacctgcctcgacctcccaaagtgctgggattagaggcgtgagccaccacacctggccttttattttgtacttctttttcttgcctaattgtcctggcttgcactctaatacagtgttgaatagaagtggtgagagtaagcacctctgtcgtgttcctgatcgtagaaggaattagttcagtcacttaccattaatcaagtatgatgttagctgtggggttttttgttaatgtcctttatcaagatgaggaagttccatctattccaaatctgagtttttttttttatcatgaaaaggatcttgtcaaatgctttttctgtgtctattgacatgatcatgtagtaatttttata

SEQ ID NO: 235480 - DNA, 332 bp, Homo sapiens
aacagtggacttttctcactcactgatatctgaggacccagcaccatcccccaaaagaatgttttatatccccacctgcccagactgatctgtcaacacagggaatactgtcaatatttcagagtataaattcaaggagagattaactgaacaaatctcaccttcatcttgagaatgtgtccttgaaggcatcaggacaaactttttacctggtaccaccacacccacaggcagaaggactttaaagtgcagaaaatgttctctccttctggcctttgttgtagaattcagaaacaatgacctgctaaataaagatgaaactgtgacttact

SEQ ID NO: 235481 - DNA, 348 bp, Homo sapiens
aggcagataatataaagatctcagaaaggttccttatatttaggggtataaaaattcatgtgtcctctgccacaaccagcctagtgacttggtggcctcccataaccctcttggtttcagttttctcatctgtaaaataagggtgtgggatttggttgatctttaagttgccttctggtcataaaattctgtgttttgaattttctgtcatctagagaatctattaatgtaagcatgattttttatatctagttatattcaattgttatagaacttgcatgtaaagaagaatacagggcattccattatgcagtgtaaatcaataaaatgaaaatgtatacattgaca

SEQ ID NO: 235482 - DNA, 190 bp, Homo sapiens
gaaaagcagcacacactgaggagcctggtggtagaagaaccatccttgttgaaggagtgggtccctggaaaagccttgcctactggagccaagtgaatgccctggaactaggaagcccaattcttttcccttgcaatgcttttccagagccgtctactgacacagcttaatgtcatgtcagctggcagat

SEQ ID NO: 235483 - DNA, 352 bp, Homo sapiens
agcaggtccggtatggcaggcgggggaactgaggctactaagagacattaagatgcttaaggacagccgggcgcggtggcagacgcctgtaatcccagcactttgggaggctgaggcgggcggatcacgaggtcaggagaccaagaccatcctggctaacacggtgaaaccccgtctctctactaaaagcacaaaaaattagccaggcatggtggtgggcgcttgtagtcccagctactcgggaggctgaggcaggagaatggtgtgaactcaggaggcggagcttgcagtgagccgagatcgcaccactgcactccagcctgggcgacagagcacaagactccatctcaaa

SEQ ID NO: 235484 - DNA, 289 bp, Homo sapiens
aattctgggatttcatatacccaaaacatggtccagtggagaagtaggctcccccatggaaagcaatccccttgctctcatgtacaccttgttccatggaatgtagttggagggtgccaaaggagaccttttaaaagagaagcaaaaggctgggcacggtggctcatgcctgtaatcccagcactttgggaagccaaggcgggcagataacaaggtcaagagatcaagaccatcctggccaacatggtgaaaccccgtctctactaaaaatacaaaaattagccaggca

SEQ ID NO: 235485 - DNA, 513 bp, Homo sapiens
cgagaatgagaaaccctgcgacgagtctgctgacagctaatataagtctgcaaaatcagctggaccaccaaacggcaattgagagctgcacaacctgcaattacctttattcaattaatgcaaaaacaaaaatggggagatgttacaggccgaaagaatgaaggtcgtgaccaactcagtataccactgaaggctatatgagcaaacagaaaactgttctcatgaaagcaggatgttggaaaactaacaactgtgtctgccgccagaagggttgctgagggcagtcatgccccaagcgcagtgttccttgtgattatctatagtaacatctgaagcctgttgtacaaaggaagcaattatgtgtacctgtgataaatcaagcagctgaccaactgttacctctccctccctgctctttctacctaataaatatgaagggctgtagaagctcagggcccttgcccactagaagcaaggagtcccctgaccccttcttccaaaaatactcttttt

SEQ ID NO: 235486 - DNA, 1266 bp, Homo sapiens
tttaatctgaaaatatgcattatcaaatctaagatagaggaaaacagtctaaagggttttccagatgtatttgacaattaaatctcattttgattggatgtaaattaaaatttcattgagatgtactttgtaaaatgctaaaatattatcagcactattttatacctgagaaaactgggcctcagagaagttaagcaactttcctattgtcaaacagctaataagcgggagggattatgatttgaaaccaggtctttctcgctccaaaaacatacacttggccactggacaattattttaacagaactccaattcttagaagatatgtaacgtacaaagctataggttgttacactacaaccctaacaattctggatagaacagtccgaacaaaaaccaaaaaaacacctccgcataccaagtcaggagtctcagtcttaaaagacagcacccactcccaatacaggaaaacagccaaaaaaaaaaaaaaaagccactgtgtttccatacgaccaacgttttcctgatgtcaggtaactgagaccttcacactacactcagccctacacctaccttactgcttctcaccgtagactactctgctggccccgcatctcaaaacgcgggctccacctatagtggcccatacctttccctattttagtggtgcttagtgacagctcgcatctggtttttccctcagcaaaggcaactgcagctcactgctgagaatattactaaagcaaataattcatttagcccaaacctaataatccctcctcaaaactcagagaatatgaaaaagaattgccccttctagttccctcggcattatgggaacaagcaagactttcatttacttcagcagtccatatgtttgaaggtcaaacaacacctgggtatttctttgaaatgaactaattgagcctggatgatttagagttagtcttgctgaaagactcactggatctccaatggtaacccaaaacctgcttttgaaaactctggattcctccaaccccagctttatcaaatggcaaagaatatttgatgctgttcaaagattaaggcctggatcaaactgagtaaaaagaaagagaaaggattgctttcaaactactatgaaaaagagccttggccccaggtgttcagagtggtaaagaaatcagagccagccaaagggaaatcaggcagagggcctagaaaggaatagttttcaaatgctaagtgtgcatagagagcaactgggaggcatcttgacaatgc

SEQ ID NO: 235487 - DNA, 352 bp, Homo sapiens
taaaagaaaagcaattgagaggactgcaaatcaagcagtacgacttccgagggggtccccaaggagcttctactataattcctgccacagagtccaaaaaaaggagccaaggagcctttcctcactgttagaggagaacatgaaggcggccgaaggtcagaagagccaccttgtgaccagccacagatgctcaggagggagtttgagccatgaaagagtcttgacaaagaggagacttttattccaaagcagaacaccggcacagcagtcacgcttaggccgaaaacgtctctgtccagcatttcaatttatcccaccctctgatttttataataaaaagaacttgtcagca

SEQ ID NO: 235488 - DNA, 409 bp, Homo sapiens
cagaacaggcttcaaacgtcagaactggtggaagagtttccatttcttttataatgttgttttcagaaagcagactggtaatattaataaaaccttaaatgcattcatttctttaagattataatttcactcctagcagcctatcataagaataaatcttaggaaatcatctgtgcacatttcagtagtacttacaatagcagaaaattggaaatgtcctaagtgtacagcaacaaatacactcactatacattttgtcatatccatgtttgttaagtgatattacaaagatttcatcataaccattgaaagttttatattattctgtgaaaagttagtatacaaaaccttatctgtgtttttaaaaccaaataaaaaacagcttgaaaaaagtactaggaggaactaa

SEQ ID NO: 235489 - DNA, 752 bp, Homo sapiens
ctctgctcatgccctccattcgggtgccctgcatagctctgcctcccaggctctgcccgggctatttattttctgtttttggaaagcccttcctgtctctgcactcaaggcacctctatctgtcttcgaggtctggctccctgccacctccaagcttgggtatgtggagctgccagccttgaatcgatcaactcccagataatggcaccatcatgggtacactttacagcagaagcaaatccccaaccctcataacaacctaatagggaaactgagacccgagccagttcagcaacttgccacattagattgagcttcccagcttccctgttctgatagggaagttcagaacagaggagggtgtggaccaagtgggaacctctaaggctcccactgcccctgctcagcacaagcctcatgcacagagcagtgttaagatgggcccctgggcctggcgcagtggctcatgcctgtaatctcagcactttgggaggccaaggcaggcagatcacttgaggtcatgagttcaagaccagcctggctgacacggcaaaaccccatctctattaaaatatatatataaaaattagccaggcattgtggcaggtgcctgtaatcgcagctactcgggagactgaggcaggagaagcgcttcaacccaggaagcagaggttgcagtgagccaggattgcaccactgcactccagcctgactctgtctcaaaaaaaataaataaataaaaaataagatgg

SEQ ID NO: 235490 - DNA, 331 bp, Homo sapiens
caaaataagtgtgtctttaggcacgctctttgcatattctattgctaactacattttgccagacactgcttgtgaatgcagtatgtgtgagaccactgcccagcttcctgtagtgctagtcctacatttccacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagtt

SEQ ID NO: 235491 - DNA, 474 bp, Homo sapiens
ccttcatcaagaacaaattttcatcgaattgaaataatggtgtagtttttggaagaaaactagcttattatgagaaataattagcaggcatctaagaaaaaaattttaattgaatttggcttcatattttttaagggctttgtaatttgggcttaatatttgataagggtaaattaaccaagatcaaaacctttaaaatattcgaattgataactattttgtaattattgaaataacttttctctaataagtaaaggagaaatacattgaacaaaataaccagccaactttctgctacacactaaattttgatagactgtccttgtctaaaatagttattcagctataaatacagaacacttgagctagagtcagaatacctggattcaagtcctggttctgccattagcatgctgtgtgaacctaggaaggtgaacttaggaaggtgaacctattagatcaaatgagaaagga

SEQ ID NO: 235492 - DNA, 372 bp, Homo sapiens
ccagggtaggggagggcggtttggataggggtagctgtgctgtgtttggccctcactctactccctgggtatccttaaaaatgaaatttgggccaggcacagtgtctcacgcctgtaatcctagcactttgggaggccgaggtgggcggatcacgaggtcaggagatcgagaccatcctggctaacacggtgaaaccccatctctactaaaaatacaaaaaattagccgcgcatggtggtgggtgcctgtagtcccagctactcgggaggctgaggcaggagaatggcatgaacccaggaggcagagcttggcagtgagccgagatcacgccactgccctccagcctgggcgacagagtgagactccgtctc

SEQ ID NO: 235493 - DNA, 532 bp, Homo sapiens
catcatgttgtataccacaaatagatgcaattttgattgatcaattatacctttaaaaagatgggaaggaaaaatgcaaaaatttaatcatctatttttgcaagtagataagaactggctctagtacatcactgggtggaacccaggtttcattattttttaaacctcacccaatatggagccaaggctgagaaccactgagctaccaaagccagaattatgtgggagccttggggatcttggaataatacaaacaaaaaaagtctatgtaaagcatacaaggggaaaggaagagagtaatgaagaaaactatcccctgaaatgcaacacagaacaagatggtcacagctagggtaacaagagccagcttctccagggtcagttatctcttaagacatgcctattcttcatttgggttttagaatgccagggccacggatgcttttactgactgcttttcaaggaatataaagatgcattcttattgaaaataattgcttcctatgtgtagtaattaaacaaataaaccctt

SEQ ID NO: 235494 - DNA, 494 bp, Homo sapiens
gcaggagaggtgagacatacaggcaaagtgggagccgccatgatgtcgcggaagcagcattgcacctgggtttaggagatgtgctttcagcctgggctgtgcttccaacttactattggatccaaacttactattggatcgtggataagatacattatctcactgcagcctcagtttctgctctataaaatgaggaggtgaactagatgtaaggccatcaaaatgtcttgttgaaaatatagacctaaacttctgcttctggaaaatgcaatagatgttcttatctatatttctcctgctaaatacaactaaaaacccaagacattctgtataaaatgaacgtaagaagactcggagaggtggagggaagaaggcagacctgctagggtgcccagaacctgaggaacgacacagcgaggagcttgttttctttttgcctcatgtgtcccatacttggcactaggaaatgctaatggacacaggcaaaaaaaaaa

SEQ ID NO: 235495 - DNA, 420 bp, Homo sapiens
gctctacctatctccgacttcattcctgagctcttgaacaggggtaaggcaaactttttctgcaaaggaacacgtggtaagtattttcggccttgacggtcacatgtctctgccacgagtcgtctgccttggggcgcaaatgcaggcttgggcagggaagaaataacaaaacttgcttcctggtcactgaaacatgaagtccaggtcacactcactgttacaaaatactccgaattttcagactgtggttcaatacacatgacataaaatggaccttcttaaccatttgtaagtgcacggttccgtggaattcagtatattcatgtggctgtgcaatcatcaccaccatccatctccaaaagtttctcattttcccaaaccgaaagtctgtccccattaaacagcagcttcccatgaccc

SEQ ID NO: 235496 - DNA, 601 bp, Homo sapiens
gaggccaaatgcttggagttcaagtttctttagtagtcccagcagacagattgaaatgatctattttaattatcaacaagtgtgtgtcaatagaaaattatctattgacacacacttccttctttctactaaccatgacctctaaacttctctttccatgctttaataaataaaaggagatttcttattaaggacaatatattatcttggcaattataatccttttattgataatataaacccagacaaatagtctatctgtaataatatataataaacataatggccatgccctaaaatcaacagcttaagttataacaaacttaataaaataaatggtaaacagaaaaactgctccaccaacataaggctaaggcaaacacttaacaatgttatttactccagggggatttttatctccctgcctgcttcctttttctttgaacaaatgtttttgtatacctactatgtacttgatactgggctactacagtgaagaaggacacaatctctattttcaaaagtgtggtctaaaggccaggcttggtagctcatgcctgttgtcccagcactctgggagggtaaagtgggatcgcttgag

SEQ ID NO: 235497 - DNA, 546 bp, Homo sapiens
aaaccaggctgaagaactgagatgggaagagatgagcagagtgggaggtgccagtgggatagtccaaaggagctgtcagcctggaactcaggagagcgctccaggttacaggtgaaagtgtggtatcgtctgttccctggagctcactggagttgtgcatggctgaggtcactgtgggaaagtatagaccatggagagaaagttgctgcaggcacaatggcaggcaacacctgccctgagcccacaggcaaaggcagaggaagcaacagattgagatggagcaacaggaaaaggcagtccccggagagggcagcggccaggtagccatggagaggtaatggcagcaggtggtgagcagccctgtgtgatgccgcaggcactgcatgggaaaaggacaagttaagagttgaaaagggaaggatcgagagcatgggcagaggatggtcttggagaggtggaagggcagagaggggagagtcacgagagaggggaggctcagagcaaccttgaaaggatgagggacctcacactgttggcctttgcagc

SEQ ID NO: 235498 - DNA, 554 bp, Homo sapiens
ctctcccacctccacccctgctctttcgtctcctctcagcatgtctggctggcccagacttgcaatatgcccacaggctggtcctccagggttccagggcacctcccagaagcttctcccaccttggcctcctaaagtgttgggattacaagtgcgagccattaccatgcctggccctgcccttgtaatttatatagccttttataatttccaaatttcttctagattcttcacagctaccccctgaaatgggcgaggataggattttcatcgcatttagcagatgccaagaactcaaagaagtgaaacaacttctccagggttagagggcttagttgaccatcccgagtccaaaaatctgaaacctgaggtactccgaagtccaaaactttttgagggctgatatgacgcccaaaggaaatgatgagtggagcattttgtattttgtgtttttggatctgggatgcttaactggtgagtcccaggaacatccagccaaaggcaagttctttgggagcccaagctcatggcagtgacagctcccccaggagacg

SEQ ID NO: 235499 - DNA, 521 bp, Homo sapiens
ctctcccacctccacccctgctctttcgtctcctctcagcatgtctggctggcccagacttgcaatatgcccacaggctggtcctccagggttccagggcacctcccagaagcttctcccaccttggcctcctaaagtgttgggattacaagtgcgagccattaccatgcctggccctgcccttgtaatttatatagccttttataatttccaaatttcttctagattcttcacagctaccccctgaaatgggcgaggataggattttcatcgcatttagcagatgccaagaactcaaagaagtgaaacaacttctccagggttagagggcttagttgaccatcccgagtccaaaaatctgaaacctgaggtactccgaagtccaaaactttttgagggctgatatgacgcccaaaggaaatgatgagtggagcattttgtattttgtgtttttggatctgggatgcttaactggtaagtataatgcaaatattttaaaataaagatcagaaattcaaaac

SEQ ID NO: 235500 - DNA, 558 bp, Homo sapiens
tgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctc

SEQ ID NO: 235501 - DNA, 141 bp, Homo sapiens
agtttcactttgctgtagtttgaatgtttcactgtaacatatgcttctgtacccacatatgttacagtgaaacattaaaactacagcaaagtgaaactcctctgatgcacctgccacctcccagcctccatacccgtcccc

SEQ ID NO: 235502 - DNA, 878 bp, Homo sapiens
atgtccaggccacctccctctgcctccagagggctgcctgtaccgcctcgtgactccccagccttcaccttcccagcaggcccggcccagcctccactgtgaccagcgggagctttctccagcacagctctgaccctggcgctcccacttcgagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctcttttttttttgttaaagcacattctaatgtaaagtccatgctccattctaaagatgcctctgggatttcagggatggatttttatgtagttcaatagttttcttggcagacagcttatgcaggagaggtgggccgttggctcagtccagccaggctgagtggcgtcactccattccttgcaatgccaggggatgtcatttgtccacctgagggggcttccccagtctcccttccctgacctgtggtcagaatgatggcctcagccttgactgagcgcgggtcaggccagactctctgaacttggtgttggcgtgtgttttgtgtgtgtctggaggtgacatatgtgggtgacagaagcatatgttacagtgaaacattaaaactacagcaaagtgaaactcctctgatgcacctgccacctcccagcctccatacccgtcccc

SEQ ID NO: 235503 - DNA, 984 bp, Homo sapiens
cggctggtactgcctcggatgttcgggattggctgggtgtcgggtgcccgtggctgttgggctctgcttcctgcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctcttttttttttgttaaagcacattctaatgtaaagtccatgctccattctaaagatgcctctgggatttcagggatggatttttatgtagttcaatagttttcttggcagacagcttatgcaggagaggtgggccgttggctcagtccagccaggctgagtggcgtcactccattccttgcaatgccaggggatgtcatttgtccacctgagggggcttccccagtctcccttccctgacctgtggtcagaatgatggcctcagccttgactgagcgcgggtcaggccagactctctgaacttggtgttggcgtgtgttttgtgtgtgtctggaggtgacatatgtgggtgacagaagcatatgttacagtgaaacattaaaactacagcaaagtgaaactcctctgatgcacctgccacctcccagcctccatacccgtcccc

SEQ ID NO: 235504 - DNA, 763 bp, Homo sapiens
atgtccaggccacctccctctgcctccagagggctgcctgtaccgcctcgtgactccccagccttcaccttcccagcaggcccggcccagcctccactgtgaccagcgggagctttctccagcacagctctgaccctggcgctcccacttcgagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctcttttttttttgttaaagcacattctaatgtaaagtccatgctccattctaaagatgcctctgggatttcagggatggatttttatgtagttcaatagttttcttggcagacagcttatgcaggagaggtgggccgttggctcagtccaccttgactgagcgcgggtcaggccagactctctgaacttggtgttggcgtgtgttttgtgtgtgtctggaggtgacatatgtgggtgacagaagcatatgttacagtgaaacattaaaactacagcaaagtgaaactcctctgatgcacctgccacctcccagcctccatacccgtcccc

SEQ ID NO: 235505 - DNA, 604 bp, Homo sapiens
tgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctccctgtggcgtaggaggttcttgggggctgacccatcacccctctgg

SEQ ID NO: 235506 - DNA, 200 bp, Homo sapiens
ttttaaacaagtaaggaaatcaccaaatacagtttgggcaacttcagcttgcctgtaggtgtgtgttgtgttcagtgggggtggggaactgaattaaagtccttgctgtggctgggtccccaggaacaggcagcaggtgtcaaaggggtggttagatgaataaaaggcagtccaaccaaataaacttgacatagaattta

SEQ ID NO: 235507 - DNA, 1147 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagagcagacttgtggccttgtttggggaagcactggaattttgaacccccagccatttgggtcaattgtttggcaagagtgtccgcttcatgatgctggtgatggcatgcacctcgtcacatgtgcacggctaggcttgtgcaggtggcctctattacccaaacactgaaggagcccctctgtgtccttggagagatgccaggtgcttagtttacatttttgcctgcttggagagctaacagcttgaagtaaaccaatccatcagggactcctgaggttttcaccagccaacaccacccaatcgtgcgtgaagactttctgactccctggacattgccatggactcaactgtcacttcaggacctgtttttgaactaacaaacctagacttctgattctctcttgctgcacctacctgtacattccgaacacatggtagagactctacaaaatgcttaatatgtgatctatggacggttcccctgaaattataaatgctgccatcttcatccttcttgttttcccaagctatttccctatccatttgtctgtggttataaatgtcaatatccagcttctctttggaatgtgtgaagctctttggtctagggaccaaaggcaggaattatttagtgatcagacaataagaaaacactgaaagagatgatttgcctttgatggatgtaaaaatactaaaaatttattttcaatttatggtaatgctacttagccattttctctcaaacaccactggagaatttatataacatgaagcatatacaaaatgcatctagggggtaatgaggcttctcttcatcaacttctgccttttagatttgccccaatattgtacttggaggtaaatattaaaactccattgaggactggtataaagttgtaaagtgaacaaaacccagtagaaagctattgataaagaatctattttataaaataagttttatacaataaaatctactctgt

SEQ ID NO: 235508 - DNA, 1346 bp, Homo sapiens
aactaccaaaagaatcctttaaaataagatcctttattgccttgataatttattctgcctgccccacaatccaaggtggaaaagttcactgcagcaactaactacagtgaaaatgcactaacttttcaatcactaacctcttggttcccatcgacatctgcttcagtcctgtttttatctccttcacaaatttcaggatttccctaattcttgcaatctctgcaatcactgccctttatcactgacccaaagcgaaaagcaccaggtttaactctgttccccctgtgctaggtccccacaggttttgttatcctgtatccttccttactcctagcagctactctgatcgattttctctcaccctcagagcagacttgtggccttgtttggggaagcactggaattttgaacccccagccatttgggtcaattgtttggcaagagtgtccgcttcatgatgctggtgatggcatgcacctcgtcacatgtgcacggctaggcttgtgcaggtggcctctattacccaaacactgaaggagcccctctgtgtccttggagagatgccaggtgcttagtttacatttttgcctgcttggagagctaacagcttgaagtaaaccaatccatcagggactcctgaggttttcaccagccaacaccacccaatcgtgcgtgaagactttctgactccctggacattgccatggactcaactgtcacttcaggacctgtttttgaactaacaaacctagacttctgattctctcttgctgcacctacctgtacattccgaacacatggtagagactctacaaaatgcttaatatgtgatctatggacggttcccctgaaattataaatgctgccatcttcatccttcttgttttcccaagctatttccctatccatttgtctgtggttataaatgtcaatatccagcttctctttggaatgtgtgaagctctttggtctagggaccaaaggcaggaattatttagtgatcagacaataagaaaacactgaaagagatgatttgcctttgatggatgtaaaaatactaaaaatttattttcaatttatggtaatgctacttagccattttctctcaaacaccactggagaatttatataacatgaagcatatacaaaatgcatctagggggtaatgaggcttctcttcatcaacttctgccttttagatttgccccaatattgtacttggaggtaaatattaaaactccattgaggactggtataaagttgtaaagtgaacaaaacccagtagaaagctattgataaagaatctattttataaaataagttttatacaataaaatctactctgt

SEQ ID NO: 235509 - DNA, 300 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaagctaagttaccatctggtttagacttccttcggagagcgatgggaagagatttctcagagtgtgaatggcatcatcctatctacagcaaggacctggaaatgaaccctgctctgagtcacacttctct

SEQ ID NO: 235510 - DNA, 5604 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggcatgagccaccgcgcctggcctctgcttactttttatatagcacattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacagctgtatataatggtgatgtcataataaagttgttttatcttttaagtaaaagtaaaaaaaat

SEQ ID NO: 235511 - DNA, 4183 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaagtaagttgtaaatctgccaactttctctatttgtttttgtacttcattataacataattatcaagccatagttcttcaaagtacatgtctatcaatacgtgaaagtataattatgtacttagcataacttacataaataccaagacagttt

SEQ ID NO: 235512 - DNA, 2598 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcaggtaatactttaagaatgagaatttctatgctgaatttgatgtcctctagatattcaaaattgacatgttcttaccctcactctctgttggaaaaaaaatggacatgttttattatctaaaaggtcatttggtgcttagcagtcatggaacattaagcactcttaatgtgcagacactatgaggaatctaaaaatgaatgagatgtattccctaccctttgtttaataaagtccaacagcaatgtatggcagaaaatctagaatataggcaaggaagggccttgggaattcagaggagggagggagtgtttctgggagtataatcaggaaaaatgtcataaagaaggctgattcttggaaggtaggtattatttcaaaaggcaagataggagaaggagaaggagccag

SEQ ID NO: 235513 - DNA, 6944 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacagctgtatataatggtgatgtcataataaagttgttttatcttttaagtaaaagtaaaaaaaat

SEQ ID NO: 235514 - DNA, 5379 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttggaatgtctgtgtccccacaaggaacccatgcctgccttctcttagagttctagtgcctgtcaccgcatggatttgcagcttataacttcgttattcagaaagttatcttcttgttattcccttctctctaagaatatttttaccactggttaaaattatgtcttaatagtaatctttaaaaactgtcttagtgttaggttggtgtgaaagtaattgcagcttttgccattacttttgcgccaacctataaaattgcagataattgattcaaagaaaatttgtggaaggattttttaatacgaaatagtagatacagggtttaggtgaacttggaattggtagaaataagagtacaaatatgacagaagataaggtttttcacattttatgcaaagttgaattttaaattattaaaatgtgaattttaaaatgttaagtacttgtcaaaaaataaaaggattccaagttgtccatctaaatgaa

SEQ ID NO: 235515 - DNA, 2367 bp, Homo sapiens
aggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcactgtatataatggtgatgtcataataaagttgttttatcttttaagtaaaagtaaaaaaaat

SEQ ID NO: 235516 - DNA, 390 bp, Homo sapiens
gtcattgcttttccctctgtgagctgactcctttttttatatcctaggcagttgacactgatgatatccagttatgttttctctcatttggagcatttaaataaaatttcccaagaaaagcaaagagcagctgttcacactataacatcattttcaatcttttccccattcagcagttcctttcccagtattaccacaacaatctatatcccatgaagaatagctagaataactatagtgaataggcagcatactttagtggttgagagagtaaagtctagtctagagttaacatctgggttcacatcttggcaccactgcttactggctgggtgagccattaaatattgatttgtaaaattgggataatgacaaggcttaacttacatg

SEQ ID NO: 235517 - DNA, 288 bp, Homo sapiens
atgcacccattagactggctaaaattcaaaatactgacataatcaaatgctagtgaaaatacgaagcaacaggaatccgcattcactgatggtaagaatgcataatggcacagccactttggaagataacctggcaggagggaggaaataaatgagaactcactgtagttttattcgatttttttgtaaaataaaaactgctctaaaaaataaaatgtattttttttaaaaaagaggcagtataaaactattcctgaaacaaaaatcacataaagatatacacaaaat

SEQ ID NO: 235518 - DNA, 845 bp, Homo sapiens
acaacagtcaacaccatagacatcacaattggttcagcttacagaattctgactgaaaaatcaaaagttgagcaaactttccacttgatgggtgccaaaaccagatcagctgcaaagaacagagctttcaatggaaattttaaacaagtaggctctattggttgctacaaaattaattgcagtttttgccattgaaagacatgtcaaaaaccgcaattacttttgccccaaccaatagatcatgaagcatctattgggaaagtgtaacaggaggtgaaatgtggctttccaactatggagacaaagtacaatcgaagtaatggctccgaagatgtggaagtggtccagtcaaagcaaaagtggtctggtcaagagcaaaggtcatggaaatagttttttgagctgcttgagaaattttgcttgttgactttctggagggccaaagaaaaataacatctgcttattatgagagtgttttgagaaagccaaagctttagcagaaaaatgcccaggaaaacttcaccagagagtccttttctatcacagcaaaggttctgctcacgcctctcatcaaacgggaaattttgagagagtttcaatgggaaaccagtaggcattcaccctacagttggtatttagctccttccaacttcttttggtttcctaatgataaaaaatctgtaaagggtaccattttttttccagttaataatgtaaaaaagattgcattgatgtaaattcccaggaactccaattctttggggatggataaaatggctagtatctaagtgctgtgagcaagagacaaaaataaataaataaatggctaatatcattgcctacaa

SEQ ID NO: 235519 - DNA, 347 bp, Homo sapiens
gacaaaagaaatttataggtaaattggacatcaaaactttttaaaaagttgctacaaatgataccatgaagaaagtgaaaggcagcccattggctgggagaaaatctttgcaaatcaataatttatctgatgaaggactggtagccagaatataaattcctacaattcaataattaaaagagaaatcacatgttttaaaaatgggtaaaggacctgaatagacatgtctccagaaaagatataaagaagaccaataagcacataaaaaatgttcaacatcattatccattagggaaatacaaatcaaaatcataatgaaataccacttcacacacactagaactgct

SEQ ID NO: 235520 - DNA, 411 bp, Homo sapiens
aagaatagaactcacctgctggtctctgactcctcttgggccacaatcagcacttggggaccgtggggtgctataaattaggcagcctcccttgtaccattgtctcagctattgctggactctgctgcctgtctgccccctgttcctctaaaccacatgtctgctgtccttgcaacatcctctgggcctccagtggcttgactggactcctagtttgtttcctcttgggtctatctgttcccactgaggcctccaaattcaggaatcctccctccacactgcactttgggcgaacttgagggtgcgctcataatcagaggcactgcctggcggagacaagaggtgaacagagagcgttagcccaggacactgatctgcatggcacagagataaacgttacgataatcatta

SEQ ID NO: 235521 - DNA, 431 bp, Homo sapiens
aggctcaaataatctttgcaagtaaaagcaagttctcttttataaaaaaaaaaaaaagacaactttcaccagtgaggggagaaagtagaataaatagagcccccaaaggaatctatagagaggcaataactctttggagtcagtcgggaccttagtacctgagactactagaagtggagaaatacttctgcccaacacagatgtttttctttacctgaaacagaaatgtggattttttgaaaacgcactgaacaaattccatattctgagtcagaagagagtggatggtgaaatgaccacaatttgtctaaaaagtactcaagcccgttctcaaccaaacaatccaaaacatgtaacagagctcattgaggaatggtcacatgctcttcatttagagcttagaaaagagacatgtattttgggggggaaaa

SEQ ID NO: 235522 - DNA, 407 bp, Homo sapiens
ggagtaccaaataaatttaagacctgagatcaaatagctgctggatttgagtcaatattttggtgggtgacaattaataaaaacgtagattagataaattccacctattacaaccaacagcggtttattaactatactagagatgctgttaaaggaatagctgagcaattagggcttactagccagatggcttgggaaaatagaatggccttagacatgattttagcagaaaaaggggaagtttgcatcatgattaaaactcagtgttgtaccttcatcccaaacaataccgcccctgatgaaagtataacaaaggcattgcaaggtctaactgctctgtccaatgagttagcaaaaaactcaggagtaaatgaccccttcacagggtggctagaaaaatggtttgg

SEQ ID NO: 235523 - DNA, 564 bp, Homo sapiens
aagaggagaataattccattctcccaacagaaagagggtgaatagttccaacaggaccgttcacctggcccagccctaccatgacagttgttggaactggtgttggtgctggtggaaatccagcccttcttctttgcacagtattccaaaatataggggagagtagaaactaggtgcaatggaatattacggtcagaggcaattagagatgagggtgttgggaattttggagttaaatctggtgtacttggaaggaggtctgcacttggggcaggaaagatatcataggttctatggggaggagtctggtatcatgtctgaaccagattcaccctgagtcaccactgcgctcctccagggcctggccagtcttgaagtctgagctgtgccaagtagtagtttaaaaggtatccaggatttaacttatagatataactgagtgatgtgtctctactctcaggggagattatgagggtaatcacactttaaatcatcttaaaatacatagtttttttgtaatatgtccttctcacaaaatataagatccacaagaccaaaactggg

SEQ ID NO: 235524 - DNA, 296 bp, Homo sapiens
aaggaaagccctttcttggagagttgcccacggcagacacaatttaaattaacttaaactatttccttcccctcccccacctcgttatcctttttcagagagtagggaagagaaaacgttttcgggagaaagctacgggaggagctcctctctctctcttccgtccagcggatgccggggctgcagaggccaaagtttgcagcgggcgcggcggggcgggagcggggagcggcgggtggggcggctgctaagggaacgcgcgggcgctcccggagcccggggaaggatggcggccg

SEQ ID NO: 235525 - DNA, 319 bp, Homo sapiens
gcttttttgtcatcataatgttgttttgttttgttttgtttgtttttgagacagggtcttgccgtgttgcccaggctggtctcaaactcctgggctcaagcaatcctcctattaatcctcctattaatctcccgagtagctgggattgtagagacgcaccacagtgcccagtgatacagttgttatactcttgaaactttagtttccatcctgtatccttcctgatacccccttcagtaccatatgcagtatcttaatatgatggtatgttaagaaagatagaagattttcccaactttgttgcatagtctgtgacagt

SEQ ID NO: 235526 - DNA, 234 bp, Homo sapiens
catttgccctaaaggcatttgccaatctgtgaataggtaaaaacttctgttttgatgacttttgatggcaaggggagcagaagttgaagtctttggtttcctagagtggaaacttcaatagaacccataacacatgaattttggattcccagaaaacataccttcagagggaaggagacataactaccaccagaaagtatttttctaaaaagttgctcagaacttggaggaata

SEQ ID NO: 235527 - DNA, 136 bp, Homo sapiens
atgagccactgtgcccagcccatttaacaattttaaactgtgttgttcagtagctttaagtaccttcacattgacttacaatcattaccaccatccgtctccagaaattttttcattttgcaaaaacgaaactctg

SEQ ID NO: 235528 - DNA, 472 bp, Homo sapiens
tggaatcgccaaccagctgaggatgcgcagccacagaccaccttccagaaatctccaaaaggctttccaaaacaggaaaacaaggaaggctgccatcagcaggaattccagggctttcagaatgaggctgtcaggagtgaagggagctgtgctccacatgcagggcagtggccagggctgccaggccttgtttatctgggagcgccaggctgcctgcctgcacctggtctgggcacctgaaggcagagctgctcctgcttagggtctgtggcaactgtcctcctcagtgggtgctgctgggagctcctctgattcctggtgggcggcttctggcctcgcctcttcacccacggtgtagggtgtgggatggagatgcagggcctctgctctccttctcccctcccccaagcagcctgggttgtacctccactaataaacaccaacacccgcgcccagggtgggttcggcaaaa

SEQ ID NO: 235529 - DNA, 642 bp, Homo sapiens
ctctctccctttctaatcttcgccccaagtcctgcctccaggtttatgctgcagagtgtccgtggaagggtggctcttacatggtagctctgaaaagcttgacattattttactaagtgaatgcaagaattctcatgtgggcatctccactcatggataggattgccagatttagcaaataaaagtacaatgaaatatccaattacacttgaatttcagataatcaacaaatacttctttttcgtacagttatgccctgtttaacctctactgttccactagggatatacttgtattgcgcacttacctgttgtttatataaaattcaaatttaaccaggcatcccactcatggggccccagaccaaacggaagccccctccctacccctagccaaatgctggttgagttttttgggatgataatgaggaaaataaggccagaagacccacattgcccctcatctatagcacctgaaacttggaaccacccaacagatccagttctgccctgccctgaagagagttgccttcattttcagcagagtctagagagtaatttaaagtttgaattggcccctggaggaagaacattgtgttaaacttcctatgtgacttgaaataaatttcgttttctctgaaag

SEQ ID NO: 235530 - DNA, 323 bp, Homo sapiens
tcagcatggatagtgttttccagattctgaaagtggatttgtgttgttcattctcagcaatgcctgttgtgaacaaagctgaaccaactttcccctaaatatatcagagagaatcaaattaagctcaggccttgtttaagctggaggaaaatttctccattttaatttgtgatcctttgaaattgagtgagtttggctgggtgtggtgactcatgcctgtaatcccagccctttgggaggctgaggcgggtggagtgcttgagcgcaggagctctagaccagcctgggcgtctagaccagatggtgaaaccctgtctctacaa

SEQ ID NO: 235531 - DNA, 400 bp, Homo sapiens
aaaacctcaacatagacttaggtacaaggtgcaatacaatacatggaatataaacttgtgcaactcaactcaaggaatactgccagctacaaatacaaatgaattccaaaaatgtttagataactgcataactttatcatccactagaagagattgtccccatgagggtcaccttgatttcggggccagagagcacactggccaagacagacaatttcttagtaaggcattttgtaaattaggttttaaatggatgacatataagatagaagggcttccttaggtagtaatctaagtaaaactatcatttttcctttacagaataaattcttttgtgtcttttttaaaaaagtatagtttgctttaattgccaggttgatgaacagtttttaaacattga

SEQ ID NO: 235532 - DNA, 393 bp, Homo sapiens
cccatggggccatctcggcttgtccgtggccctcggccccagggcatgcgttccccctaccgcaggccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacactgacaccaccatagtgtggatcttcccacctcaagttctcagacatctcaggcaacctgggatttttctgatcctctagaagtgcccagaagctagcccagaagcttggtttgccctggacctgcatctcctaggggccgtgtgggtggtgaacaacaaatacagtcattctgctcaaaat

SEQ ID NO: 235533 - DNA, 965 bp, Homo sapiens
aagctcactgaattaagatacaacttcaagaaatcataaaagcaatgcatgaagaacatgagaaggacaaccaacatacagaaattatgacgaactacacagaaactctcgggataaaaatacagtaactaaatggaaaaactcaatacatgggttcaaaatcagaattcattatgtaaattaaaaactagtgaagaggggtcaggcaaggtggctcacacctgtaatcccaggactctgggaggccgaggtgggtggatcacttgaggtcgagttcagagaacagtctggccaatatggtgaaaccttgtctctactaaaaatacaaagattagctgggtgtggtggctggctcctgtagtcccaggtactctggaggctgagtcaagagaagcacttgaacatggaaggcagaggttgcagtgagccggattgccccactgtactccagcctgggtgacagagcaagactgtctcaaaaaaaaaaaaaaaaccaaaaaacaaagaaagaaaattccaggactatcttttatacacctgagcaaaaggaatgtctctctccatgtctaaggttctgatggcatgaatcctaaacatgtaattattttcccagaaatatgacagtaatacgttcaaaataaacacaagtgtgaacacatagctataggtgtttaaaacactgaaagaggccaggcgcggtggctcacgcctgtaatcctagcactttgggaggccgaggcaggtggatcacgagctcaggagattgagaccatcctggtccacatggaaaacccggtttctactaaaaatacaaaaattagcctggcatggtggtgtgtgcctgtaatcccagctactcgggaggctgagacaggaaaatcattggaacccgggaggcagaggttgcagtgagccaagatcacaccactgcactccagcctgggtgacagagtgagactccttct

SEQ ID NO: 235534 - DNA, 455 bp, Homo sapiens
aagctcactgaattaagatacaacttcaagaaatcataaaagcaatgcatgaagaacatgagaaggacaaccaacatacagaaattatgacgaactacacagaaactctcgggataaaaatacagtaactaaatggaaaaactcaatacatgggttcaaaatcagaattcattatgtaaattaaaaactagtgaagaggggtcaggcaaggtggctcacacctgtaatcccaggactctgggaggccgaggtgggtggatcacttgaggtcgaatggaaaacccggtttctactaaaaatacaaaaattagcctggcatggtggtgtgtgcctgtaatcccagctactcgggaggctgagacaggaaaatcattggaacccgggaggcagaggttgcagtgagccaagatcacaccactgcactccagcctgggtgacagagtgagactccttct

SEQ ID NO: 235535 - DNA, 2003 bp, Homo sapiens
  misc_feature (714)..(714): n is a, c, g, or t
tcaagatgagatttgtatggtgacaaagagccagaccatatcaagtacctaactcattactatcctataactatgagtattactggtattcttattggccacttgacaccaacacaagtggggggccttatatcacttaagaagaggaaatatatagaaaaaagtggcctggagagaaacttgctccctgaatttccaatatatgtccaaactgatgactggggtgagaaagatctattctggcttttgcatactgactcagataaaaaacaaagctcatattattacaaagtcaaaaacaaaagatactggtagggctgcagagaaaagggaatgcttatacactgttggtgggaatataaattagttcagccactatgaaaagcagtttggagatttctcaaaggacttaaaacggaatcgctgttcaacccagtaatctaattagtgggtatatatgcaaaagaaaacaaatcgttctaccaaatagacacatgcactcacatgtttactgcaacactattcacaacagcaaagagatggaatctacctaggtgcccatccatggtggattggataagtaaaatgtggtacatatatactatggaatattacacagccacaaaaaggaatgaagtcatgtcctttgtagcaacatgcatggtgctggaggtcactatcctaagtgaattaacacaagaacagaaaaccaantatcacatgttctcacttgtaagtgggaggtaaacattgggtacacatggacctaaagatagtaatggtagacaccagggacaactagagggggcagtcagggaggggagcaaggaatgaaaatctaactattgggtattgtgctcagtatgtggatgacaggatcagtcacatccctaacctcatcatcattacaatatactcgggtaataaacctacacatgtaccccctgaatctaaaataaaagttaaagttattttttaaaaaaactaaaaatgtctggtacacctgagtaatcctcttggtgagagcttcagccagaaaccaggctccttcaatcctaagactgacccatggatatggatggggcactggggcattcctgttctgggagcaaaggaggtgttttttggtgaagatatttgtgaaactgaacccttctggtggagctgaagtctcagctcactgagaagtaagccatgcaagccagagggctcagaggtgggtagcccagacaagacaaggagctcttttccttgattgacacttatttcactccattggtttgtctccctcttacatagtgtcactgtcactagagttggggatggacaaaggattcctggttggtcttaaagccagcacagtgggaggtgggctgttggatggctaagacagattagagtaagagtgtctggtggatggtgatgatgagagatctcacctccaaagccaggtcctacctgcacagcatctttggtttgacatagctttgtcaagcagagcccgagaaataagaggctctcagtttccactagaccaggccaccctagtcattggcaagtcaaagctctggtcctgatgttcattcttcaactgaaggggcaagggaaatctgtttcctcctccagaagcttctgccatgggactgcgtaatacagaggtatctcctagtgtgggaaatggacagatggtggtgatgctttagtgcaccagctcactttccagttatgttctctttctctgggagagagagacagggagaaagagagagggagttgagggagaaaaaagaggtggatgacatgcagcatgagctgtgcactagttgtggagaatacgactgcctgttggtccacggcaaattctaaattaaaaaacaaactgggccgggtatggggacccacgcctgtaattccagcactttggggggctgaagtgggaggatcacttgaggccaggagtttgtgaccagtcttggcaacaaaatgagaccccatctctattt

SEQ ID NO: 235536 - DNA, 575 bp, Homo sapiens
acacactaagtagaaatgaaaaaacatatttatctatctatacttaaactatactatactaagccaaccgaattattctcagtgcttttcatgagttatttctaaattggcaggactattcttttagttgtaaaattctttcaaacaaaaatttaaatattctaatgtgggtagaacatgagcattaaaaataggttatgaagtttttttatagtgctatttaaatttgtacaataccttaaatacctgtaataaaaaatatcagggaaaattctggatgctactgtcaggttactggaaagggagtgatactggcttgggattcctggttacctctgtgatcactcattttttagtttcacaaagtcttgataccaccagagggagctgttgatatcgaagtcttcgaatgaagaagttggtggtgagagttaagactagggagcagcttatgctgatctgtgaagcataatcattatcttgtctgtaatttgtaatcttatagactcttccccacagcaaacattttccttccatgtttcatttcagatattcttcccacattgacccttttc

SEQ ID NO: 235537 - DNA, 783 bp, Homo sapiens
gttgctataatgttccccagaaaccatttattaattggtatgaacatgagactagaaaagttttcctgtcaatgttaatgctacatgttaccacttagggtaggaacttcggtatcatcttggactcttctgagtccattatctttcacatacagttttcatgaggcaagttttactctgcaatggtccttaaatttcttttttttaaattgccactgaggcaaccctagttcaagaactcattcttccttgcttgtactattaaactcttttctgagttctctcttctcttctgagccacccttcattgatcagaaatactatcttcctaaaactcttcccttcctaaaatgcttctagcccttcactcttcccagcctatcagtggtatccacatgtcagttcttagatattcagagactctcccctttacatgaccccctcttaggcttgttttactgccttctgtctttcttcccgcctctccaggttgacagccttctctgaacgacctctccattactctcatgctttgctcatgctcttccctcacaatgcttttaaagtccttttttttttttgatcgattgaaatcttttgccaactaagtggacatcagtctccatttttggctacatgtccgagtgagttgctcttccacagcagttacataagttttgtattattttttttattcgtgcatatttgctcatgtcacaggaatatggaagagattgtgtattcattttttacatcttcctcagcattaacataccacttttt

SEQ ID NO: 235538 - DNA, 868 bp, Homo sapiens
tgtgcagggcagggctgcctcccacggcaggggcaggcagaggcctctgcgccaggtacagcctaggtaccgcctacccccatggctgaccctgggccccaaatccagcgggaggcctgggagcatcttctccgcctgagtcaccgggctgggcccaggaccccagccaagggctttgcctctgggaagaaaagagctttggagtccagcaaaacctgggaagcagggggaagcttccctagcaggtgctatttgagcagaggcctggaggagggagactagcaattatttggtcttcgaggcaagttagcaccacacagagactcttctggatataaaggaaagactgtaaagaatttgcagagagaataactctcgctatgtgacccgaggtgattttatgctttgcctgtgcagcctataaaataatcttgtgtggtccccatgatgcacatcaaccaggagatgctggagagtctgagacagcgtgctggcagcactctgccgggggaaggacacggaggtgtccaggctcggctccaaaagcagacaagcctgcactgcgctggagcaggtgagaagtagctgggttccaccgtgcccttttcgtctgtgtcccttgccacccaacacgagctcagcacacagttgatcttcactaactagtcacccctccaagcttttgcaatggttgttccctctgctaaagatacccccttctcccaccttgaccacccgactaactcttaagctcagctcccaggtgcctcctcctccttcttcttggtacatgagtgccccgcttggcattcgcttaggggtgtctatacacactatttcctctgcctggagtatcttcttccatggg

SEQ ID NO: 235539 - DNA, 382 bp, Homo sapiens
tatccagatttctccctcttaccaaacagttttacattcctctttctggtggccaccaaattttgcaattctcttccctcccacctgtaaataaaagcaattccttcctaaaaagcgactaagagaatggccattctgaaagtttcttcttcattaaaacccagtgcttaagttgtagagttatctggctttcagtattacaactgaggtcaaatgtttacaaaatctgaagtgctggggcatttaattttgtatttaactgtctacacagtaagatttaatggcaggaatggaatcatccaacaggtgcacttggactaaagtctccaatggaatcatccaacaggtgcacttgaactaaaggacctctatatttaaaaaa

SEQ ID NO: 235540 - DNA, 473 bp, Homo sapiens
atttacaaaaagaaaaataatattgacacaggaaatatgcaaaaatgttctatgttatttaaaaaacaagaaatataaattaaaactaaatttaaatacacttcttaccatttgattggcaaaactttaaaaatgttgtaataacacattttgttagctagtttcaaggcaagagtatatttatacattacttctgcaaatggaaatggtaccaaaaaattaaggcaacttgacaatatgcaacaaaatttctattaatatcttcacttttcaatcctgctttctgggatgtactcttctgatgtatcttcaacagggataatatacaaatgtacaagtgtatttataacagcatcatttgtaataataaaatattggaagtcactgaaatgtccataaattgcagcactgttatataaaccactcaatggaatttatgcagttttaaaaataaattactccatatgacatga

SEQ ID NO: 235541 - DNA, 593 bp, Homo sapiens
agcaggttccaggggaattgaaagtaagccacagatgagctagagaaggctgctgataagaatatgttgcacaaattatctggcttatccaggtgctctgccgtgcgtctaacccgttgagcctgtgtgttatctccacgtgacttaatctgtgagatcttgccacaggttaacttgctcgtgtgtacaagaggcggacattcctttcagtgcagtcggaactactgttgatcaagcagagagtggcagttactgaagtgtccctgcaaagtggaaacacacctgttccttatacagttggctctcctaacctcagatttcgcatctgcagattcaaccagccacagatggaaaatatgtgaatagaaaataaaataaaaataatgcagcaattaaaataatacaaataaaaacaatacagtataacaactatttacacagcatttatattatattagttattataagtaatctgtaaataatttaaagtgtatgagagaatgtacataggttatatgccattttatataacggacttgagtatccgcagattttggtatctgcaggaattaatcctccacagataccaaggg

SEQ ID NO: 235542 - DNA, 450 bp, Homo sapiens
aaaatcctgcacttaggccctgtatagacagtgtgttccaaacctaaggaggtgtctgcaacaggggaggctgctgagtgactctgcagagaacagatgacatctgttaaatgtcaaacaccatcacgtcgtacttcaagttgtactttacttggaacatggaagccatctgtctggagctcccacatccatttcaaatcttcagggttccccattccaggggaggagctgaacctcctgacaccgtccacttccctcctgcctccttcaaacatcatcccttttttctcccgaatccctaaatgtttctgcacccaagggctctaccccaataaacacagctaagactctttgattcttaaaatgtcttcctttaacgtcccaccctccagaatctattgtcgtatgttttgttcaccaaaggtaataaaaataaatgtggattttggt

SEQ ID NO: 235543 - DNA, 366 bp, Homo sapiens
cgcccggcagcaccaccattttcttttgggagaccctcccttattcttagtctgcgtggttaggaagaggctgacagccactccctccctaccattcctctctaggctcattctgttttcctgggcgcggtgattggttcaagcataaaccttgacaacaggactattgctggaacttttgggaaaagagaagcctggactcttcctggaaataaaagcatgctataaaataaaataattagcctgggcgctggtgcacgcctttaatctcagcactttgggaggccgaggtgggcagatcacctgaggtcaggagttcaagaacagcctagccagcatggtgaaaccccgtctctactaaaaata

SEQ ID NO: 235544 - DNA, 2811 bp, Homo sapiens
  misc_feature (1107)..(1107): n is a, c, g, or t
  misc_feature (1964)..(1964): n is a, c, g, or t
  misc_feature (2068)..(2068): n is a, c, g, or t
cgccttgcagtttgatctcagactgctgtgctagcaatcagcgagactccgtgggcgtaggaccctccgagccagtgagatgaacccggtacctcagatggaaatgcagaaatcacccgtcttctgcgtcgctcacgctgggagctgtagaccggagctgttcctgttcggccatcttggctcctccctcaggtatccttcagaaagcctgggcaataaaccgaaggcttctaaaaagagcaaagtgtctggtgagtcaagcagaatctcaaagctgaactaaatttggtgaatctggactttgccagccctgaagaagaataagcatgaaggaactcttcaagtagctagtgcatttgtgttgctgtcagcaaaatagccagttggagagctatgctgttctccactaaaagaattgtagaaccattgggctttaatagatttgaaagactgtataattgaatttataatcatctggcttagaaaatatgcaaaatcacattcatagtgagcagatgagttatggtatccgtggacaattctgataggaaatattggttatatctggtgaaacccatgataaaccaaaggcacgttaagggcagatggttggagttggggtatgagtgttggtcatacggtggaggggaaaagagtaggatgttaggatcatgcagaaattatgtggttgccctacagaaatgataagccataaagttctactctggccagtgttttaagtcgatgctagaaaagaaaaacaatagtggcacaggggttggttatttgttttccacaggccaagaatatgtcaaaataaagcccaataggatgtatattcagtggtcaagtagactgagagatgttaacacacttattcatggcatcatttcagattttgcctatagtaggcattcaaaagatgtttgttaaattttataaataaacaaaagctatatcagcatggcctttttctaatccaaaacctgggcacacagccaggataaacttaagctgtccaaaagccatgtgcgctctcgccagaatcatcaattctctccagtcatttcactatgaagaaggcctggatgaacttaatgggaaagncccattagctgccactcttggattgcatatctacgtatccttcagatttcatgtccctgatatatttgtgttcttgctagtcctgattttaaattattgcttttccttttaatattgttctgatttatttttatatgttactcaatattctttaatgacagcaaataatgataaaaataatagctgccatggcctattgaggcttcctatgacagaaactcttctaagataaaatttcatcctcatgacaactcataacctttgagaaagtttccatagatttctattttactactaaaaatactgtggtttagtgagattatgcaattaactcaaattcacaaagataggaaatgcttcagctgggatgcaaacctctatctaagagaaaaacccgatttcctcattgctatatataccattaatttggagcaaagcagaatcacttaaaaatccttttaagtgatgattaaataaatcatcaattgttaaacaatgattagattcctaattattttcagtcatttgtttaccactaaatataacaatagtagtaataataataatgataacccatctgcctgtgttcttaagtgtcttatatattagttgtggaaataagacatatatgatgaactgttaaaaactatagaagagaatttatacctaaatatgttcatgtattaagtagtacaagaaagtcatctggaaattttaaaatgaaaggaaatctgcaaatattaagtcaactgggcatttcttttcaggaaatgaaaattaagctgaatctgaagggtgctaagaacaaaattgatggaggtgaagacagagacttctacataaaggaaatagttagnaattaagcacagagacaaaaataaaagacagtgttttgtaggggcagagtgattgggcatagccaagaaacaggatatattaagtagattgataataaggtttnaatgcttcaaaagttctaagcttagatgcttggaaacaaaatttgaccaagaatttgggtaataaatttgaagaataaaatgagaagcttaatttgcatgtgttcagtttaaaatgatatccggttggaaataccaaattgtagagctggagacattgtactgggaattgagtaatggtcaggatttattacactgggacagaagagaccaacacatagaatacactgaaggtcaggttctgtccagaaaccactcaacaccagagcattaatgaatatgtgaataagtaagtgcatcttcttagctcaggcatggaaactgatttaaaatgtaagaagtctgtatggatgggagaaagaagtggaaatcaatttaagggaaaaaaaagcaaaatcagaatatacaatctctcttctgaggccctagtcatatgttgctaactatagaggagtcattagataaaagtgtgtacatttggaagcaaacaaagactgcatcccatgagatttcataagctatgattattataaagagcaatagactctcaaaaatactcttaaaatactatacataaaaatagctagtatttaaaggctcataaaattcttgaacaggtattagccatttaagaagtgatggtagaaagagaaatgtataggtcagagaacagtccttggaaaatgaaaggagttaggaagtaaaagaaagaaaatcaagggaaataaatgaaagaatgacagag

SEQ ID NO: 235545 - DNA, 2198 bp, Homo sapiens
  misc_feature (1253)..(1253): n is a, c, g, or t
  misc_feature (1315)..(1315): n is a, c, g, or t
  misc_feature (1471)..(1471): n is a, c, g, or t
tttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcacctgccaccatgcctgtgctattttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttattttgctttatttttattgttttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcctccattttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagatngcaatattaggtaggcaaattgagagtccatgtttgttcctcatagcaatgtgatttgttcnttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacagnagtacagggaagctcacctccactttgtttacatttctatgggcaaatgtgccgactttctagtgagatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctg

SEQ ID NO: 235546 - DNA, 530 bp, Homo sapiens
tcttgttcctcttgtgaattctcatttcagttcgactttagttggaatggttaggatactgttcaggcagtaaataacctttacgtaggaaaaactgctacaaggcttttgtatttttgtttgatcatgaccaattcaggataggtaatttgatgggagggaaaaagtggcccctcggcgggagtttgaggctgctgtgagctgtgctcgtcccactgcactccagcgggggcaacagagcgagaccttgtcacttaaaaaaggtagctcatggtaaacaaccttggagcaccttctcttagtgatttcatgtttcaaccagtacattgtggtgaatactgaaatatcttgtttaattcagataattaaaatggtggcaaaggaagctgtttagccagagcccttcttgactttgaggaacagtggtagtataagacttgaagacagacgtgtaaaaagtactactcactggtaggctcaggtctggttgattgactgattcttgagacagagcaagactccatctcaaa

SEQ ID NO: 235547 - DNA, 446 bp, Homo sapiens
actgtctgcttccttctagactgatacatgccctcttgttaaatcacagctacaaccaccacaagaaaatagctatcattgagtacttacgatcgtcagcaggcaggcatgtctgttacggacttatacatggtaaaagaaaagtaaaaacaacaacaacatgatttttctaagaagagacaattatcagtaagagtcaataggaatatctaaaaagatgttaaaaagaggtaacagttctttgagaagatcccgcaaccctgcagtccaatgacggttcaactccctgcatctgataagcaccttttcccctcaattaaaaggaaggaggccaggcacagttgctcacacctgtaatcccagcactttgggaggctgaggtaggcggatcacttgagctcaggagttccagaccagcctggccaacatagtgaaatcccatctct

SEQ ID NO: 235548 - DNA, 423 bp, Homo sapiens
tttgaggcttaggtttgggaggtgaatgtcaactctcacccctgtgaggtggcagctttgctctgttggcctcctcagaggctaaataaagaaatgctgagatctataaaccacccagcccagagagaaaaaggagggaggaagggcagctccctagaaaaaaatccaccccctccccaccactaaacacatttttaattgtcccttgggaacatttgtacatttgaccaaagcaaatctcaaagcagcagcagcaaaatgagtcagaggggctggtggtccagagagagctggggatcggagatggggaggtgaggagaggtggcaggcatgtttgggaaggtgagaaacttggttcctttcccaccatctctgtcaagctatagaaagaaagtgagcaggagaaataaagttccaggggaa

SEQ ID NO: 235549 - DNA, 404 bp, Homo sapiens
cagtgtcattgctttgtgtgatttctgaatgttgtatttgttcatctcaaccctagatgtatatagctctgagttattaatggttataaagctcttgttattgatattacctatttacatcaaaaagcttttagaaaatggtatgatgtaagcaattcttgtcatggtgaaatctgatggtgtaacccgttttactattggcgctgcttcataacaaaaatgaaaagctatatacatctacagccagaatggattgtttatgtcatataatttcctttactaagttcacttacattacttacagagttttattcattgccataatagagccatgtaggaaatgcactgactgcatgttattgtggcaagaatatcctaaatgtcattaaaatcctccaacatga

SEQ ID NO: 235550 - DNA, 289 bp, Homo sapiens
tacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgc

SEQ ID NO: 235551 - DNA, 585 bp, Homo sapiens
cagttcctggaccctatatactattaatgcccttggctgagacttggtgcatttgtgtagttttggaaactccttcaagcaagagagaaatttttctgaaaaaatagagaaaccttagattctattttattagaaatgctgtatcttgctttcatttagcagaaattctatgccttattccatgaagcaaacaacataataagtaaagggcttgctctgtcttggcttctgagagagctagatttgcctcctgggtcatcttcttaagtgaactcctttgggctggagagctgttctctgattaatgccagagccaagcccagggagatgctcaatcagataaaatagcgttgatgcctaattatagactcaccatgtcttgtattttgcagcctgacccttcctggaattttgacgatgctattcaggataccacttcctattcataatctgcatatttaagatggcttgattcaaaacaatgttttggatacaaacattccaacatttttccaaaacacaggctttatcagcatataaagtaatttgccacatgcattgtgtttgcatcctagcaagtggata

SEQ ID NO: 235552 - DNA, 1000 bp, Homo sapiens
gagaccagcctaggcaacatggcgaaaccctgtctctacaaaaatacaaaaaattagctgggcctggtattgtgtgtgtgcctgtaatcccagctacttggtgagggctgaggtgagaggatcacctgagctttggatgcagaggttgcaatgagctgtgatggcaccattgccctccagcctgggtgacagagtaacaccctgcctcaaagtaaataaataaaatgttacacttttatagggcagctctgttacaatcttatgtggccaccattgtatatgcagtccattgttgaccaaaatgccttatgtaacacatgatttcatagggaaagaaagcctcttccttttggtcaatgaaagaaggtggagtgaagaaaggtgagagtaaggagaggaaatataagatgtttttgttctgatttcaggtatagaggaacctagggacagagggactccagatttttagccatgtggatacctagaccgaggaaacctcttgctggaatttggttcctttttgatgtggaaggagcccataattcccagctctctgggggtgtgggaaggcagctgacctgtgagtcagtgggccagtcatgcatctatcatagcagggggcagagctggaggtgggttccctaagctcggggactcaatagaggaagtgacaggtattgagggagtctgtacttatagtcggagcaagcatgaggctaccaggccctatcaagctgagagaccaacttattaaatacaagttgagcatttgagatcagtagcacatgcagccgccagagggcagcacaaggacgtgcgtgggccagagccccttctcccatgttcccacatgccccatggaagccactggggccaggagcggggagagactgagcaatcgtcccacactgtttatgttataagatggggctaacttctaacccttaggaccacctgtggtgtagagatagcagtgtaggggaaaggtggtggtttgtga

SEQ ID NO: 235553 - DNA, 363 bp, Homo sapiens
caaagcctgaggtgactttctaaccaggagcacaaatgtctctgacgcgtgtcccagctagaaaacacaccgaggtacagataccaccatcccttccagacctcccttgcacacacgccccttggtaaagtacccagcaccaaggggacaagggaaaggctgatggaatacttggatggtctggggtagcgtatctgtatgcccgttggtatcttccctggacatcccttctaatatatgccaacctccacagctctgtgaaaggtttttttttttttaaagactgagtcttggtttgttgcccaggctggagtgcagtggtgtgatcttggctcactgcaacctctgcctcctggattcaag

SEQ ID NO: 235554 - DNA, 416 bp, Homo sapiens
caaagcctgaggtgactttctaaccaggagcacaaatgtctctgacgcgtgtcccagctagaaaacacaccgaggtacagataccaccatcccttccagacctcccttgcacacacgccccttggtaaagtacccagcaccaaggggacaagggaaaggctgatggaatacttggatggtctggggtagcgtatctgtatgcccgttggtatcttccctggacatcccttctaatatatgccaacctccacagctctgtgaaagggttaccaagggatggaagagatcctcactcactgtgcctgaggcaggaatttttttttttttttttaaagactgagtcttggtttgttgcccaggctggagtgcagtggtgtgatcttggctcactgcaacctctgcctcctggattcaag

SEQ ID NO: 235555 - DNA, 560 bp, Homo sapiens
caacattcctgtgatttgtgggcacgagaagcgacttctcccgaatctccggccattttgggggccccagggctaagctcggcttccttagatcgcattctaacggcgttttattttatttagggcacagtttgcataataaaattaaaaggatcccattactccccttttctctctgagcactgcccagcaaggtctttcagactgttatttgaacatctagagcggccttcagaagtcgaattagcattgcttttctatgggaaagaaaaagggaaagaggtaaatagggcaaagtgagaagcgggtaaggtacaaggagtgaggtggattaaaacatgcagggagcggtgaaggagactggggacagaagaggacaagagaggagatggggcagcagggaggcgaagagataaacgctgagtcaccctaacaggtcattgggtacacaggagcgagatgccgcaggccaggaaaatccgggtgcaaatcgcaccccatcttctgggcctccttcccgccaagccgtaggagcgccggcttggagctcggcgccgccc

SEQ ID NO: 235556 - DNA, 525 bp, Homo sapiens
atttcactgactagaattaccagtactatgtcaaataagagtgactagtttggacatattttttcacaatcctggtagaataaaagcattcattttttcatggttaagtatatgactgatgaatgccagatgcctctagtgagccaccttgaatcactattctgaatacatcttgagtaaaaagagaaaattgctcatgtttccatgtctatctgaatcatgttattggaccatgagagcaagcagctggatctcattctgtccaggctattgctaaggcaggctggctgccttcatcttccccagtattctaggataacctcaaagaaatcacaacagcttgttttctacaattaaaacatttgggttttgatagtgtgcatggtctacaaagaagtgagaagtgtagctgtttgtatggaatcttatggtgaacattgctggctccaacatataacttgattggtgcgacatcaaggtaaatgaatcctcaaagagctagcaaatggatcaaataaaagtaga

SEQ ID NO: 235557 - DNA, 450 bp, Homo sapiens
cacttctatgaacttttatgaactgtaacactcaccgcaaaggtctgcagcttcacccctgaggccagggagaccacgaacccaccggaaggaatgaacaactccagacgcactgcctttaagagctgtaacacttaccacggatgtctgcagcttcactcctgaagtcagcgagaccacaaacccaacagaaggaagaaactcccgacacatctgaacatctgaaggaacaaactctggacacaccatctttaagaactgtaacactcaccgtgagggtcaaccgcttcattcttgaagtcagccagaccaagaacccaccaattccgtctatctgaatcatgttattggaccatgagagcaagcagctggatctcattctgtccaggactcctggaaacagcagctctaacaaaattgtcttcaataaataagtttttttgcatcaca

SEQ ID NO: 235558 - DNA, 104 bp, Homo sapiens
gaggctgagaggagcaggacgcacagacacatggcaggcaccaggagagccaggctgctctgctctgctggcgatccatgtgctgtccccctctgtctcttgac

SEQ ID NO: 235559 - DNA, 4066 bp, Homo sapiens
  misc_feature (511)..(511): n is a, c, g, or t
  misc_feature (2211)..(2211): n is a, c, g, or t
  misc_feature (2959)..(2959): n is a, c, g, or t
  misc_feature (3814)..(3814): n is a, c, g, or t
cgcgcctgtagtcccagctactcgggaggctgaggcaggagaatcgctggaacccgggaggcggatgttgcggtgagccgaaatcgcgccactgcactgggcaacagagcgctacttcgtctcaaaacaaaaaaggcgttttacagtcaggcaaaccctgcctctgcccagtccagcgcccgcctcgccctcctgcgccggtcgctgctgacccggggctccacccacgtgcggtcccgggggtcccgcctgccgtccgtccaccgcgcggtcgcagtcagagctcggctcggggcggacacgcatgaacgcgagtgagaagcggcgactggacggcgggcggcagcgtgtcccgcgggccgggcactcgggtgcgctccggcgtccggtgtgtgtttcctggtcctcgggggcgcttcccccggtgcttccttttgccgtcggcctcacttccaaccgaaggtcaggacggcaggcctcggccccaggggcgacccttccacctgggaanggtgggcgcgagcctccagcagagaccgcctttacccgccccgcgtgggaagcgccaggatcgcgaggaaacgcgacacgtgcatcgcgacggcccaggcacggagccgcaggaagctggcacctgacgcgcctgcgcccacccaactcgagttggtggcgcgtcaccttcccctgggatcgcccgcagcaggggcgcccacgcacgtgccagtccacgtggccccgccctagcgaccgttgctaaggggcgtggctcagccgcacggaacccgagcccccggcgacttataaatatttgcgtattcaaatgaggcctggctcccgttgctatggcgcccaggccgcaaccccgcggcggccggaagaacagcctgggagtaggagacagcgcctggaggtggagggcgcccagggccgagctgccagggccggacacctaggctgagccctcagccggccaactcgcctggcacaggggcagctctagacgggatggagaggatgcatcttcagtgtccacacgtggtcaacagataaaagccatggccagaacgttctaagtggctacatgtgcatctgcctgttcacggattccttcgacaaatatttgagcatcccctcctgcgactgtggacagcagaggagcacgcaggccacgtgcagcccacagctctggggcgaggcaggccctcaaccgaacacgtatagagacagggtttcaccgtgttagccaggatggtctcaatctcctgacctcgtgatctgcccgcctcagcctcccaaagtgctgggattacaggcgtgagccactgcgccccgccagacgtctgcatctttaaggggcaacaccagcaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggccttgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctgggtacggcagctgcgcccggaggacccactgctgagncccagctccccccaggaagaggcccccaccccaggcttctcagaaacggatagccacatctcatgcacttctccagccttgaccccggtccccagagctgtgcacacccggccccaggccaggacactgtctctgagcagcccacagagggagaggaaggtctgaagatgagggcctctctagaaggctgcagcgtgagaggccagcctcaggccatgcagcatggggattggggcccctggtctgtggacagagtctggggggcgctctcaggctgggccttggtgacctctgcttctgaacctcgggcagactgtccccgtggagcccccatccggagacttgaccccgagctgtccctgcctgagacgcagtcccgggcctccaggccctggcccttctccctgctggtccatgggggccccctgcctgaaggcctgctttctgaggacctggccccagaagataacaccagcagcctcacccatggtaactgacttgcctcaaagctgaccctgcagcccctcggccccgaaccaggcccagccatgctgtctcttgcaggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcanggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcaggcctgagccctcgagcccagggatgtcctggcccaaagccagcaccacatgcagcagctagacctcccagggcagctgaactctctcaccccagccccgtccccacttaatatagcccccactgccaggcttgcctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccngccccagggtaagagccacctcctaggccgcagtggcccaaggtcccagctgctcgcctgaggccgccgggggtgcggtccaggcctcccgtctccgggggatctgtagggttcccgcactgcgatagggcggcccgtcccctcctcttggcgcaggacgccccggaacccaaaccaacatttccagctctcaggtgtacagaaatgcggtttactttgtaggccacgttggttcaataaatgatgcagcgg

SEQ ID NO: 235560 - DNA, 4141 bp, Homo sapiens
  misc_feature (511)..(511): n is a, c, g, or t
  misc_feature (2286)..(2286): n is a, c, g, or t
  misc_feature (3034)..(3034): n is a, c, g, or t
  misc_feature (3889)..(3889): n is a, c, g, or t
cgcgcctgtagtcccagctactcgggaggctgaggcaggagaatcgctggaacccgggaggcggatgttgcggtgagccgaaatcgcgccactgcactgggcaacagagcgctacttcgtctcaaaacaaaaaaggcgttttacagtcaggcaaaccctgcctctgcccagtccagcgcccgcctcgccctcctgcgccggtcgctgctgacccggggctccacccacgtgcggtcccgggggtcccgcctgccgtccgtccaccgcgcggtcgcagtcagagctcggctcggggcggacacgcatgaacgcgagtgagaagcggcgactggacggcgggcggcagcgtgtcccgcgggccgggcactcgggtgcgctccggcgtccggtgtgtgtttcctggtcctcgggggcgcttcccccggtgcttccttttgccgtcggcctcacttccaaccgaaggtcaggacggcaggcctcggccccaggggcgacccttccacctgggaanggtgggcgcgagcctccagcagagaccgcctttacccgccccgcgtgggaagcgccaggatcgcgaggaaacgcgacacgtgcatcgcgacggcccaggcacggagccgcaggaagctggcacctgacgcgcctgcgcccacccaactcgagttggtggcgcgtcaccttcccctgggatcgcccgcagcaggggcgcccacgcacgtgccagtccacgtggccccgccctagcgaccgttgctaaggggcgtggctcagccgcacggaacccgagcccccggcgacttataaatatttgcgtattcaaatgaggcctggctcccgttgctatggcgcccaggccgcaaccccgcggcggccggaagaacagcctgggagtaggagacagcgcctggaggtggagggcgcccagggccgagctgccagggccggacacctaggctgagccctcagaccaggccagtgaggcacccagagcctgagccactgccccgctccaacactcccacccaccacctctgtcaacagccggccaactcgcctggcacaggggcagctctagacgggatggagaggatgcatcttcagtgtccacacgtggtcaacagataaaagccatggccagaacgttctaagtggctacatgtgcatctgcctgttcacggattccttcgacaaatatttgagcatcccctcctgcgactgtggacagcagaggagcacgcaggccacgtgcagcccacagctctggggcgaggcaggccctcaaccgaacacgtatagagacagggtttcaccgtgttagccaggatggtctcaatctcctgacctcgtgatctgcccgcctcagcctcccaaagtgctgggattacaggcgtgagccactgcgccccgccagacgtctgcatctttaaggggcaacaccagcaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggccttgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctgggtacggcagctgcgcccggaggacccactgctgagncccagctccccccaggaagaggcccccaccccaggcttctcagaaacggatagccacatctcatgcacttctccagccttgaccccggtccccagagctgtgcacacccggccccaggccaggacactgtctctgagcagcccacagagggagaggaaggtctgaagatgagggcctctctagaaggctgcagcgtgagaggccagcctcaggccatgcagcatggggattggggcccctggtctgtggacagagtctggggggcgctctcaggctgggccttggtgacctctgcttctgaacctcgggcagactgtccccgtggagcccccatccggagacttgaccccgagctgtccctgcctgagacgcagtcccgggcctccaggccctggcccttctccctgctggtccatgggggccccctgcctgaaggcctgctttctgaggacctggccccagaagataacaccagcagcctcacccatggtaactgacttgcctcaaagctgaccctgcagcccctcggccccgaaccaggcccagccatgctgtctcttgcaggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcanggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcaggcctgagccctcgagcccagggatgtcctggcccaaagccagcaccacatgcagcagctagacctcccagggcagctgaactctctcaccccagccccgtccccacttaatatagcccccactgccaggcttgcctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccngccccagggtaagagccacctcctaggccgcagtggcccaaggtcccagctgctcgcctgaggccgccgggggtgcggtccaggcctcccgtctccgggggatctgtagggttcccgcactgcgatagggcggcccgtcccctcctcttggcgcaggacgccccggaacccaaaccaacatttccagctctcaggtgtacagaaatgcggtttactttgtaggccacgttggttcaataaatgatgcagcgg

SEQ ID NO: 235561 - DNA, 4659 bp, Homo sapiens
  misc_feature (511)..(511): n is a, c, g, or t
  misc_feature (2804)..(2804): n is a, c, g, or t
  misc_feature (3552)..(3552): n is a, c, g, or t
  misc_feature (4407)..(4407): n is a, c, g, or t
cgcgcctgtagtcccagctactcgggaggctgaggcaggagaatcgctggaacccgggaggcggatgttgcggtgagccgaaatcgcgccactgcactgggcaacagagcgctacttcgtctcaaaacaaaaaaggcgttttacagtcaggcaaaccctgcctctgcccagtccagcgcccgcctcgccctcctgcgccggtcgctgctgacccggggctccacccacgtgcggtcccgggggtcccgcctgccgtccgtccaccgcgcggtcgcagtcagagctcggctcggggcggacacgcatgaacgcgagtgagaagcggcgactggacggcgggcggcagcgtgtcccgcgggccgggcactcgggtgcgctccggcgtccggtgtgtgtttcctggtcctcgggggcgcttcccccggtgcttccttttgccgtcggcctcacttccaaccgaaggtcaggacggcaggcctcggccccaggggcgacccttccacctgggaanggtgggcgcgagcctccagcagagaccgcctttacccgccccgcgtgggaagcgccaggatcgcgaggaaacgcgacacgtgcatcgcgacggcccaggcacggagccgcaggaagctggcacctgacgcgcctgcgcccacccaactcgagttggtggcgcgtcaccttcccctgggatcgcccgcagcaggggcgcccacgcacgtgccagtccacgtggccccgccctagcgaccgttgctaaggggcgtggctcagccgcacggaacccgagcccccggcgacttataaatatttgcgtattcaaatgaggcctggctcccgttgctatggcgcccaggccgcaaccccgcggcggccggaagaacagcctgggagtaggagacagcgcctggaggtggagggcgcccagggccgagctgccagggccggacacctaggctgagccctcaggtgagagccgagcgcacccttggggtgggagccgcaagcctcgccctatgaccggtgccaggagggaacctgcgccgaggcgtgggcgcggggacgaagcagcacagccatcggggacccagtgatggccccgcatgtcagatctggtcccctgaggacccttgcctccaccaccccctggccctgcactgaaagggctccctgtcaggagacaggaggggccccaagccctgcccctgagggagactcagaggcaatgacccagggtgctcagggttccagggtggggctcaggaggggagcgggctctgccttccgagcccccatggtgaaggggcgagggcagcaggggacccagaggtgatggctacccaccagggaatggcactagcaggggtgtggagacaggccccccagttaccaatttggggagcatgggggcttgcagaggggacacagggtgggagcagggccgtgaagtgtgtggatgggttcaggcctgggtgagaacactaggtgcagtgtctgaggtgggagttcaatggggtctttggatcccacagcctccaaccccttgcacccccaggccttggggctcagaccagtctgatgcttggggctcttgggcacagaggagacaagggtagctgactcagcccttagtgtcacccataggtgtccaggggctgcccgtgaccccgccagctcacgccctccatgaggctcgaggctggcaggcctgggatggaggtggccagagtctttggggggatgcagtgttggggtcctgctgtgaggcctggggccttgcactggctggagaaaggcaggcagtgggggagatttgggctggaaactccatgagattctgctttgggcttcacttctttgatccttggtgcatggtcaccttccagaccaggccagtgaggcacccagagcctgagccatgcgccccgccagacgtctgcatctttaaggggcaacaccagcaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggccttgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctgggtacggcagctgcgcccggaggacccactgctgagncccagctccccccaggaagaggcccccaccccaggcttctcagaaacggatagccacatctcatgcacttctccagccttgaccccggtccccagagctgtgcacacccggccccaggccaggacactgtctctgagcagcccacagagggagaggaaggtctgaagatgagggcctctctagaaggctgcagcgtgagaggccagcctcaggccatgcagcatggggattggggcccctggtctgtggacagagtctggggggcgctctcaggctgggccttggtgacctctgcttctgaacctcgggcagactgtccccgtggagcccccatccggagacttgaccccgagctgtccctgcctgagacgcagtcccgggcctccaggccctggcccttctccctgctggtccatgggggccccctgcctgaaggcctgctttctgaggacctggccccagaagataacaccagcagcctcacccatggtaactgacttgcctcaaagctgaccctgcagcccctcggccccgaaccaggcccagccatgctgtctcttgcaggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcanggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcaggcctgagccctcgagcccagggatgtcctggcccaaagccagcaccacatgcagcagctagacctcccagggcagctgaactctctcaccccagccccgtccccacttaatatagcccccactgccaggcttgcctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccngccccagggtaagagccacctcctaggccgcagtggcccaaggtcccagctgctcgcctgaggccgccgggggtgcggtccaggcctcccgtctccgggggatctgtagggttcccgcactgcgatagggcggcccgtcccctcctcttggcgcaggacgccccggaacccaaaccaacatttccagctctcaggtgtacagaaatgcggtttactttgtaggccacgttggttcaataaatgatgcagcgg

SEQ ID NO: 235562 - DNA, 538 bp, Homo sapiens
tcagtcgaccagagttctggggatgattatgtttttccctgaatacagagttctgggatgattatgtttttcttcttcaagcatttaaaagatgttgcattgtttcctgtcttccatggtttctaatgagaagtcaggtgtggtgtcagtagtatcattattcccatgtatataataatgttttgatattctctggctgctttcaggattttctctttatctttggttttcagcagtctgactatgatgtgcctaggtgtggttttctttgtattcatcctgcttgggggttgctgagcttcttgaaactgtaagttgatatttttcaccaaatttgtgaaaagcttgacttttatttcttattctttttctgtctcatttctctctcctcttcctctgtaactctaattacatgaatgttagtatatttgatattttgtagattactgagggtctgttcgttttcttcccagtgtttttacttttagttcctcagaatagatacactattcatgtattttcaaggagatggaccaat

SEQ ID NO: 235563 - DNA, 460 bp, Homo sapiens
ggcccagctattctactctcaggtatttaccaaagagaaaggaaaatatatgttcatacaaagacttgtacctgaatgttcatagctttttgactcatttattcactcaaaaaaaaatcatgctgttcacactaagaaatagtcttggaaaagaaagaaaacaaacaaaaaaacccatcattctgtgtgaaagaagacagacaaaatagtgcctattgtgtaaatctatttacgtgaagttctagaactggcagtatcaatctacagtaatagaagcgtagtggttggcagccatagctgtagaggggattggctggaaaacgcaaaagtgaactttctgggaaatgttttatagcttgattgggatggtctacatgtttgtcaaaactcattgaattgcacagttgaaatgtatgcaatttattgtatgtaaattaatcttgaaaaaactattttaaaa

SEQ ID NO: 235564 - DNA, 454 bp, Homo sapiens
gtttatgtattattctgtcttaagaaaagcagaccaaaaagtttagtggtccacggaagttctgccgtactggaactgaaccatagcaaatgcatctccatttccatgattcagtagctttgagtgacaaagtaactaatctccagccctggttattgagaaactcctgaattgtttgcactgagctgccggtttcatccagaattcctggcaaaggtgttagaacggctccatgattgaatcaccagtgatttttagtataaatacggcagagctggaaacctggaaaatagaacaaaatgaatggattggttatcctaccgctgaagcaatcaaaacagcacaacttgggaagagaaaatttagggttcacaattgtttttagttctgtaattaagccaatcattcgaacacaaatatgttatttaaaaataaaaaccatttccctagcttt

SEQ ID NO: 235565 - DNA, 451 bp, Homo sapiens
ctccattctctcccccaattcgctcaaatcctcacccccctagtggtccacggaagttctgccgtactggaactgaaccatagcaaatgcatctccatttccatgattcagtagctttgagtgacaaagtaactaatctccagccctggttattgagaaactcctgaattgtttgcactgagctgccggtttcatccagaattcctggcaaaggtgttagaacggctccatgattgaatcaccagtgatttttagtataaatacggcagagctggaaacctggaaaatagaacaaaatgaatggattggttatcctaccgctgaagcaatcaaaacagcacaacttgggaagagaaaatttagggttcacaattgtttttagttctgtaattaagccaatcattcgaacacaaatatgttatttaaaaataaaaaccatttccctagcttt

SEQ ID NO: 235566 - DNA, 771 bp, Homo sapiens
  misc_feature (27)..(30): n is a, c, g, or t
actaatcacttattggtaagaaaaaannnnttgcatgccattgcagcatcaagtggtccacggaagttctgccgtactggaactgaaccatagcaaatgcatctccatttccatgattcagtagctttgagtgacaaagtaactaatctccagccctggttattgagaaactcctgaattgtttgcactgagctgccggtttcatccagaattcctggcaaaggtgttagaacggctccatgattggtcagtgaaatcatcaccatcttcccagaactcaggtgcaagctgttgggatgggaagccagtcacccactttattttcatttcctgaaagtgatctggtaccgtttgtcatgggtctttgtcttaagaagcctcaaccgtaagcgtagagactggggacaccacagtggacactgatgctccagggatgaggcgtgcccagccagtgcagttttaagacggaaaagtgaatgccttggtcaccattggcaccggccattattgttactctgcaaagcatttcatgtatttctcttatctgtctgtcctgaagacatttgaaatgccatccccagttagagttcagaaagttaaactacgtccttcattaatagcagaacaaactgtgatataaccatgcagataatatgttcatgcatggaataccatccaactgtttaaaataataaactggctgagcatggtggctcacacctataatctcagcactttgggaggccaaggcaggaagatcctttgagccca

SEQ ID NO: 235567 - DNA, 235 bp, Homo sapiens
  misc_feature (1)..(1): n is a, c, g, or t
natcactgcgtgcgaacctgaatcaccagtgatttttagtataaatacggcagagctggaaacctggaaaatagaacaaaatgaatggattggttatcctaccgctgaagcaatcaaaacagcacaacttgggaagagaaaatttagggttcacaattgtttttagttctgtaattaagccaatcattcgaacacaaatatgttatttaaaaataaaaaccatttccctagcttt

SEQ ID NO: 235568 - DNA, 342 bp, Homo sapiens
aggtcagcgcttgagatattttgcagagcctggacttgatggatcagctggcaccacccagatccataaattggctcatctgatcttgtggcccccatccatctgtgttcttgtggaattcacccagaatcaccagtgatttttagtataaatacggcagagctggaaacctggaaaatagaacaaaatgaatggattggttatcctaccgctgaagcaatcaaaacagcacaacttgggaagagaaaatttagggttcacaattgtttttagttctgtaattaagccaatcattcgaacacaaatatgttatttaaaaataaaaaccatttccctagcttt

SEQ ID NO: 235569 - DNA, 486 bp, Homo sapiens
ctccattctctcccccaattcgctcaaatcctcacccccctagtggtccacggaagttctgccgtactggaactgaaccatagcaaatgcatctccatttccatgattcagtagctttgagtgacaaagtaactaatctccagccctggttattgagaaactcctgaattgtttgcactgagctgccggtttcatccagaattcctggcaaaggtgttagaacggctccatgattggtcagtgaaatcatcaccatcttcccagaactcagaatcaccagtgatttttagtataaatacggcagagctggaaacctggaaaatagaacaaaatgaatggattggttatcctaccgctgaagcaatcaaaacagcacaacttgggaagagaaaatttagggttcacaattgtttttagttctgtaattaagccaatcattcgaacacaaatatgttatttaaaaataaaaaccatttccctagcttt

SEQ ID NO: 235570 - DNA, 419 bp, Homo sapiens
ccaggacccagctcttgaatgttttctctttctacacttactccttgatgacctcatctaatctcattgcttttaaaataccatttaggtgctaatgattccccaatgtacttttctcaccttgatcacttctctaaattccaactagttttttccaacaccctaatacctaaacttagatttttaatagaggttatcaaaattaacataacaaaatcttagttaatgagcccgcactccattcctccttccgtctgtcctagagtccagccatttaccatctgcacatttactatctgcactactaacacctgaaccaagccaacaccggctgtcatctggcttactgcagtaactctatttcagaacagccagagtgacattttaaaaacattgtcattgtacacagtggttaacta

SEQ ID NO: 235571 - DNA, 507 bp, Homo sapiens
ctcactctattgcccaggctggagtgcaatggcgccatctcggttcactataacctctgcctcccaggttcaagcgattctcctgcctcagcctcccgagtagcaggaattacaggcatgcaccaccatgcctggctaattttttttgtatttttagtagagatggagtttcaccatgttggccaggctggtctcaaactgttgatcagcccacctcggcctcccaaagtgctgggattacaaatgtgagccgtgagccactgtgcccggccaaatttttttttttttttatagacagggaaaacatcattaagatggaagagatcaattactggcctatcttcagcaagagctattttctgcagagtacaggaccagatgaaaagatagctcctggtctaaattccgctaataaaaacctgaacatattagagtaatgacatattgtaaggatctaaagttcctatgattcctttttcaaagctaataaatcaatagattaaagag

SEQ ID NO: 235572 - DNA, 395 bp, Homo sapiens
gaatgaattcaccatgataaccactttcaacccagatactccttaatagaaaataaaacaactgtatttccctgtctttgtaatttatgcaaataaatgtgcagaaccaaggctgaaaatgatgtcatggagcacagtgatcttccatagcttctttatcatttgtcctattaaagggcatgtagctaaatagtaattctaataggaatttcagacatgaatctggaattgtatgttgtcactttctgtacaggtctgatattttttaaatgtgagcatacaaaagagacaattgtccatcattgttctaaacttaggatgctagaagtggcctggaattattactataacttaaataagaaaaatgatctcaatgataaacctgagcagggctc

SEQ ID NO: 235573 - DNA, 685 bp, Homo sapiens
caaagctaataaatcaatagattaaagagcttggtggaatatttttaattccatgactaagaaatttaatgattattacatgattaaaccctccagtgatggtttcatcatttatcctaaaattctttttccaaaaccgtcaagagtttatgaaacaaccacttaaacctataataatttcatgtcacctttaaacaatgagccagagtggatgggcgttaccttctatcacagcagaatgaattcaccatgataaccactttcaacccagatactccttaatagaaaataaaacaactgtatttccctgtctttgtaatttatgcaaataaatgtgcagaaccaaggctgaaaatgatgtcatggagcacagtgatcttccatagcttctttatcatttgcagaagcaataaatcatatttagtagagagaaaaggacccatcaaagtgatttttcctattaaagggcatgtagctaaatagtaattctaataggaatttcagacatgaatctggaattgtatgttgtcactttctgtacaggtctgatattttttaaatgtgagcatacaaaagagacaattgtccatcattgttctaaacttaggatgctagaagtggcctggaattattactataacttaaataagaaaaatgatctcaatgataaacctgagcagggctc

SEQ ID NO: 235574 - DNA, 546 bp, Homo sapiens
ggaagagcaaaaaaggaaaaagagagaaagagattaacagggattatttcttgagaaagagaatctgtggagaaaacggagatgggaaagctggggtgaggccagggccgatttgcgctgtccacagaaggactccaaggggaaggccgaggcccaccctgcaaaggaccccaaggctccgaggcatagttgagtccccggctctcaggagcctgagcccctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacccgtgacattctggactatttctgtgttta

SEQ ID NO: 235575 - DNA, 180 bp, Homo sapiens
ttccttcttgctagcagaagtagcagattgtcctgttgcatctggtgaggtgtgagaaagagagagggagagttgggaatgatgaatgttttgactcctttcttctctatatgatttatcagtagaaaaacagaagcactgatgaagacgtgtgccttcactaaattcagtgggttttca

SEQ ID NO: 235576 - DNA, 582 bp, Homo sapiens
ggcgtgggaggcttctgtgggtcggggcgcagctttgcaaggttcagctccaagactgcttcctccagggagccttccctcccttcccccaggtaagtgctcctccccagttgctcattccaccagggcctgatcacaccctgctggcagtgtcagagcccggctttgtcttccaccacccctcctagaactggtggcagggacagatgaatggatgaatgaatgaatgggaagtgagaattctactactggaccatcaatgcagccctcggaatgagtgagtgagtgagtgagtgagtgagtgagtgatggaaagtggtctggaggcagggagagggacaggccgatcatgcgaggaatcccagcccaagcccccgaggtccccgctcccgccctaaaagatgcacgcgccaagcccttgggccagaaaaaaaaaaaaaaaacgggccgggattggctcaggctgggggaggcgggtctacgacgagacacgattttctattggcttactcgccaggactctgcccaatcgacgcgatcgtcttccccagaagacccccgcctccctcccgccggcggccg

SEQ ID NO: 235577 - DNA, 352 bp, Homo sapiens
agcctaaactatttattatctggccctttacagaaaaagtttgctgaccgtacctagtgctcttgtcagatgaagtcacgcgtaagcaaatggaattcatgctgtgttcacattgttccctcatgtatcaatttgaaacaaatttgcatcttcaaagcaaatgttgtggcaatattgtctctacatggaacttaagactgtagtccacctctggagagcagagtgaaggcaacaaaggagagacaccttcctggaagccctttgaatcccctcaatctctctgtgctgaaagtgagaccaccccttagatagtttccattatatgaatcaataaatttattttcattcaagc

SEQ ID NO: 235578 - DNA, 429 bp, Homo sapiens
ctttcagatgttcctcccaccatcctttgataattttttcacttcaaggaccatctcgtgttttcacctccccgtgtatgggtgctggctgacgatccgatcacatgagccgcgtgaaggctctgaatctccacggtgccatctccagtttctgggcatcgcgttcctctcaagaatgaacggcgatttcaaaaggaccccaacactgggtgatggcgtgcaaagtgttaccgagaaataaacttcaagcagtgaagacagatggatgagatggagctgtgattgaacatgtctcagaggctagacatctaagaaacagtcgcagaggacaaagaacacattgatttttaaataagcaattcacgatggaatgaaaaatggaattaaaaggaattttgggcaaataaatgactgcaggtagtaaattaa

SEQ ID NO: 235579 - DNA, 726 bp, Homo sapiens
ggagtgtcctcccatccgccgcaccaacaactggacagatgaaaagaatcaaaaaggagaggaagaagagggtgcaagcacaatgcccactgccttgccccaggctgggcgaggccagcactcaggtagagctgaggacaaatggagatgagaacagaaggggaggcttccgggcaggcgaggcgcccaaaagccactccacagaggccctgactgcatgcgtcaacccctcctgtgagtacagggagaaaggctgccaggcctccagcacccagggggaactcagaggacacgatggggatatgaagtcaacactacttaaccaactagagatgcagcctccgctaggcttagaagatcaggggttgcttgtgttcttggcatacgtgtctgaggcttggcaaaacctacatccctggttgcttattgatacaggaaaagccagagataagcttgtctccattcctgtaagtgacatgaggaagtttcccagtcaccaggagcaaggcttagcacacggactgacctttccttagttactctgtcctcaaatagcccttggtgcagggataccagagaaaacaacagcattttttgcagcccttatgagaccttcgtccatacttcagagaatctgggactttctagaactcttacgagctaggaaatccctcagtgcaatgagaaggcttcttgttgccctgcctgggagcctcagactcagga

SEQ ID NO: 235580 - DNA, 399 bp, Homo sapiens
ggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaac

SEQ ID NO: 235581 - DNA, 320 bp, Homo sapiens
ccacacactgctgctgaccgtggtccgctccccacgctggtaagcccgtatgagctcaggaaactgcggggtcttcccagtgcgccctcctgctctttgggctgtctgtatttccagctggggaaggggagtgggccccaaagcacctgtccactctcggcctgcacccgcccgccctgcttcccttcaaatgctgtggactaagggtcctccctacccaattctggggcctctgagcatgagcaatcagggccccaccagtgggggcaggggaggggggctgagagcatgggacagaggcagagggcactcccctttcc

SEQ ID NO: 235582 - DNA, 356 bp, Homo sapiens
aggaagagaaaggcatcacaatgcctctgcccttcctccacccatgcagccaaagtcctcatcccccaagagagtctggtgtactggagagaagtccaggtttctcatcccattcctaactggctatttgaccctgggtaggttatttcccaatgagattttaaaatgacaattaatgtaaagcacttagttcaagtgagttttcattaagtggtcactattattgttttattactactgttattattattgtattattaatactgtggaaagagtggtcagcaagatttaacgaaataatgtagccaacgcttctagcatagtatctgacccatagtgggtactcaatgaatacg

SEQ ID NO: 235583 - DNA, 843 bp, Homo sapiens
caaatacggaatctgcagataacgaggcctgactaatttccaatgactgcttttatcccttctagtagaggtaccggagtaaaccgacctctgctagtttttggaatggtgagggtgtgtactttcagtggccgagtgtaacttcctcctgcctgctttttcctagtgtggaagccagctctccaggccacggaagtcctctgagcagcctgttaccttctgcctcagtgccagagtccatgacaattagtaagtactttcgcagccccctccaccagctctgggatgacttctggcccacgtctcatggcggtgcctttgtgcttctaaccctgtgactgtgggttcacgtcaggtgtgtacgtccctggttgtagactggaggtgtggtacgtgcttgtggatatccagaaccgtggttaatgcgtggcgcttgggcgtgtgcgcgctaaagggcgtgcctcaggatggagcagccttgccgtagacttctgtggttccaggttttggggtttgcctcccataatgcagttagctacagaggacctattctagttggatttcctttgtaactctgaaggactcatttttgtaagtgaagaagaatatgtctctccaagatgattaaactttgctaatgatcaggcttcaactgtttccaactttactacctagaaaaagtattagagatatagcaaggaagactaggtttgaatggctttgtataacaaagaataaaccaactgttatgtaaactgacgggtgctcctggtatctcactggtggcttgagccagcatttgtcccatggcctcccctggaggcagagggggcacttgttccc

SEQ ID NO: 235584 - DNA, 593 bp, Homo sapiens
agtgaagaggtgccagaatccgcgaagagggtcgacgaatgcgctgccgcggagggccgtggaagaacttgccgatggagggaccacagagggatctatgggagaacaacggcaactgcaggagagtgggccaaataatcatggcaacaggacttttagaagcacgtcctctgaaagccattttctgcctgtggttggaaagggactgtgagtctttcctcaggaagtcagtagccctacctggtgaggtgatcaagagtttgctagcacaagaaatgaagcaacaatggccatgagggattcaaggattatgcgtctctgcaccctacaatacaccagctggcagttccatcatttgaaagaaaatcttcaaggtaaagacatttacaatgacacaaaaacctttcaaaggcatcatggtcctaaagggctttccccaagggacagcacagtgtgttccaggccctgacaagaggtttaagacctgtgacacagactgaagctctcctggcatactctgaagctctcctggcaccctcccctttatgcttcacaggtgtttctcctaataaatttcttgtatgtctcatccc

SEQ ID NO: 235585 - DNA, 713 bp, Homo sapiens
  misc_feature (649)..(650): n is a, c, g, or t
  misc_feature (674)..(674): n is a, c, g, or t
  misc_feature (706)..(706): n is a, c, g, or t
agtgaagaggtgccagaatccgcgaagagggtcgacgaatgcgctgccgcggagggccgtggaagaacttgccgatggagggaccacagagggatctatgggagaacaacggcaactgcaggagagtgggccaaataatcatggcaacaggacttttagaagcacgtcctctgaaagccattttctgcctgtggttggaaagggactgtgagtctttcctcaggaagtcagtagccctacctggtgaggtgatcaagagtttgctagcacaagaaatgaagcaacaatggccatgagggattcaaggattatgcggtaaggtcttatgaaacacttaagagctacataaggacctagactttaggtttgctccacaggaccacacttccagttctgtttcacttccagattttcccagttttccatgccttttctctggtgatggcagaagaagcactgagctgattcaagggcaggcaggagaggagaaagccaaatcaagagcctgaataagcaatacccagcataatttcattgaccacattcagtctatcagtcttttgggaaatatttatatttttccttctccctgcctttgtcaccaagaataatctcttaggaaaggcagccaaaccacagcacaccttgnntcttttgggagtttgcttatcctnccatttgaaagtatgtgagttgttctatttgngtctgtc

SEQ ID NO: 235586 - DNA, 472 bp, Homo sapiens
ggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatcaaac

SEQ ID NO: 235587 - DNA, 464 bp, Homo sapiens
gaatcataagagatggaatatgggaaatgccagcaatatctaaaagagaaaccaggacaaagaaaatccagagtgttttgcaaagaaggcaagggtaagagcatgtagagttggaattcgtgggatcagcagtttgcaattggctgcccttacaaattagggaacattgaatatatctggaccagaggactaagaaaagttagcaaagtggtacatggtagagatagttattcagtacatcaagtaatttgtattttcccagattgatgaaagtgtcttcataaccacaagaatgaaaaacatgtatgaaactatggtttttatgtgactaaaagttgacagaatatcaaatgtatctaaattgaattatctttgatcatgcctgggcattcagctgagctggtgatatttggatgagtaataaaataatgacctgattaataaattatcatatatttttccat

SEQ ID NO: 235588 - DNA, 596 bp, Homo sapiens
cggccgctccaacatcagctaattaatccacgccctgtgccctgtgaggtagcttaagtatgagtaagattaaagttgatctcttttgaaagacttttcacacaatgtgctctgttcagggcaggtgacaggctgtgttgtaagcatgttggtttccgatgaactcatactggctgcacagaatcatagttggtcttgcaccctgaaatattacacataggaaaacacgcagcattttcaaatggtattcctaggagagacccagagagtctggttgttcgaagtcgttttggaaggcagctgttgtgtgttgcacgctgtgccccttcttccctgagcggaggtggagctgtgtggctgtgtgagtggcacatgagtgctctccccttgagctttgggtacagcctgatgctggcagttccctggcaggtctttccattacattcggagcatttgccagtaagctctgaggaagaacttgagtggcccatggtccctgcttgtttggaaggcctggagggtgggtatatgtgttgaccagtctctgaaggaggcatatatggggaagtaacatattagagttgactaaaataaag

SEQ ID NO: 235589 - DNA, 650 bp, Homo sapiens
ggtcactggctaataggcataagaattaaagaccgaattccagtaaactgtgtttcacgggtgagaagggaagggagaaggaaaagaagttaatagaaatgaggttgggaggagacatgtgctgagaccagtgagtaccagagtcttggagactcccggaagctcagagagtgtctgtcccaagctctatcggagatcccatagtctggttgttccccctgtggatggacatcaagactgctgcccatttttcactgtttcgagcaatgcagaaacaagcattgtatgagcatcctggttctttgtgcacaaacatatgaatatatttcttacccgtgacaactaaaagtggaactgctgggtcttagtggtaggcacattaaaaattttaatagctacttccaaattgccctcccacaaggctgtcccggtttatgcttttacccccacctgtctttaaacaagtttatggggactgtaaagtatttacacacacattcaaacactcaggctggtttctccatatggcttcagagagagcaaagtatatcccctgaaacagaagtgcatttagtaaaagcctcagagaacctgggttaggctgctagtttaactacactcaagggtgtaaatgaggaggtgggtatctg

SEQ ID NO: 235590 - DNA, 436 bp, Homo sapiens
gaaatcagtattttcttttgcaaccactttaaaggatatttagaatgtatgttgtaacatgcctaacttcatcctgtgtcatccctaagtatcgttgtattattagatctcctcagtaggaaacataaaactgaatgttaaaaataattttttacttaagatcacaaaatttactaattttaacctttttgcttgcctctggatggtccatcttaccaagctaaacaattatttatttttagcttggatttttgtattaatttagtaaagtttttactgaaaatatatatttaaatagtctatattaatagcagactaatagagattttcgagtgagtggtttactcttccaagttctgtagggcaaaatgcatagagttcatattactaataatgaatttgttgaatgaatagttagatgtattaggacagtttt

SEQ ID NO: 235591 - DNA, 363 bp, Homo sapiens
aaggacaaggtcagacagacagagacaaggaggtgggttgacacatagacacagataaagaaatgaagacaccatgcctgtaatcccagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaac

SEQ ID NO: 235592 - DNA, 256 bp, Homo sapiens
gagacagagtcaacctctgtcacccaggctggagtgcagtggggcacgatctcagctcactgcaacctccaccgcccgggttcatgccattctcctgcctcaccctcctgagtagctgggactacatatgccatggaatacagaattttgtttaatttgactcattatattttaccctttttattcagaaaaagagagagctcccctcccaaaataaaataactgccatactatctttcattgcccttcaaaactc

SEQ ID NO: 235593 - DNA, 354 bp, Homo sapiens
atttattgtcacactgcaaatatggcaagtgtgtgatacaaaactgaactcgtaccagttctagggcacactcatgaaatcagctgtttgagtaagactctaagatcagttctcatcaactcacaaagctttcatatttactggcaaagagttggcaatacacacaaatgctgtttttaaaagtagctagaggctatggttaaatataaatgaaacagtgtaataaagtggtcagagaaagggatgggtgatctgaatgccagcgggtggaagctgagggaacccttctgcaatggagacccttaccccagggctcctccacctgaaagaattgtcagggtttcagatcagcta

SEQ ID NO: 235594 - DNA, 402 bp, Homo sapiens
tcccggccattgagcaagctcctttcccttccacatgtccttttctccccagagccagcccctttccagttaaggaagagaacagaagaccccatggactctaccctcaggcaggagacacccaggggcccctgtgcgctaacaaagagaggcacattgttctccgggtggctggtgtctcaaacacttggagcgcaggggcacagaactccaggttctaggaaccagagcggaagaaaacaggtggtggaaatggcctttctcagaactgcagtgacacaccagccagagctgaaagccacatgctggcccactgggagggatccagacccccacccatcccaggaggcccctgctcaggctgtttggggtgtggccgaaggcttactcagcctctgcaga

SEQ ID NO: 235595 - DNA, 453 bp, Homo sapiens
gttgaacttttgtgaaattgtgttcaacaggagaacattagggcgtggctatgagtgccaggtctgctcctagcaacaccaaagcctagctggtagtaccacatgagctcccagaagctagggtgctctttctcaaacaaaaaaatcagatgtgccagtgaaacgttgttggtctgcaatttgttttcataattaacactggagttctgtgaatatactgtgttactaagcaactctgcttttgcacgtgctgtttggtctgcctagattgtctatccagttaatgatttttcttctttaccattatactgtctatatctgttagctaccctactgttttctacatccactggattattattagctccataaaccaagtgttttaatcctttctctcccaacacctagcataacacatatagtattcaataaagtggctgttgaattgcactg

SEQ ID NO: 235596 - DNA, 393 bp, Homo sapiens
ttttttcatgtaatatgtcctgaagtttgttctgtactagcatgtagaggtatttatagctgcaaagtaccccactggtatatgtatcataatttgactggtcctctgttgatagacactcaagttctttttaatttctttttgtttttacaaatagtcctgaaatgaatagcctgtgtatacattttttatcttcaccaatgttatctgtgggatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattatt

SEQ ID NO: 235597 - DNA, 251 bp, Homo sapiens
attcctagaaatataacctttgacccagcaattccatttctaggaatccatcccacagataacatggtgaagatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattatt

SEQ ID NO: 235598 - DNA, 428 bp, Homo sapiens
agctgtatctcttgcccgcctctgtaactgacagctctcttcttaacgcttactatgtaagaaggtcttaaagtttatgtagagcctccagcaaatcagggaggagagaggggcatctgttgaactataaggtggtgaacacatggccaggcgcggtggctcacacctataatcccagcactttgggaggctgaggcagggagattacttgaggccaggagtttgagaccagcctggccgacacggccaaactccgcctctactaaaaatacaaaaattagctgggcctggtggcttgcacctgcaattccagctactcaggaggctgaggcacgagaatcgcctgaacccaggaggcggaggttgtggtgagccaagatcacgccactgcactccagcctgggcgacagagctagactctgtcttaa

SEQ ID NO: 235599 - DNA, 640 bp, Homo sapiens
agttttgctctgtggcacgatctcagctcgttataacttccattgccagggctcaagagatcttccctcttcatcccaagtagctgggactacaagtgtgcatcactgcaattggctaaattttttgtatttttggtagacacagggttttaccgtgttgcccagactggtctcgaactcctgaactcaagggatcctcccacctccacctcccaaagtgttgggattacaggcatgagccaccacacccagccctgaccctatcttctttttgttttttttgtcggagtttctattctctgtttcattttttgagatctatggatgtgaataagcttcctgccgtaaagaagacatcattatttatttctgtagcttttgtgtactaccatggagatgacatggagcatcagttgaggggtcctgtagagtgacagctagcagatgggtagaataactattattagtgctgcttctcctctctgtcagttctcatagcagacattgctaattgatcacagtactttttctcagcaagcctgactgtggcctatgaatcttcctctcaaggagtgccagccactgataatcgatagcacttgactgaaatgtatttcccctcccttctctaattgttgtg

SEQ ID NO: 235600 - DNA, 434 bp, Homo sapiens
tagtgtaatgtcgattatggtccctggtataggtgcaataactgatcttattttacataacattaaagaggaacagcttttcttttatactgtaaaagaaaaattagaccagaccaattaaacggggaaggaaaaatttattcaagactattgcaataggaaagggagattgaactcaacaaaaggcaagaggattttaaatgctaaagagagctaatagaaaagtaagatagaatgggggaggtgtgtctgtatgattaggctatctgtgtttgctaattggcacttatctaagctaggttcttactctcccacagagtctgggagaccaaggctctgtctttctggatgattacatttcaaagggatggctcacaggttcttgaggaagatatccctagtttgtaaaagatttacatctcaaagagccagag

SEQ ID NO: 235601 - DNA, 945 bp, Homo sapiens
accaatcagtgatctccacattgcagcccattccaacactcttaaaaacccctacccccaaatgcctcagggagacagatttgaggtttcttctcatctcatttagtgaccctatgattaaacccctttccttgctacaacctggtgtctcagcttattatttgctgtgtgcatggggcaatgaacctatttcagttacacttgtgcactgttggcaagaaggtaaaatggtacagccactatggaaaatggtatgaaagtttctccaaaaattaaaaatagaattctcatgtaacccagcagtcccacttctgggcatatatatccaaaggaagtcaaattagtatctcaaagagacctttgtacacccgtgttcgtaatagcattattcacagtagccagaagttgggaacaatccaatgtccattgacagatgcacagataaacaaaatacggtatatacataacaatggaaaattattcagccttgaaaaaaactgaaagtctgacatgtactataacatgagtgaaccttgaggacagtatgataagtgaaatgagtcagaagcaaaaagacaaatattgtatgattccatttacataaggtacccagagtagtcaaattcatagagatacaaggtgtctgctggaatggcggttgccaggggatgggggaagggaaaatgggaagctgttgaaatgagtccagagtttcagtttggaaatgatgacagagctctggagattggttgcaccacaatatgaacatagttaacactatggcattgtacatttagaaatgattaagatggaaaattttacgttagatgtattttaccacaactaaaaatttaaaagaaagaaaaaaacagctatgaagatttctaagtcttgggccttattttgccatgaggaaaaataaatacatcccataaaaaaaatcct

SEQ ID NO: 235602 - DNA, 687 bp, Homo sapiens
acaaactggcaagacgacataagcattgtcttatggtccttcagttaaaaaaaaaattgtgtaaaaacaaaaatggacaaagacccattaatttcatggtggttgtagtgggttgaaaggtggccccctaaaatgtatgtccacccctggaaactggggatgtgaccttttttggggaaagggtcttttctaatgtgattaagttaaggattgcaaaatgagagcatcctggatttgggtggaccctaaatcgaatgttatgtgtactgagaagagaagggagaagacagaggagaatgccagatgaagacagaaacagagattgaagttatgtggccataattcaaggattgctggcaacaccagaagccaagagaaagatgaggaagaattctcccctagacctttcagaaggagcgtggcccagccaacaccctgacttcagacttctggcctccagaactgtgagaataaattcttactgttgtaatccacctgatatgtggtaatgtgtacatttcagtgggttttagtatatatacagaattgtgcatccatcaccacaattttagaacattttcatcacccacaaaataaatcttaaacccagtagcagtcactccccctttcaccctccccataaacccctggtaaccattaatctactttgttttatggattttgcta

SEQ ID NO: 235603 - DNA, 507 bp, Homo sapiens
gggtttggcagttcactcaccaaggtgatctgatggagtgcacttcgcacgattccaagtacttgcctaatgttcatcctttcctctagacgggagaagggagaagacagaggagaatgccagatgaagacagaaacagagattgaagttatgtggccataattcaaggattgctggcaacaccagaagccaagagaaagatgaggaagaattctcccctagacctttcagaaggagcgtggcccagccaacaccctgacttcagacttctggcctccagaactgtgagaataaattcttactgttgtaatccacctgatatgtggtaatgtgtacatttcagtgggttttagtatatatacagaattgtgcatccatcaccacaattttagaacattttcatcacccacaaaataaatcttaaacccagtagcagtcactccccctttcaccctccccataaacccctggtaaccattaatctactttgttttatggattttgcta

SEQ ID NO: 235604 - DNA, 533 bp, Homo sapiens
tgtcatcttctgcctgaagcagactgcttctgtgtttaagaaggtggagaccctttttctatcagttttcctttgagcagtaacttactatagtggataaccttgacttacccggtcctactctctgctgtaaaatgtacataagtagagtccctcaaccctcttcatgagatttcggatggttccaatggtcagctcttttatgctgattgagaagtccaacttgcatagcagtgcagcttcatacctggcattatacacacgcttaatcccacttttgctgaagaaagagacagcattggcaggcagaacaagtcctgtagctttgggacaaaagtggctgagtcttgagtcttgtccccaaaggtcttaccttccttatccactccaaagcagaagttggcatgcagttgaggcaactaaccaaatatcgagagataggagtttttcaggtgtccaccaatgggaaactggttgaaatgaatttgagtgaattatggtagagtcacatagtgaagtgctatgcagccata

SEQ ID NO: 235605 - DNA, 857 bp, Homo sapiens
tgtacttgtgattgtcaagatttattaaaacatatttttcccattcatttgctacttagacatctccagcaaagactcctggaaggtggtatctcagctgctatgtcctttgcttcccatggcatgaagcagaggactgtgccagttgatgatgcccaataaatacccactgattggatcaatgagtgagagtgggaatgagtcagactttggagtggttacatcatcattttgaagagactcagttcagttttgggtgccacattgtaaaaagcaaatccatgttttgttgctggatgtttcctggttcagggtttaggccaagaaaggcagaggaggagcagtctattcccatggtggcagcttgaagcagttactcctgtgggtagatcagtccaggcacttctttcctgggctttgataaagttgagtttaatgttgatgcaattttacatatcttatttacctttactcttctactaaaactgaatagcccatatagatcacttttgttaaaaaaaaaaaacaggctttcataaaatataatttgcacaccagaaaatctaacacttaaaattcagtgatcttagtgttatgttactttttaaaaattagcatagcatacggaacctacaattggacactctaacccattttaattgtacagttcaatggcattaattacattcacaatttccctccttttattttagctcatttgaattttgagaacttagtttagagaggtacatagaaaatataaacccaaggagagagggatcaattctagttgggttctaactatagaaatatctaaaaatatttgatgaatttttgtagaatctcttttctttttc

SEQ ID NO: 235606 - DNA, 259 bp, Homo sapiens
tcagcttaagctgtatttccatagtcatttaaagcaacataacatgtttttaatatatgtgctttttccctgaagtcagaggagttcaggtaaatcaagtgagccccatagtgtcatctctaattagaacctgtagggttttatttatttatttatttattttgatagagtctcactctgtcaccagcctgaagtgcagtagtgagccgagattgtgccagtgcactctagcctaggcgacacaatgagactccgtctc

SEQ ID NO: 235607 - DNA, 280 bp, Homo sapiens
cctccctccctccctccctctttcctctctccttctccctctgtccctctccctctctctccttccctccctgttttcccctttgcacctcttctttctttgacagggtcttgctttctctgttacccaggcttagtgcagtggtgcgattatacttcactgcaagctccacctttcaggctgaggcaggagaatcgcttgagccagagaggcaaaggttgcaataagccaagatagcgccattgcattccagcttgggcaacaggagcgaaactctgta

SEQ ID NO: 235608 - DNA, 197 bp, Homo sapiens
taaaaaccagtgtaacattttattctaagtcagaagtaattactgagctgtggttttgtgttctgtatgtataatctcatttattgacagttctaacctagtaatgaaagtgcaacaggagaattataaccagaaacatctaactgttatattatacatacatgtactgtttaactgtaattgtgaaaatgcatttt

SEQ ID NO: 235609 - DNA, 691 bp, Homo sapiens
cttagtatcacagaattttgagtcagggttcaaattttcaattatctccaaatttatgacatagtttaacatgtttttctaacctatctctgtagtttctgtaagtcggaagttggatctaaactctggatcaagattctgttttgtgtttttgttcttgttttttattgatgagattatgtcatagctatattcgttcttcctttgaggaggcatataatttctcactttcttttttgtgatgcagttcacgcttaatgtctagatccatttgctcattattagttcagatgttcaaattcttgatttattacctggaatacttctaccaagagaatttatggaattaaataattttgtatgttttaattcactttagttcttattaatgcctgaattgttccaacttagaccagtgggagcctattcaagttttattctgagtttttctatagatctagtagtctttaacagctttattattatcagatatgataagatggtccagacttatcttgtatatttcatgactcaggcctgaatcagctatttcttcaatgacccttaattcctttcagaaggaaatagtgtttagagatgcacaatctgggcactagggttgtccattgctactgggttggttggcttccttccttcctcgcttcctcccttccttcctttcttgagacca

SEQ ID NO: 235610 - DNA, 401 bp, Homo sapiens
gactgccgtgagctgagatcacgccactgcactccaccctgggcaagacagagcgagactccgtctcaaaaaaaaaaaaaaaaaaggcattctatattacaaaataactacagaagcttttgaatattctcatcacaaagaaataaatgcatgagatgatggatatgctaactgccctgatctgattattatacaacatatatgtatcaaaacatcaagttgcaccccacaaatatatacaatgacatgtcagtaaaaaaaaaataataaagaaatgtgccagatgggcctgtactgacataggacaatgtctgagataaactggcaactgaaaaacagaggttgcaaaacaacacctaaaataaaacccagttcctgtggggaaagatagcagacatatg

SEQ ID NO: 235611 - DNA, 547 bp, Homo sapiens
gaaatgctcagagcgtcatggagaagccagcacaaccatgagccccagagggcctgctgaaggccagcccaggggataggaccagtcagacaaggtcctgctgttgaggagccccagtctagatcaaaaggaggtaaacagcctctgggacagtgaatggaaatgggagattgaatcagagccccagataaccagaggccaataccatcccatggtccacaagagtccctgggctgaatgtcaagggtgaatgaacacagggcaggcatgttcctggggatgctcctcaaaggaaacagaactgggagagtttgagaggagaggaggggcacctctaacccacattttcaggtctcctgggtccactgtgctgtgccctttgtcaccagggcagcaaagaccctggaggtctgctaacagccaggaatccactctgaggagggcaactccccaagcctgcaggctgggtagagctaattaaccacacaggaaccagaggcatgttgatttaaatctgtggaaagccatagctcctgtggtttctaca

SEQ ID NO: 235612 - DNA, 542 bp, Homo sapiens
  misc_feature (394)..(394): n is a, c, g, or t
cagacatatgtctttaagatagcctttttgatggcatttccatgcaaattttaaatcaaggttgataccattatcagacaataaacacttgtggttttaatcttcatgattttgactctttggaaaagatcttgatgatccatgaaatttttaaaaaagtattatcaaacctcatctctaaaaatgttgtggtggccactccacatgtctctgtcctttctttttctacattcatttcccaatcaaatgacatgacttcaaatgcaaaaaatgtttatcatttcctgaaattattacttagctagttaattctcatatctttatttaacctttcttatgtttctgcaatgttttctcaattatttttaatttcttctgaagccggacttcatantattgatactctgcatcatcattcctgattcaaagtgaagtactctaagcctcccacaaagcttctgtccattcagttcattcatgcgttcattaatttttctacttcatttatttattcatgcaataaatatttattgagtacgtat

SEQ ID NO: 235613 - DNA, 984 bp, Homo sapiens
gccaagcctagcccaagaccaggtgaaaggagaggggaggaggagccacctgcaagagatggaaagagcaggcggcagagggggctggcagggaggggctgttaagagtggggttggaggtgggagagaagctaggacaagggagatggagaaaggacctatacctggctcacggaaggccttcaggtcactacacgttgaacatccccagtgtttgagcccccaaagctagggtgcaagagcactgccatcgaatgccagtgggtgaggccaagtgagggtatttgcagctctagacataaccaagaagcgtaaaggtgagttgtttggtggtacgactgcctgtgccttcttccgatggcactggggtggctgaaggaacagacatctttgggtttcgtcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattca

SEQ ID NO: 235614 - DNA, 1065 bp, Homo sapiens
gccaagcctagcccaagaccaggtgaaaggagaggggaggaggagccacctgcaagagatggaaagagcaggcggcagagggggctggcagggaggggctgttaagagtggggttggaggtgggagagaagctaggacaagggagatggagaaaggacctatacctggctcacggaaggccttcaggtcactacacgttgaacatccccagtgtttgagcccccaaagctagggtgcaagagcactgccatcgaatgccagtgggtgaggccaagtgagggtatttgcagctctagacataaccaagaagcgtaaaggtgagttgtttggtggtacgactgcctgtgccttcttccgatggcactggggtggctgaaggaacagacatctttgggtttcgtcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattcagtcaacggaacttatttgttttggaacacactgtttttcaactctgctgagtgttttgaaaaaatgaactattgtttttcc

SEQ ID NO: 235615 - DNA, 447 bp, Homo sapiens
tctaggtagagtcaatgcatagtctggcaggtgggtcacaggctctgaatcctgcaactgagtccccaccctgcctctttctagctttgggatcacagctatcatcatttctccatgtttctttttctccatctgtaaggtgtaatgaaagttttaggtgataattgtggacttagcatatcatatcaatttctccttagatggatggcaaaaatgtccatgaccatattctccccatagaaggttcgtttgcctacatggaaaatatgggaaaatatggggtttagtgtagtccccttcatcaacaatctcagctagatcttctggagaacttgctgcagcttctccatcagcaattgctgtttctccttgcacgtttatgttacggagacggctcctttccttaatctcttccaacttttgtttgcagttgtctcacccctctca

SEQ ID NO: 235616 - DNA, 565 bp, Homo sapiens
cctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttcgccgccaagaactccaccactgactgtgtctcagacgacatgaagaaatgaagaggggatgtttacttccttaaagtatgataattgctttggggtgaagttagagaaaggaatccttgttgccaaaggattcatgcatgaaagaacacactgtctggtgcttgctttaaaactacccacgaggagtggggtgacacagaaatgaccaaggctgactttaagttggagccgagtcataggtagttgggggcttatgttatgatcagctctacttttgtgtttgaaactttccacgataaaagtgtttacaaataaaaatgaatgccaagcaa

SEQ ID NO: 235617 - DNA, 863 bp, Homo sapiens
gatgtttctctttccccagtcctcacatccaatttttcatagccaagtttttttttatcatttgaccccacctaacattcccactgaatactcctgccagactggaccaatagctcttcactggcctcctctgaactttttcaggtgatattccttctgcccagaacagcttacagtaataataggttaattttttttatgagtgtgaagataaagtcacagtgattctcctttctctgggaattgctcccaacaaatggctgtgcttactgtcaccatgtctgtagttggtgtgactctgttctctgtttacttcagaagaggatatctgactcaacaagacaagtgaaatttgctagggtattggaaattttgaacccaaagacagattggaaataattggaaatcactttaggtcagcactggataagaagtaacatgtgtctcaggaggcatccttcagattgagctgggtgtcagcattcaattccacaaggctacctgtttaagaagaatggaaatatttcatagaaactgtttgcttggatgatgaagtaatggaggtggggtatgtgagaaacagtatgagagaagtatacattacttacgttgaggagcagtgtaataatattgtcatttatttagtctctcataactggtaaaataccttcatatccctgacctcgaagtggcagcactcatccagctacctcagagttgacaacatcactcatcagaccttacacataaaggatttcaaattgttttgttcactcactgctacatcccaagtgcatagagctatgcctggcacatggcaggcatccaataaatatttgttggctgactttaaagatgaagag

SEQ ID NO: 235618 - DNA, 726 bp, Homo sapiens
gatgtttctctttccccagtcctcacatccaatttttcatagccaagtttttttttatcatttgaccccacctaacattcccactgaatactcctgccagactggaccaatagctcttcactggcctcctctgaactttttcaggtgatattccttctgcccagaacagcttacagtaataataggttaattttttttatgagtgtgaagataaagtcacagtgattctcctttctctgggaattgctcccaacaaatggctgtgcttactgtcaccatgtctgtagttggtgtgactctgttctctgtttacttcagaagaggatatctgactcaacaagacaagtgaaatttgctagggtattggaaattttgaacccaaagacagattggaaataattggaaatcactttaggtcagcactggataagaagtaacatgtgtctcaggaggcatccttcagattgagctgggtgtcagcattcaattccacaaggctacctgtttaagaagaatggaaatatttcataggtaatatgttctaatttctaatatgtcatatgtaatatgttcatttcttaggtagtttcttcctctaaatagctcttaaaatattttccttgataatgttatttatgatatttagcatttgttgagtgcactgtaccatgtgttgtgttaagcactaaatattcatgatgataattaaacctcacaataacacca

SEQ ID NO: 235619 - DNA, 453 bp, Homo sapiens
tatgtaccaggcgcccttctaggctcttggcctgcagtaactccagatctggcagctgcaccagggggtgggcattctgattaaccctgactttgcaggtgaagaaacaggctcaaaatagtgtagcgaagctttattataaagtcacacagctctgaaatgatggaaattgggactcaaacatgattgtctcacagcccagtgtcttaatatctgcctcaaagaacactgcccacagcatgcaggcttctttatgttgcaagaacagaaaaccccactggcttaagccacaatgcgcagctgattcaacacccagcaccccacttccaggctaattctaccaagacctggcttgaatgacatcattttctttctcagaaactcttcatgagtcttgctttattgtttagagcaggaaagaaaataaaccacaaaccctcagtagtcatttgt

SEQ ID NO: 235620 - DNA, 278 bp, Homo sapiens
caatgtctggacacatacaacatactaagattggatcaagaagaaatattaatagaaaacctgaacagaccaataacaagagatatcccctttacagatgatatgatcctataactagaaatacctaaagagtccaccaaaaaactcttagatgtaataaattcagtaatgttgcaggatataaaatcaacatacaaaaatcagtagcattcgtgttcaccaaaaataagctagctaagaaagaaatcaataaggcaatccaatttataatagctaca

SEQ ID NO: 235621 - DNA, 427 bp, Homo sapiens
actgagaaactgagtgatagtgatctgggactcctggtagaagccagtgcaaactctctggataaatagaccgtaaacccaggcctcctaggattctcaagattagatctgagcttacaatccaaaatttaaaaatacacaaataagccaccataagggagaaccagcagactcagcagacagcacaattaatatgaataggacttaagatattggaatttttaggtaaagaatatatgtagtgctatctatgagtgtttgaaacttttggagaaataagagatgaaatggaaaatgtgagcaaagaatatgaaactactaaaatgatcagacaggttttaaaaagaaccaaatagaaattttagaaattaaagtttcaatctttaaaattaaaagtttagtggaatgattttaattggcagattag

SEQ ID NO: 235622 - DNA, 450 bp, Homo sapiens
ttagtccattttcatgctgctataaatatactacctgagactgggtaatttataaagaaaagagatttaattgtctcagttctgcatgactggggaagcctcagggaacttacaatcgtagccgaagacaaagaggaagcaagatttcttcaaaaggtggcaggagagagagagtgtatggggacactgccactattaaaaccattaaatctcatgggaactccctcactaacacattgaggaacagccaccatgatccaatcacttcccaccagagggatccctcaacacgtggagattacaattgtagatgagatttgtgtgggaacacaggaccaaaccatattattctatcccagacacctctcaaatatcatgtcactctcacatttcaaaacactattatgcctcctcaggagtcccccaaagtcttaactcattcaagcatta

SEQ ID NO: 235623 - DNA, 502 bp, Homo sapiens
caaggtccacacagtgacaaaaatctctgagccagtctgaaaggcctagatgagatatttgaatattccctgcagtaaaatcaccttttaaccaaggtttaggccattatttggatgcttcataaaatgatttaaatcagagtttattcattgcctcctggtaagttcacaagtgactgagaaatcctttcatggtaaaattatgagagaaatgacacatctttgtggctgttttaagctcataagtggttataaggttgtagaaaagaaaaaaagaacatctcgcaaaaaaaaaaaaaaaagtggtctgacaactcaagttgaagttgttcacattaatgcacaagtttaagaggaaaaaaacctcagaatcagatgttcagattattcagtgtttacatgatcagagccctgactcattcccattcttttgggggatattttaaaggaaaaaaaaatggcaagagaaataatctaaaatacattcacacccataaaagaa

SEQ ID NO: 235624 - DNA, 424 bp, Homo sapiens
ccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagg

SEQ ID NO: 235625 - DNA, 2214 bp, Homo sapiens
  misc_feature (1047)..(1047): n is a, c, g, or t
  misc_feature (1253)..(1253): n is a, c, g, or t
  misc_feature (1834)..(1834): n is a, c, g, or t
  misc_feature (1999)..(1999): n is a, c, g, or t
  misc_feature (2063)..(2063): n is a, c, g, or t
atacaagaaaaaaatcacatctttatgccaataccattctttcacaatactagaagaacagattcagagtagaattacataactggttggttacattttgcatccagtgagtaacaccatcatcttcttagtttctatatcaatttatttatttatttatttatttatttttgagaccaagtcttgctgtgttgcccaggctggagtgcagtagcacgaactcggcctcttcagtggccagtaccacaggcgtgcaccaccatgcctggctaatgttttttgtatttttggtagagacgggatttcactatgttgcccaggctggtctcgaactcctggcctcaagtgatgcgtccgccgtatctcaaaataataagagctatttatgacaaacccacagccaatatcatactgaatggacaaaaactagaagcattccctttgaaaactggcgcaagacagggatgccctctctcaccactcctattcaacacagtgttggaagttctggccagggcaatcaggcaggagaaagaaagaaagggtattcaattaggaaaagaggaagtcaaattatccctgtttgcagatgacatgattgtacatgtagaaaactccatcgtctcagcccaaaatctccttaagctgataagcaacttcagcaaagtctcaggatacaaaatcaatgtgcagaaatcacaagcattcctatacatcaataacagacaaagagagagccaaatcatgagtgaactcccattcacaattgctacaaagagaataaaatacctaggaatccaacttacaagggatgtgaaggacctcttcaaggagaactacaaaccactgctcaaccaagtaaaagaggaccaaacaaatggaagaacattccatgctcatggatgggaagaatcaatattgtgaaaatggccatactgcccaaggtaatttatagattcaatgccatccccatcaagctaccaatgactttcttcacagaattggaaaaaactactttaaagttcatatggaaccaaaaaagagccngcattgccaagacaaccctaagccaaaagaataaagctgaaggcatcaccctatccaacttcaaactatactacaaggctacagtaaccaaaacagcatgctactggtaccaaaacagagatacagaccaatggaacagaacagagccctcagaaataataccacacatctacaaccatctgatctttgacaaacctgacaaaaanaagaaatggggaaaggatgccctatttaataaatggtgctgggaaaactggctagccatatgtagaaagctgaaactggatcccttccttacaccttatacaaaagttaattcaagatggattaaagacttaaatgttagacctaaaaccagaaaaaccctagaagaaaacctaggcaataccattcaggacataggcatgggcaaggacttcatgactaaaacaccaaaagcaatggcaacaaaactcaaaattgacaaatgggatctaattaaagagcttctgcacagcaaaagaaactaccatcagagtgaataggcaacctacagaatgggagaaaatttttaccatctacccatctgacaaagggctaatatccagaatctacaaagaacttaaacaaatttccaagaaaaaatcaaacaatcccatcaaaaagtgggcaaaggatatgaacagacacttctcaaaagaagacattcatgcagccaacagacacatgaaaaaacacatgcacacgtacattgactgcagcactatttacgatagcaaagacttggaaccaacccaaatcaatgatngactggattaagaaaatgtggcacatatacaccatggaatactatgcagccaaaaaaaggatgagttcatgtcttttgtagggacatggatgaagctggaaaccatcattctgagaaaactatcacaaggacagaaaaccaaacactgcatgttctcactcatangtgggaactgaacaatgagaacaccaggacacagggtggggaacatcacacactggggcctgtngtggggtggggggagaggggagggatagcattaggagatatacctaatgtaaatgacgagttaacgggtgcagcacaccaacatggcacatgtatacatacgtaacaaacctgcatgttgtgcacatgtaccctagaacttaaagtataat

SEQ ID NO: 235626 - DNA, 447 bp, Homo sapiens
tggaagagaggagaggaggtttcagaagggcctttggatggctctcctccatatcgccttgcccaggacctctatgtgggccaccttggggtgcgtgtggacatgccttcccttccacggttggaccagtcctgacaagcgctgcggggccaggcgtcacaggactggagtcacccgactgtcgcagcactgccacctgctggctgcaggagaaaatgcagaattcaacagagagtccacacttgttaaagaccagcttcagaaacacacaggcagagacccgcgcacacacatacctacatatacaccacagaacagagcccctccgaccctggctagaccacagcagcatctgtgattttgcctgtgtaacaactacagatgggttcgatttctcccttcaggggacagatgagattggagtgggggagaagaattaaaaaaaaa

SEQ ID NO: 235627 - DNA, 287 bp, Homo sapiens
tcatcactattttcaatccagatatactttacaaaaatgagaagggcttatttgcatttttatttacatattgaaagggaagcatctgatctcatcaatgattgccatattttttgaaaaagtaatcctatttcaatctttccttgtgtgaaatggccataataccagagtgcacttccctacctcacaggttaggattcaaagtgtgtattcccccattgtgtaaattgagtgattgtgttactacttgaaacagatgaagtaataaagatgaagtatgagatgta

SEQ ID NO: 235628 - DNA, 292 bp, Homo sapiens
cagaagagcacaaggctaggacattgaagataaagttaaatgatagtttctaccatttgaaagctttattcagaatctagatacacgagaaaataaataaagaggctcatgtttattaacatggtgagggagcaagaagccggggtatttgcataattagaaggagtggaatcacttgagcatcaagtacatatttttgttgtattgggacaacctcaaggtggaatttattattttattttattttattttgtttctttttcccgagacagagtcttactccgttgcccag

SEQ ID NO: 235629 - DNA, 424 bp, Homo sapiens
  misc_feature (35)..(35): n is a, c, g, or t
ttggggacggagtctcgctctgtcacccaggctgnagtgcagtggcacaatgtcggctccctgcagcctccaccttccaggttcaagcgattctcctgcctcagcctcccgagtagctgagaatggctgtggaataagcaagggaagcaatggtggaggctacgtctaggacctggatggaggcaggacagcagggatagagtggagaggtactgcgagttaaaatccacaggacttcaagatggaacaggagtgagaagtaggggagggggttatctagaaggactcccagggttccagcctacaggaatgatgatggaaccctctcctgaaatgcggagggccaggaggatccagcttaggatagggatgaaaacctgagttctgagtcagggccccgtcccacccctcccatcagccaggc

SEQ ID NO: 235630 - DNA, 719 bp, Homo sapiens
tctgtttactgtctgcagaaaccctgtccctccttcaagactctactcctgtgggaaaccctccccgacctagcattgtcatctgtatcagagtataactcttaccagttgctactggatatttatgactcacgctcttcctagagacttctagacttgggagggaaccttacagtcctctactccagctccctgattttacagatcggggacccaccattcagggctgataacaaactcaggtctcttcaccctcagtctgatactattttcacttcatcttcaacttttcatttatgcacgtctcatatctctgcctagagtataagcttttttaaagattcttaagggcagggatcatgtcttattcttactttgatgtccctagcatgtatcataaagcttgacccaaagatagaagttcaacaaatatttgctgatttgctgttctgcatactagggcgcccacagccacaggaatgtctccctccttccccatcatcacagttactatgccaccaatgccccctcccaagacctggcattgcttaccaccagccaccactcctactgtcatgactgccctggccagggttatgcctggcactgcttacagccagtgtgtggagcacgcagcagaacccagcttccaaaggaagggttgggggcagagttttttcatgttgttgttacaccacgactacagttagtattggagt

SEQ ID NO: 235631 - DNA, 505 bp, Homo sapiens
atatttacaagctacatatctgacaaaggactcatatctggagtatgtctcaaacctcaatgcaaaaaacattcaattagaaaatgggcagaagacatgagaaacattttaccaaagaggctatatgaatagcagatgagtacatgagaatatacttgtcattgttatctgttaaagaaagcaactaattctgcaactatacacctattaaaacaatataatagtggcagtaccaagtgctgtcaaggatgctgaaaaactagctctgtacattgctaatgggagtgtaaaatcgtacacctactctggaaacatttggcccatttggtaaactaaacattaccttaacatattttaactccatattacatatccatatgaataacatattaaatattcactttgagctttttttcagaggtatgaaatcttatgttcatgcaaatatctatatatgactattcatactagctttatttgtaataaactgaaactggaaacacta

SEQ ID NO: 235632 - DNA, 327 bp, Homo sapiens
gagagtttaaggtaggaaaacgtttgggaacagtaaaaaagcagccttggccaggcgtggtggctcacacctgtaatctcagcattttgggaggccgagatgggtggatcatgaggtcaggagtacgagaccagcctggccaacatggtgaaaccctgtctgtactaaaaataaaaaattagcccagcgtggtggcacacacctataatcccagctactcaggagactgaggcaggagaatcactttaatccaggaggcgcaggttgtggtgagccgagatcacaccattgcactccagcatgggtgacaaagtgagattccatctc

SEQ ID NO: 235633 - DNA, 596 bp, Homo sapiens
gagtgctgggattataggcgtgagccactgctcctggcacaaaaccattacttcttgttaactctagattttagaacatctgataagaagcctagagtgagaaagtcatgtgcatgcatacattttgtatgtttaaagtttatgtaggacggtgcggtggctcacacctgtaatccccctactttgtttgggaggctgaggcaggagaatggtttgagcccaggagtttgagaccaacttgggcaacatcgggagcctctggttctacagaaaaataaaaaaattagctcgggggtggtggcacatgcttgtagtcccacctattcaggaggccgatgtgggagggtcacttgagcccaggaggtcaaggctgcactttagtcttggcgactgagtgagatcctgtcttttaaaaagaaaaaaaaaaaagttgatgtacctgaaagtggatgacaagagtggtaacttaataagtattcttaagtatttgtaataataaaaacaaaaattataacttttattaagaggtcattttatttcctaccagaattactgatctgatttttctacttaaaagtaaggtgttacacccagtg

SEQ ID NO: 235634 - DNA, 576 bp, Homo sapiens
gataggcttactctggctaccatgatatcatttcattcatgtatttttcattaataattaaataccatcgctgctttcattcttaattcttagatgaaaacatgcttcttcatttgattatattgtttaatttttatttcgctctcctgttattcattacttaatatttcccttgaattatttagtctttttctaaggtgctgtaatttgcatgaaaaactcaacataaaataaaattgtcctgctttcaatgaccagaaaaaatgatttaaaagttcaggccacacacgatggctcacaccatgttggccaggctgttctccaaatcgtgacctcaggtgatctgcccacctcggcctcccaaagggctggcattacaggcatgagccactgtgcctggccaaaaattttgttttgagatgatctgcacacaggaatgaattgctcagaaataattggccgatgtcaaccacatatctgtttccgtggaaaatgcagcaacattacttcaaatagtttcatttgtgaatgtgatgaacaattttcagataaaaaaatacatatatatacatatat

SEQ ID NO: 235635 - DNA, 408 bp, Homo sapiens
ctcaacttgctatattgaatagactaatattgttgtgaaatatgaatgaatatgcttttgaaagtcagatgagaaatgtattttgccttctgaaatttgaacaattgccttgttaatacaaactggattggttggtgtagctaatctgacaaaagatgcaattggataaaacaataataaaaataataactaacacatgactcattacatgctaggcactgtattaaacacatatgacaacaggaggcaaaaagaggttaacttgctaaggtcaagcagctagtaaggagtcaaacccttactattcctatcttatttaccatccctctctattcctaaccaccgtactatctataccataatctaattaaccgctctgcagtgtctaccagcacttcccaagatttc

SEQ ID NO: 235636 - DNA, 623 bp, Homo sapiens
ggcaggtggatcacctgaggtcaggagtttgagaccagcctgaccaacatggagaagccctgtctctactaaaaatacaaaattagccgggtatggtggtggcgcatgcctgtaatcccagctactcaggaggctgaggcaagagaatctcttgaacccaggaggcagaggtggtggtgagtcgagatagcaccattgcactccagcctgggcaacaagagcgaaactcccatctcaaaaaaaaaaaaaaaaaagttaagcctaaaatcttggcttggctgatggagcatgtacagaaaaatgagagcactgtagggttcagacattttaaaaggttaaggaaccaaatccacaaggaaggttaacttcctttgaccctgagaaagctcttatgttaatcatgcctggttactttatcatcttgaacattgttctgtttttaatcagcattattgtgagttcagggttactgctcctatatatcttacatcatggttagtcaatcggatttagcatgtggaagagtcaatagatgctcatagatcattctctgaaaattttttaccaagagcaacagtgggttaatcctttatttgccagacttgagtctaaataatttttgg

SEQ ID NO: 235637 - DNA, 451 bp, Homo sapiens
gtctccaaccagtgctctgaacagagttcaccacccaagggagccctctctgactgctgtcccccgagcacctgctttgttcccttcttgagatagtgtcttgcaatgtcgcccaggctggagtgcagtggtgcccctcctgttgtgaatgtatctcctgatctgtttaactcctgtgtgtgaaactttgtgattcatgcaatgagaacaaggctttacgtgaacagaccagagcccaggtgcagggcggtcattccagagcccaggtgcagcaggtgcagggcggtcattctgcccacacagctgtgtccatgccagggctcaagatcccacacctcagcctagcattgctctgtccaaaggcagacagcctggtacagccatgtgtgcagttattttcacttcaaaaaaaaccttattaaacaaaaaccaaatatatgtaaacacacca

SEQ ID NO: 235638 - DNA, 611 bp, Homo sapiens
gcggccgcctactactactactgctcgaattcaagcttctaacgatgtacggggacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatatatgtccctaatttaatctatagtttttattgttcccaaatgttttctcccagttgcatttcatacaaactaagtgggaataataagcagttgggttttaaaacaatttatttgtgaaatttgatacgtataaaaaaagtaaaacatttaagtaacacttgaccattgtaagagatctattccgtccagttagactgctggtat

SEQ ID NO: 235639 - DNA, 2668 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatatta

SEQ ID NO: 235640 - DNA, 4258 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235641 - DNA, 4357 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235642 - DNA, 4162 bp, Homo sapiens
agcgggggcgcgagcgtgtgcgagcgcggcagcgtactgcgcgtgctccgcagagggacacgggaaggttgggtccggctctggaggagatgcgtgattggctgacgctgtgctcgggggttccctggccctttcggcagggcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235643 - DNA, 4464 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatatatgtccctaatttaatctatagtttttattgttcccaaatgttttctcccagttgcatttcatacaaactaagtgggaataataagcagttgggttttaaaacaatttatttgtgaaatttgatacgtataaaaaaagtaaaacatttaagtaacacttgaccattgtaagagatctattccgtccagttagactgctggtat

SEQ ID NO: 235644 - DNA, 3593 bp, Homo sapiens
  misc_feature (11)..(11): n is a, c, g, or t
  misc_feature (13)..(13): n is a, c, g, or t
gactgggaggnanagagagtcagcttctgctggcttcccaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235645 - DNA, 3269 bp, Homo sapiens
catggctgactctagaggatacacttcctctcctcccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235646 - DNA, 3203 bp, Homo sapiens
aggctgtctagaggatccctcgggccaccaagacaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235647 - DNA, 2070 bp, Homo sapiens
gacccacgcgtccgcggacgcgtgggtcagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235648 - DNA, 2721 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattaaaaaaaaaacaaaacaccgggactatgcgggggggagaaaaagatgaacgacg

SEQ ID NO: 235649 - DNA, 1678 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggttagatcaaagaactctttagacttacaacatcacatgttcaaatttggtgctgttaatgaagtatgacctttttctattatgttaaattgtttagtaaattattttatgtatatgaaagaagctgtggggttgttgttacctgagaaaatgttattgtttccctgccccgcaaaatacccctctaagagtgaaacttataacttaagatgaatccttgtctgtatgcattgtttagtaacttatatgaaattatttggatccatgtatagagctgtcagttgttctttcattctgtattaaattctctgagcacagatgcaccaggaatcatgcagtttcccaacttaaacaagttggtctataattaaaagaagagatacctgttgtttgtggtttaaatgggatcagtttcctttctacaccaattaaactatcttggaaagatgagtgacatccttagtgtatcatgtaagcctacctgaaacttcttttatctttcttcaaagtcaaaggttaaagtatatttgagtggtgataggaggagattctttgttcaatttgtgaatgtcagagtttccagctaatactctcttctttcctatccttccctctcccgttaacaccatcacacaccctatcttacccccaaaggggaaataaattgtttctattaggttcaggtttttc

SEQ ID NO: 235650 - DNA, 405 bp, Homo sapiens
gcggccgcctactactactactgctcgaattcaagcttctaacgatgtacggggacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235651 - DNA, 798 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggtaaattttaaacaaataatttggtatttttatctactttttttcttgggtatgactatatatattttgcatttcctgtctcctcattatctgacagtatctttgtaaacatgtctaaactgtattcaatattttattcatttgatggcaaaaagtgtttttaactgcaactcacagtaataaaaacattttatgtcatattctggtacataacacattcatatctatatatgcacacgcttattcttatatgtactctagtattttatttttagagtcatggtctcctctgtcactcaggctggagtgcagtgatatgatcatagcccactgtggcctcaaacttttggcctcaagcgatctcccagcttgcagcttgcattcccaaagtactgggattacaggcatgagccaccaagcccgacctttatttcattaaaa

SEQ ID NO: 235652 - DNA, 524 bp, Homo sapiens
gttatcagaacttattaacattagtgtcactaaaattggtatacaactccccactgctaaatttggctaaaaagaaaatttatttcatggtggttgatgacaaagatgactttttaatagttattcttgtgtttgctccctcagcatttgacattgtgcagcaaagaaatggttatggagaagcccagtccgctgcttgtagggcgggagtttgtgaggcaatattatactttgctgaataaagctccggaatatttacacaggtaaattttaaacaaataatttggtatttttatctactttttttcttgggtatgactatatatattttgcatttcctgtctcctcattatctgacagtatctttgtaaacatgtctaaactgtattcaatattttattcatttgatggcaaaaagtgtttttaactgcaactcacagtaataaaaacattttatgtcatattctggtacataacacattcatatctatatatgcacacgcttattcttatatgtactctag

SEQ ID NO: 235653 - DNA, 3993 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaataatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatattatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 235654 - DNA, 3516 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtatttgtttttcatgtactgggcaatatgagtaaaatctgtccctttttccccctttgaatgaggtcttccatgtttgagggagaatctcggggatctctaaagtcgactggagcatgcag

SEQ ID NO: 235655 - DNA, 1338 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaagggattaataaccagaatatacgaggagcttagaaaattctataggaaaaaaaaatcgaataatcatttaaaaatgggtaaaagattagacatttctcaagacaaacatggcaagaccagtgtatatggaagtgttcaacatcattgatcatcagaaatgcgaatcacaactacaatgaaatatcatctcacctcagttaaaatgacttttat

SEQ ID NO: 235656 - DNA, 839 bp, Homo sapiens
agcggaagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtataaagcgttgaggaagtataaagcgttgagaaagtataaagcgttgaggaagtataaagcgttgagaaagtataaagcgttgaggaagtataaagcttgagaaagtataaagcgttga

SEQ ID NO: 235657 - DNA, 370 bp, Homo sapiens
cctggtgtaggaaagataagccacgtcagatggaaggaactttgtggggaatggcatggaggtaggagtaatgtggtggatgaggaaaaaccaagcacagttcagcatcatcagaatgatgtgtgcatgtggcatgtgcatgtgtgcacaggtctgtgcgtgtgtgcatgcatgtgtgcatgtgtgtgtgtgcatatgtgtataattgtggggaggggctatcaagaaaagaagccaggctaggggagggatagcattaggagagatacctaatgtagatcatgggtcgatgggtgtggcaaactaccatggcacatgcatacctgtgtaacaaacctacacattctgcacatgtatcctagaacttaaa

SEQ ID NO: 235658 - DNA, 398 bp, Homo sapiens
ctgagccccgggggccgttggctgccagtggcccactctgatctgcggccccccagttgccgccagccccccacggcccgcacggaaatttttctaccgtttttcagcttccaggctctcctgaaagtgctcacaaggcaaatcgccatggaaagcgagttcaagtggccttttaaagtagaccaactaagcgaatggctttgtctccgaagacacagagaccttgggcagccagtcagggacacacccagaagtgtttacactgctctgggtctgcttttttaggggtttttgttttgcagattctgtgttatgcctggttaggtatgagcttcagaccttctgaaccggagcaggaagaaaaataaaagctttcctccaaaccccaagaccaaact

SEQ ID NO: 235659 - DNA, 285 bp, Homo sapiens
aactgatccatccttgaagtgtggtttgtggcagcttcagtgagtacaaagatgactaaagtcaggtctttccttcaaatttctcacaattcagaggggagatgatgatacaccttgacgaatgatttctttggaaattaattactctctttaatacaggttttgtgtgtctttggggaagaaatctgaattattattttttttgcctttcatgtttattaagagcagttcaaactatttcttttttatcaagcaggctaatgagtaatttaaagtaaggagtag

SEQ ID NO: 235660 - DNA, 230 bp, Homo sapiens
atagataagcatgagtcgcaagacatgttttcccaagatgtaagctgagtcctaagaatgtcacctgataattaactgctttgttctcgcttttgtaaaccagcttcctgcatcatataattcccacctcaaagtgcataaaagacattcattttctttgtttgctgctcagactttcaagatgcatgtccgctgagctagtgtacacttaaaatattccctcctgaact

SEQ ID NO: 235661 - DNA, 1026 bp, Homo sapiens
ggaatgggagagccgcctccaaccccagccccatggagcagggcagaaacgctgcccactgccctgctcctgccaccaggaagggcgtgtggggggccactttctgtaaagaagaaaccgcctgaacaacaagtggctcaaggcacccttgtctaacgaccagggacactgagcgccagggcccaagtcaccagcaagagaaaacccaggcggagcccagggtgtcccccactgcccaccagccactgcggtcaacgtgaagggcaagggtgcaagcgggatcgcgtcacagggagccgagtgagcccagaaagtaggagaaggacgtttccacccacctggagcgcagtccgtttgcagccggcggcagaatgctgctgtctccatcaataaagtccatgttagccacctagaggataaaataccacgaggaggagtagcaaggtgcccctgttgacagatcttgaagcacaagctcactcccagaagcacagctgcctagtcaacaaacagctgacaatacatgtctgaaggagctcagctgggaacagaagaatggccccactgagcctagcctaaatggcggaccatctcaattatgagctaataagttttggatgatttgttatgctgccatacctaactaatacatgcacccagtgcagattgggtgtcaagatttaaagacagtttgattattagtcaccttctaacaatgggcacctaaaggtactgacatttttcccgatttaaagttaaatgtcttgtaaggcaatgttgactgatgcaggaatacttgtagacatgtatgcatgtgattggtgcttatatgcacacagtcccccacaccacaggaaaaaaccgatgaccagagcctgaccattatggccaaggccaaatagccaaagtttgcctttaatctattttcttcatatctaaaaattggaggtcaatactgtggacaggtctgaagacatagagttttgttctcctgtggccccatcattcttcagtggtctacctgtg

SEQ ID NO: 235662 - DNA, 547 bp, Homo sapiens
ccacttcctcaatctgtctgtttcttttgctgtttccttcatcttgcattccttctgcattggaactttctgttggataccttactttttttttcagggtcccatctcaaataccactccacttaagacatttttgcatagaaataatctttggtgtatttacttttgtcatctgaatgagataaatggaaaaatttggcagcataaattgttcaaagtcaatttggtaattcacattgaagaaacatccatatgtaagagattattagaaataaagccttttaaagaatgtattgttaataactattagtagatttgttcttggtaaatagaagaacattgttccccagaggtttatgtgtatattccatatctgaaaatcaatgtgcacaaacacggggctgttattagcaaagtcattaattacagtcctgcttgctcttctattatgaagaatattcattcgtttgctttctctgactgacaggcagtaatgacttcaataagctaatgagacatctagttaaataaatatgattttaagtta

SEQ ID NO: 235663 - DNA, 519 bp, Homo sapiens
gaccacatgacaccagtcccattcttgaagcagaatgttcaaagagtgtgtacaaaatgcagaagccacccatttccaagaaaaacggctatgcttcaaccagcctaagtctactgcaagcaagggcacccataagagatggaccttgagggattcaacctaactaactaggccccctgcatgtgagctcatcacatggctgcccggcaagatactacattttccagtcttccatgaggatagatgtggtcacgtgactgagtctgggccaatgggatgtgtgtagatgtgatgtatatttatctccataaagatgaagctggttgccctgaatattctgtccatcagttgggaagtggcaatgaatggaacaatgccttgggccccaagacggatcctgagtatggcagagctgcccaccagcctaggttcctatatgtcatcatgggacagagctgccttgtagaccctggactgttatattaatataaaaaagaaataaacttctatcttatataa

SEQ ID NO: 235664 - DNA, 2554 bp, Homo sapiens
tttaaattaatgtgtatttctcttctctctctctcacatacacacacacagccatttaatccaagctttcattcaaaccaaggatctttccacaaaatccctgagagtcaacttttactgtttactaaaactgtcttcactgtgtggagcttacttctttgtgaagcttggtgtttcatttggacaggccaatttatggaaagctgtccttcatactgaactgaaattgatcttttcatctgtgcctatcattcctggaatcaaatgagataccatatcctgaaattttttgaaatggcaaagcactgaataaatataaaatatattaatgtcagttctactgtatagagtttgaaaatttgacaagcacactgtcctctccaagtcattggaatagatgaatatgagaacagaacaagagagatactctgcacaggttttggaagtgctcctttcaatttgatattaatccattaatcagtattctttaaactactctatttaagcagtgagaggcagggaccaggttaagccaagacctagagaataaaaacaaagccaaagtagaaagaaaaccaggacccaccaccaccccaggcctgcagcaaatacatcagtgttcactcaaggcccaaggacccttcagtcagcttgtgatgaatactgttgagcctgggactctcccttcaggacagtgctcccctctagcccaggaaaagtccagtaataccatccatgtgccaaggcctcgaatcatggaccccaagagcccacttggttctctatccctctgtggccaatatggtacctaagcttcaagacaaagtcggctttactcttccccctccttttctcaagcagaaggagtctctcatcatagccagcatagctggggatgtgctgagtcacacttgaagccagcatgtctctgaatctcacccaaggcccatagcaagtactgtctagctaccactgctaactatgcagggccaaagggctttttagtcagtagttaatgaattgtggcaggactgagtccttctctttaaggcagctggttctcttctggcccagggtgtgtctagaaataacattaggagctagggcctggaatgggagcctcaagtctccggctagtgctctatcctactgtggttgagctggtatccaagttacaagacaaagtcctctttattcttccttctcctcattttaagcagaaagaagtctctcccagagctgtgagctgtgctacctggggttttgggagtggtggtgcaagcacaccctcggctgtcctagccagtgtctcgctgggtcacgtgttccccaagtctactttctcgagtccagcacagcaccaggacttgccaaggaattgcagtcctcttggcctagactgtctttcaagtttacttaggaccccatagcatcttagcccatggtggtggggcttgctagaagaaagggtccaacaactgggatgggtgagtccactctggctagggctggtgtatatgctccctccataggcattgactaagttctatacagtgttgcttttctgacagggcagcaatgagttccaatgctaagtcccacaatcactgcactctccccaccaagagcacagatcttctctcagcaccacatggcagctgctgggagttgagggtagggtggtgtcagcaattcaaggctgtcttttctatcttcttaagtgcctctttcagtgatctgaggttaaaaccaggtaccgtggtcactcacctgatttttggatattatgaaggtgcttttttgtgtgggcaattattcaatttagcgttctatggggaggacaatcagtagaggtttccatttggccatctcgctcctcctcctctgttccaattctgagtccagcaaacaaaaatagcgccctttggaaagaagctactataggacaagcttagcagggagctatgcttcacctccatgagagcagactacctacctaactatttactttggaaaagagctccagatgaaggcctgatgagattcccatgcttactctgaaatcatcattttggaatcagtcattaaagcttcgtaaatatccaagatatttattgtacacactactgttcaatgtaattaataaaatattaatttataacatgctcttagcccaaccaaaagatcatgctaattagttttcttcaaaaaatattaataagtagtaaaaatcctaccttgagtattcagccaatattaagagttatgcctggtggggtgtggtggctcatgcctgtaatcctagcactttgggggaccaagtcaggcagatcactttaggtcaggagttcaacgccagcctggccaacatggtgaaacccgctgtctactaaaaatacaaaaaagttagctgagtatggtggcggtcacctgtaacccaagctacttgggagtctgaagcagtagaatcgcttaaacccaggaggtggaggttgcagtgagctgagtcacgccactgcactccagcctgggtgacagagcaagactccatctc

SEQ ID NO: 235665 - DNA, 342 bp, Homo sapiens
atatgcttataaagatggaaagaagctttgcatttagcattttccatttaggctttgtgaaaattgttcttattttaaaaatagccctaacatgtgtgtgtctgtgtgtgtgtgtgtttcctgagtattctagatggtacatggtattctgaaaactgaaagtcacacctccaggaataaaattaggaaaagcagaaattggagggaggtctctagaaatgatgtagtattatctgaatacctcaaatctaatccaggtcatctgggtagaaattctgggagggatttatttaaatataaataaaaatttgtatacctaaataaagattgtattctacattt

SEQ ID NO: 235666 - DNA, 88 bp, Homo sapiens
attcaattagagttatttgtttttgcatggtcatccaatggctttatcagtgaatcaacagcatgattctttatccgtattcaatagc

SEQ ID NO: 235667 - DNA, 384 bp, Homo sapiens
gtaaagtctgagcatcagttattcaccacattttacacttctttaccaaaattatgtgagtctagattttttgcatttccatataaattttagagtatacttttttacgtctacaaaagaaatgacatctttactatgttgagtctcccaatccatgaacatggtacatcttgctacttagttaagtttcctttgatttctttcatcaatactttgtaattttcagcatacatattctatatatactttgctagatttgtactaaggcatttcattctttgaataatttgtaagtagcattgtgtttttaattttggtttccacatgtgcattgtcaatatatggaactgtgattgatttttgtagcctgcaaccttgctgagc

SEQ ID NO: 235668 - DNA, 2142 bp, Homo sapiens
  misc_feature (1070)..(1070): n is a, c, g, or t
  misc_feature (2092)..(2092): n is a, c, g, or t
cttagatgcctacctggtgttctgttgtattgtggctgagctggcactcaaattacaagacacagtcctttccactcttccctcccctttccttctagttctttcactcactgactttataaaaaggagaatatgtccaacacattgtttcattacctagtatagttcctttaatgacacataacaaacatcttttaacataaccgttacgtgtttcttctgtaaccgtaattttaaacatctacacaggatttcattgaacagtaactttagtccctgcttcctgaacaccgaggtgctcaataacttacatacattacctccctgaggtctcttggaggtaggtatggttgctgccatcttgtagatggggaagctgaggctgagacatgcaaagccacagcctgggttcacacagctggtcagagacaggatcaggattcaagcccaggtgtgtttaccaccaaagccaaaggacttccattgcggaggaaggctggctgccccagaggaggctacagcatgtaataggaggtcttctcctgtagctctgtgaacactgtgagccagctcaggcaagaatctgccccccaaaaagatacccaaatggccaataggacatatgaaaaggcagtcagccacactagcagtctagacaatgcaaattagaaccacaaggtgatggataccactacccacccacaagaatggctaaaaggaaaaagacaggtaatatgaagtattggagatgctcacataccactggtgcaagtgtcaattggcacaaccactttggaaaactgcttggcagtatctattaaagttgcacatgtgtataacttaccaccccagaaatgcacatttatgtactccaaaatgcatgtttgtggcattaaaatgttcatggcagcaccatttgtcataaccccaaattggaaactactcagatgtccattagcaataggattgggtaaatcctcattgcatgaatatactaggcagcagtgagaatgaactattgttgaatgcaacaatatgaatgaatctcaaaatatattgagtgagagaanctagacttaaaagacacatagtgtatgattttattatatggagtctaagaacaggcaaaagtcgtatgtggtgctagaagtcaggatggttggctcttgttccttgatctggatgctggttacatgggtgcattcatttcatggcaattcatcaagctgtaggttcgtatgtttttgattgaagcattacctacacttttttgagtggggctctgcaattagcaggtagcaaaaccagccaggcctgtgtccttccctgcagggtggtgtacacttttttgagtgtaggtaatgcttcaatcaaaatttacattaggccagttgcggtggctcacgcctgtaagcccagcactttgggaggccaagacaggcagatcacttgagcccaggtgtttgagaccaacctggccaccatagtgaaaccccatccctactaaaaatacaaaaattagctgggcacagtgatgcacacctatagtcccagctacttgggaggctgaggcatgagaatcacttgaacccaggaggcacaggttgcagtgagccaagatcaagccagtgcactccagcctgggtgacaaagcgagactctgtctcaaaaaaaaaaaaattacattagaagttgggtatggtagtgtgcacctgtagttccagctacttggcaggctgaagccggagggtcacttgagtccaggaattcaaggccagcctggaatagcaagaccttgccactttaaaaaaatcacagaggggctgggcgcaatggctcatgcctgtaacccagcactttgggaggccgaggcgggtggatcacctgaggtcaggagttcaagaccagcctgtccaacatggaacagttggcccaacatgggccaataaatatcccatgtatatttttagtctctactaaaaatacaaacaattagctaggcgtggtggcagacgcctgtgatcccagctactcggggggctgaggcaggagaattgcttgaacccaggaggcggaggttgcagtgagccangattgtgccattgcactccagcatgggctacaagagcgaaactccgcctc

SEQ ID NO: 235669 - DNA, 390 bp, Homo sapiens
tgggaaagactggacttcaggctccctgcaggaaggaagagaataaagagaaagaaaagaatattttcttcccagagaacggtgatatgagcacaaagaagccagacaagaagcagatggtgcacaggcattaacctacaccattgcacaaatgcagtctttctgtgtggcttttaactgcagtcaagttggacagactgaacgacatagtttagatgtctgtcccctccaaatctcatgtggaaaggcagtccccagtgttggatgtgagggctagtgtgaggtatctgagtcatgaggacatatccctcatgaatggctggtgccctccttgtggtaaggagtgagttcttgctccgagttcaggcatgatctggttgtttaaaagag

SEQ ID NO: 235670 - DNA, 503 bp, Homo sapiens
aggctgcagtgatctgtgattgcaccactgcactctggcctgagcgacagtgagaccttgtctgaaaaaaggtagggaggaggggcgggtgggtgcctcatgcctgtaatcccatcacttcagtaatttgggaggcagaggctagaggatcacttaagcaggagtttgagaccagcctgagcaacatagtgaaaccctatctttttttttttgagacagagcctcactttgccgcccacgctggagtatagtggcatgatctcagctcactgcaacccccacttcccgggttcaagctattctgcctcagcctccccagcagctggggctacaggcgcgcgtcaccacgcccgctaatttttctgtttttagtagaggcggggctttaccatactggccaggttggccttgaactcctgacttcgtgatcagcccaccttggcctcccaaagtgctaggattacaggcgtgagccaccatgcctggccgagaccccatctctt

SEQ ID NO: 235671 - DNA, 478 bp, Homo sapiens
gcgcgagccgcagcctctcctcccgtctcgcttcctccgacaggcgcccgactcggacacacggcgcccctgtggttaccacatccactgctttttggtctcctcacccaaccccttaacataaactcgacaccagggaaggcatcttggacgattttggtccctgagggtcctagtgcgaagggcagggagagagggagcggtgtggtgcagggggatacagaacgcggaggacatctaggggctgaggatgcggggacgaggagcgcgcggaagagccgaggttccggggttggggggtgcggatttcagaggaaccgccggggatgtggacggactcggaaggaaggggtcccagagaggacgcgggcggctgcaggacacaagaggtgcgggacgcaggaggccgtggggtcgtgcgggagcccagggcacctcgacatggacccgccagacctgtggctcctccagcggccgc

SEQ ID NO: 235672 - DNA, 676 bp, Homo sapiens
ggaaaatatagatataggttatatggtttcaatagatagaataaaatgaggatacagacacagctgactataccagtttaattatcaaatgctgagatatagctctgtgaaggtccactgggtctgtttttacatcatgctcatcatgtttagctatacctaattttcactgaattttaaaaattctgctgggcttgatttgtaactgattaatccagctcattaatatttaagaatctaacattagtaatataaatttggcatattaaaaatgataccaactaccttttattatgtgcttagactgtttcaggctctgtgctaagagatactagtcagacatcacaagaaacctgagataggtgttgtgatggtcaccactgttgagtggaaagtactaataagactcagacagtgaaagtgacttggccaaggactgtcagtaagtagggagtgaacagggggccaaaccccagatatctgactggaattgaagcttgtttttaaacttctagatataatatctcatcccatgcctcatggacaaagttcagaaggtgtaagtgaggactacattgcaagtaaggatctgtgagtgtgagagaatagagatgagttataggtaaacagattgtgagttatctcttcgttgttgggaatacacaggggaagggta

SEQ ID NO: 235673 - DNA, 406 bp, Homo sapiens
ctctttaacccagatggtcaactgtgactattacatcccaggctctcttcttaggtgtggggaactcaacaaggtatgctccctgtcttcaaagagctatggtctagtgggagagacagacaggaaaatagacttccatagagtattgagagctttgtcaggtgtaagcagtgggggaatggagaaatggggagttactgcttgataagtatgaagtttctttttgcagtggtggaaatgttttggaactagttagaggtgaaggtttaggaccctaaacccagtatcgccggtcagagaaagtttcataggagagatggcttctgaagacatggaggaattaatcagatgaagaggaaaggggacattcagagatagagggagtaacctctaggcaaaggtctgg

SEQ ID NO: 235674 - DNA, 569 bp, Homo sapiens
aacccttgtgtgtatgtgttagtttttttcccctaaggttttgtcctctagttttaactagagagacacatttgggatattaataaccgaattctagcaagcattatgatctcttcagatttcatgtagtttgatgtcagaagctgcatagcaaagttaagcctgatctgaattggcttcaagtggatagagctgtatgaccctcagtcttctcatgtatagaatgacttatatactctaaacttccttgtagttttcatatttcatgactatgaaacctgtgaaaacttaccagtgttttttctattcatacttcctttgagtctgcagctgctgttcttctgatttgatttttttgttgtttatttttattagccactattcattcagtaccttttatatgtcaaaacgtttgatatttaacctacgttatttaagggcttttgtactgctgctgtactttataggtgcatagatatggtaaaatcacaccatgcctcctgctctgactctggataacatattcctacagcaggatctcatttcaataaaaattaaaagaaacacta

SEQ ID NO: 235675 - DNA, 565 bp, Homo sapiens
gtgactgagagagtacatgatcatgtactaaatcagagacaggaggtaccgaggggtttggagggtatcagtttgaactaaggtcatccgagaaagtttctcagaggaagaacagcttgggttagccagtggaggctggtagtttgggcagagaaagtgatagatgagcagaagctcaaaggcaggggaaggaaatcagactcaataggggtaacatcttctccagctcacagaggtgaaacataaggcaccaacctggatacaaatacaaagaaaggggccaggtgcagtggctcacacctgtaatcccagtatgttgggaggcgtaggcgggaggattgcttaaggggttcaagaccagcctgggcaatatagtgagaccctgtctctaaaaaaaatatttttaaaaatttagccaagtgtgctggtgtatgcctgtagtcccagctactcaggaggctgaggtaggaggattgcttgtgcccacggtttcgaggctgcagtgagctaggctcacaccactgcgctttagtctgggcaacagagagagactctgtctctgaga

SEQ ID NO: 235676 - DNA, 689 bp, Homo sapiens
  misc_feature (664)..(664): n is a, c, g, or t
tagtcgtaccgaaattctccttcaggaaggatgagggtagcctggattgactggaatctgggtcttggggtcaggcaggtattgatgtaggtcttttatggcaataggactaaaagtactcaatgcaagctgggccaccagagccagggtcactgtttgaaaaaagaggctggaggtaggcctccccaccctcttttcattctttcaggtgaaaggaacctgaaaagaatcccctgtgtctgatgcctgggccatggcttacagtagtagttctgctcttagaaggcaactgtaaaacctagagattggtgtgaggagtcagggagtggaggtggagaaaaaaaagcagcaacagtgacaataacaacaaagcctcccactcaaaaacgaccccgcaaatctaacattaatgaagacagccaaggtatcaacagtcagaatgtaaatctactgccgaagaaaataactttgtagacagacctgattaaaatagtatattcgggctgctcagagggaaaagtaaaggaataatgttcattttaaaagaatgagaaattaggaaccaaaaaagaaacaagaacagaggatttgaaaaagaaccagtttgaaattcagggactgaatcattgaaatgaaatctaagtggatcagataaactattgtngtgtttctttttccctcagttgctg

SEQ ID NO: 235677 - DNA, 518 bp, Homo sapiens
ccctactcccatcagatctatttggaatagttcttgtgatgcctcctgttgattactcagttgattgaagtgaatttttcttggaccagcaattttcagaagtttcatgttggggaggaactagggctatgttctgggctagctggaatttccctcatgacccaggattcttgtgtcaggttaattagcctttacttcttcccagcccttagagatagctcccataaacttttcaccgagttctatctctgctattctctcattgctaaagggacaaggtgcttcttttaaatatgctgtctatgtgatttctcatgcagtccaacactctctgcttcctagttctggggaagctcttgatgctagtttgtgcactcatcctactgctgcaaatgaatgatttttattttgcccttgtctctcactgccaagaaatatactttgctggctcatgcatgatccagggtcacagtctttttccccccttcactttctgccacgtatatctccacttgatc

SEQ ID NO: 235678 - DNA, 440 bp, Homo sapiens
acaccatcacctcagcctcaaatggggatgcctcagcttatcaccatgcagcggacagaccagaggcgtgaccaaccctcgcttttccaatggcatgcaaaaattttgctcatggttgctagaactgtcattatttttattattattttttctgcagtacaggcataaagaagtataagagttttaattatgtccacttgattttttttaactttctggctaaaaaatcctttgaagtaaaacccagcaagaaatgggtcacagctctgtgaatggaactacaaaatgtgagcgaaagccattttgataggaaccttgagaaatggacagccgcctcacattccttcacaggaagaattaaaggttataaagcgtccagtccccctaactcaaacacagaaacataacaattttacaaaataaacctttttctaacttga

SEQ ID NO: 235679 - DNA, 223 bp, Homo sapiens
tgtgacatccaaaaaaaattaaaaagtgatggggtgaataacaggaagaaaaggctgaagaacgaacttgtgcctggaacacacagtcaaggaattctccactttgtgatgtcagctttcctcaaatatctggggatgctttattgcttcctttgctttgtacttgaaaatgcccaagtttttttgtacacagcagagcgagatagagggaaagtatgaaaaa

SEQ ID NO: 235680 - DNA, 547 bp, Homo sapiens
ctaacttctccagaagcaccttgatggcacaggccatcccgaatcttgccagtattcatgcagtgttgtcttcaggttttatttgttgcctagtttttaaagttcactgtctgtggccacgctgatggtgcccatgcagagtgctgaccgcaaggagctctattccgtgctgagctggacacttggagctcccatgacgtttcacggtgaggaagcagggattctgaatcgcaaaggagcagcgcgaatgagggctgtttggcctccgcctgttgctgggttgtgacctcccttcacagaatctcttgagatggatgccactcctgaagtgacttggctctgttttaggggcctgctcgtggggtggtgtgtgcagctctcccggcgctcaggaaaagtggagtacagggacacctgagggatgatctgccatcggccagggccctgcctgccttagcccccgctgagagctcagcatagtcgtagcttccacctgcagctgtcttcctgagcattttcttaagtgaaaataaagattcagccatga

SEQ ID NO: 235681 - DNA, 1686 bp, Homo sapiens
agggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagtttggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatgtagcagtgatgttcttggaattgctgagaaatttggggagggcaaaagataggggcagaattttttcattatttccctttatctaatacttttaaatagaaccaacacagcctatatgagttcaggcaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcgctctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgattta

SEQ ID NO: 235682 - DNA, 1196 bp, Homo sapiens
tcaggcgcgtggctcctgcctgtatcctgcactttgagaggccgagggagtcggatcacaaggtcagaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagtttggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatgtagcagtgatgttcttggaattgctgagaaatttggggagggcaaaagataggggcagaattttttcattatttccctttatctaatacttttaaatagaaccaacacagcctatatgagttcaggcaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcgctctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgattta

SEQ ID NO: 235683 - DNA, 548 bp, Homo sapiens
catgttacaagcactggagatacaaagacgagtaaatcccagccctcaagaagagtataatctcaggaaaaaggcaggcaaatcaatgaagtattacaagacactgataagtgctaagatctttcttcaagggaatgggtgagtcctgccagtgactacaagaggtttatctccagccacacagattcagcataaactggaaccaagatccccacaaaggcttcaccatacaggagacagtgttatttatctgctcataaatgctgatagtcaagaacaaaatgaacgagtcacaagatattgaaaacaaaaatccttaggagcagctgatcctggtgggccaggaagctcagaatcaaaatggatgctcagttggaacatccgcactagcctgccacattagcacgtttgctaccacctctttctgcagatcccatttgcaatttctgggtttacaccatcagactgattttctatgtaatcttcgttataagcctcttcagatgtttttaaaatgaaatgaggaatacattaatgaataatcaaat

SEQ ID NO: 235684 - DNA, 1239 bp, Homo sapiens
tttttaatgagatggggtctccctatattggcctgtctggtcttgaactcctgacctcaggtgatccgcctgccttggccttccagagtgctgggattacagcatgagccaccatgcctggcctgtatgtgtgtgttttaaagcactagatagggatggacattaaatctgtgttgcagggaaactaaacagaggtttccaaactgaaggcaacctaattgtaaatgcctgtgttaaagaggcagcttgactgttcatgtttcattttgcaaccattggttttgagattatcttttatgcacatttggagtcccttttcaacagtgacagtttcttacacgaagaatggatatggttattgggctcctctaagaatcagagtagggtaacaatgtaccaggcaaattgtaagttgaaattctagataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaagagttcatgaccagcctggtcttttgtagagaccctgtctctacaaaaatataaaaatcagccaggcgtcgtgcacacctgtagtatcagctacttgtaaggctgtggcagaagtgctttagcccaggaggttgaggctgcagtgagccatgtccacaccattgcactgcagcctgagtaacaaaatgagaccctatctcaaaaacaaaaaggaaaagaaaatatacatgatgggattcctattgtgaagtcatttaaaataatgacttgaatttctcagaaatttcaggagcatataaactatttaaatcaaaatattcttacatatagaaaccaagtaagaataaatgagagatatttcagtggacatctggacatatttatggactttgagtatctagcaagtagaaaggaaaaaaatattcatcatactctaatcatttttttatatctattgagcttgtttcttgtaaacttttctttatcttataaaggcatatctcgcttttgtatcgacctgttccttaaaaaaaaa

SEQ ID NO: 235685 - DNA, 686 bp, Homo sapiens
tagccatgtggagaggctacatggagtgaaagatgctctgacagtccccagggtcttctgccaactccacccaggtgccagcatttgagagaaaatgccatcttggacactgtagccacagcaaatgccacatggagaagtgcagaaaccaggtgatagacagaaacaaggcctcagacattcagtcccagcacaggaatgtggacatcaacctccaaggtccctaaggatccctgcctcctggtctgcacacctccgtatagtcccttcccacactgcaccatgattaggctgtgcgaccaacagcatgtggcagtgatggtatgtcacttcaaggatcagaatacagaagacactatgacatctgtcttggatgctttctctcttattcactcaagggaaaactagctgccgtgtgaggacactcaggcagtggatggtgaggcccatgttgtgaggaactgatgtctctgaccaacaggcagtgaggacctgggacctgtccacatccacatgagtgagtttccaagtggaccatccagtcccaatgactgcagcccaggctgacagctggacagcaacctctacagaactctgagccagaaacaaccagctaagccattcctggattcctgatctatgtattgtataagaatagataactaataaaaattatcacaatcatc

SEQ ID NO: 235686 - DNA, 283 bp, Homo sapiens
gtaagtgaacctctggaaatagtggtctgaaatcttcatccttagtttctcagttctgttcttttttgttttgtttttgtagtttaaagttgtaccctgaatgaacactgttttgtttttataaaccatttatgtgtataagtcataaccttcttaaaaagccaagttatctggtttctcaagtctgcagatttgaaatagcaaactagaaagagtgggtgtatcgtaggaaaggaatgcactcacatctaatagcaataaaaattgacatctgtctcagatt

SEQ ID NO: 235687 - DNA, 551 bp, Homo sapiens
attactagtatggttgaacgtcttgtaaattatgcatatgcctgtttacattttgggttcacaatgtctttctgattcatttgtgggaactcttctcctttaatattgttaataatggtttttgacaggcattggttttaaatatatataatcaaatctccccctttcccacttttttaattgcttataaaaacttggaaagtaattatccatcctgtgtttaccctggctctttcatgaagtctatagaattactttatacacatttgcttatttgataaacattctctctgttttgtatgtgcttaaagaagctgttttggggctcatacctgtaatcccagcacttcgggaggcgaatggatcacttgaggccaggagtttgagaccagcgtggccaacctggcaaaaccctgtctctactaaaaacacaaaaaattagccggctgtggtggtgcacacctgtaatcccagctactcgggaggctgaggcacgagaatcgcttgaacccaggaggcagaggttacagtgagccgagatcatgccagtg

SEQ ID NO: 235688 - DNA, 411 bp, Homo sapiens
tattctctttgtgacccgaaagttgagagtaggggcaataatgtcacaaaagacatagttaccctctgaccaataaccactgttgttgctttctgtcttttcacagaagtagtgggtttgttaattttcagcttggacacctataattatggacttttgcctctggaagttggccctttctctctgtgtttcattttgcttatgcagaattgagccgacttccagacaccagagccctcccaagctgggtggcaccattgggagagcctcatgggaagaggcattgctctgcacctggctttttctgtcaggtcttcaaaagagacttccatagttttgggaactggagtcatagagcaaaatttcagttggttaatactttctgattaaaggaatctaattcagttaaca

SEQ ID NO: 235689 - DNA, 397 bp, Homo sapiens
gagctatgattatgcatcactgcactgcagcctgggtgacagagcaaaccatgtttctaaatacataaataagtaaataaaatgaagtaatgaaacacctacaaggtaaatgcaccttgaagacttgtaaaattaaagacgccaattgcaaaaggtttcatattgcatgatttgatctgtatgaaatgtccagaataggcaaatctgtttgagagagagaaagtagatgagtgcttgcctaggaccgggaggaggtttgcgaggaaatagagattcactgctaataagtacagggtttcttttgggtgcacttatgaggatgctctgaaattgattgtgatggttgtacacctctgaatacatgaaacagcattaaatcatcactttaagtcaactg

SEQ ID NO: 235690 - DNA, 1066 bp, Homo sapiens
tacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaagacaacccttgcacgtcatcatagaattcatactgcagagaaactttacaaataggaagaatgtgacaaagttttcggttgcaaatcaaaccttgaaacacataagaaaatgcatactgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattgg

SEQ ID NO: 235691 - DNA, 623 bp, Homo sapiens
caactttctaacataaaagtgattggaaagagtcctttcttctgcagtgtttcaggtaatttatggattgaccaaaaaaataccatccccaccctaacatgtagcactggattcaatccccattacttagcctagagttctaagcctgtcagaagggaggggccctcgcagaggagtggggcagttctctgcagcgcagcttctctgggcctgccgagttaatgttgcctcatgtctgccaatgatgttgttgagcaggatagggttctcgttgaaccttgaagctcagtgctgaccatatcacctccttctgctctggggccttacttcaccatttaggaagaacttataccagctctgttcactgtttgtataaatccatttttgtactgctataaagaaatacctgacagcctggccaacatggtgaaatcttgtctctacaaaaaatacaaaaattagctgggcgtggtgatctgtgcctggagtcccagctactgaggaggctgaggtgggaggatcacttgaatccgggaggtggaggttgcagtgagccaagatcgcaccactgcatgatcacacctctgtcactgcctgggtgacagagtgagaccttgtctcca

SEQ ID NO: 235692 - DNA, 1077 bp, Homo sapiens
agagaatagtatatatttcaaacatagttatgttttctctaacttgatgaggtcatgtcacagaccattttatcccttcagtggaaaccatgttatgtcgactattagtgataacaaatgggtcactatctggtgaaaaaatatggtatttcatgatctaagactaccagtctttttctgtttttgctccatcttgaccataacatattcatcaaaccattttcttcaagcaaagtacatgactgttggacctgctataataatatttcactaaaatctggcattaaaaattttaagtatttggagctccatgtactgattacagtttttaaatttgaaataaatgaccagcatcctttgaatattaaaagctgtttccttttgacatttaatttactctctttaaaatgtgagttgtaaagtgatggtttgtcagtgaactagactttttgttttagagtgtgaggacttggaagagtataatgaaagccctctttttggtgaagagagtcaacttaaaaaataaattgccatgttccaaaataatattgtggtaattgtaagtagtgcatattttatcttaaaaactcaggattgatgtaagcactggaatattttatttgtagaaatgtgtatcgcaattacttaaatttatttttttgaaacagctgcagcaagagttggcacttattcagatgtatcttcaacctctgttattctggtgactgacaaaagaacttgaacctatgttatatgatacatgcataacttgagctacactaaaccacatgacagtgtttagttaattcttgtataaattagtatatctcttctattattagtctgtttgttaaatgccagaccacgtttctatgatctgttgaatgaaccctagacagttctgtgagaaagcagcaattgcacagttacatacacagtcaattaaattttaacattaaagataatttagttttaggtttggcctctgtggatctgtatcagttccaaaatgtggaaagcacgggcatggaaaagtacatttttctctaataaaagaagacaaacccttattttatc

SEQ ID NO: 235693 - DNA, 456 bp, Homo sapiens
atattctgtatgtggagttattcaacttagtttttaaatgtctatatatttgcctagagacaactaactgtcattttattttatttatttttattattattatttgtgcgtgtggcatgaggtctccctctgtagcccatgctggagtgcagtagcgtaatcttggctcactgtaacctcaacctcccgggtacaagcgattctcctgcctcagcctccttagtagctgggactacaggtgtgcgtcaccacacccagctgatttttttggatttttagtagagatggggtttcaccatgttggccaggctggtctcgaactcctgaccaggagtgtggtggtgcatgcctgtagtcccagctacgtgggaggctgaggtgggaggatcacttaagcccaggaagctgcaccactgcactccaacctgggcaatagagtgagactgtgtctcaaaa

SEQ ID NO: 235694 - DNA, 486 bp, Homo sapiens
agaaatcaatgtaaaatatgtatacttgcatatattttacattgaaacaaagattttggcaaccatgcttatttggattaaaaaaaaaccccacaaactgactaaaattgtcaaaacgtagcatcagtttattttaagcatcctgttcacaacatttacaaatgatatgctccatatgtttttcttcaacctccaggcatctattcaggtgaaatccatctgaatttaaaacacatgccctttgctgggactctcacagactcacttctgccccttccggtggctctggtgattgcaggcagggctgcccagatctcgtgggaagaagaccacaggaggactcggctcaatgcgcaaggcccgtgtaaccaccgtaatggtttatgagagtaagcagggagtctagctcttttaatcacaaccacatccttagtgcccagcactctgccttacaaaagtcaacaactttcttgaatagataaccga

SEQ ID NO: 235695 - DNA, 294 bp, Homo sapiens
ctgaaaaactctcctccctttacctctttgtgaatctacagcagtcttttaagattgttttgcaaatgctatattcaaaaagaggttttttttttttcaagtaaagtgcatggatttctcagaagttgctgtattttaagaagtgcctctttaaccccataatgagcaatccttatgttggtcagaagcaaagcagttttgtttgcaattgtaaatcttggctctcctagcccaaatctcacagccatcacccaggatctctgccccatatttccctggaaaatgtcctaagtc

SEQ ID NO: 235696 - DNA, 511 bp, Homo sapiens
caggttcttcatacagcatgttaaatctgctaatgcttgtcctttatctataatggcctataggacttttgggaggccaaggcaggaggatcagttaaggttaggaattacgggcaacatagcaagaccccattctttaagaaaggatatgaaaattagcaaggcatggtggtatacgcccatggtctcagctactcaggaggttatatggctaatgtttgtccttctttttgtctagtcgatagtcatgggacaccaggatatcctgccttcccagccttggctccataggaaagcagtggagagagggaagatgttgctatgccattctgccattctttctccagtggcacaaggatggatcagaaactttgggcctcagaataacctatggtgatatgaggaaatgagaatccagtatctgcatcttatagagatctccaaacataaaatgggaaaggtgaaaacaacaacagtctttccacaagtcctctttttttaaccttttatc

SEQ ID NO: 235697 - DNA, 2957 bp, Homo sapiens
  misc_feature (1058)..(1058): n is a, c, g, or t
  misc_feature (1291)..(1291): n is a, c, g, or t
  misc_feature (1632)..(1633): n is a, c, g, or t
  misc_feature (1654)..(1654): n is a, c, g, or t
  misc_feature (2007)..(2007): n is a, c, g, or t
  misc_feature (2193)..(2193): n is a, c, g, or t
  misc_feature (2324)..(2324): n is a, c, g, or t
ttatttataaaatcagtagagagtactagcaatgcgtcattctattatagagaagcttgtactgtagtgagatgataatctcttagagaaaaggggaaggcaggagaggaagcggaatctgccagcttaaagtcacagcatccaaatacctcaagtcctcactccaggtgaaaggagtctatgcaaaactgtcccaaaaacctcacgattcctgcttctttcttcctccatgtgtcaaggttgaaaggaattctgccacttccacgtgcttctgttgttatatgtaccgtcattattttcctaccttatcccagcccccagctgcaaaacaaactgtcatttatcaaatacttgcctgaccccaaatgctgagatctagtataattttaagcatatacaaaaaagacaaaaacatccctactcaaatgtaatctgtttttgtgtctgacatcaacttttaaaatttattttttaattaattaattaattttttttaagagacagggtctcactgtattgctgggctggagtgcagtggcacaatcacggctcactgcagcctcaagcgcctgggctgaggcaatccttccatttcagccttccaagtagctgggactacaggagcacaccaccatgcccagctaatttttttaattttttgcagagacggggtctccctttgttgcccaggctggtctcaaactcctggtgtcaagcaatcctgctttcatcttccaaagtgctgggattacagtcatgagccaccatgcccagcctggcaccaacttttgagaatctaacatcccaactattggaagaaagctagaagattgctaaaggtcacatttagttaagagtttcttttctttttttttttttggtatcagaaatatgtcccacactcaagaaaaccctgtgaatctgtgccaggccagtgggtcgggattgattggcagggcagagcctctgcccagaagtggctggctgcatttctgcagtcttgcagcctgagcgccatgctcctggtcaaacatttagcacttgctgtggccatgttnccaccagacagaaacagagaagacaagctgtaaagaataatggccagccggagcatggtggctcacgcctgcaaccccaacactttgggaaggcaaggcgggtggatcacttgaggtcaggagtttgagatcagcctggccaacatggtgaaactaaaaacacaaaaattagctgggcatggtggaggggcacctgtaatcctagctattcaggaggctgaggcacaagaatngcttgagccagggaggcagaggttgcagtgagctgagatcgtgccactgcactccagcctgggcgacagagcaatattccatcccaaaaaaaagaaaaaagaacaatggccttaaaatgaaatacactaaaattgccaaaatgataccgtatcctcctatataaaagcaatgtaaagcgtggtttagattactttagacaatactatgacacttacagtataagtctaaagacttaccttaaggataaaatgagataggtataggatgtgtattaattgtttcataagccatatagatatgtacagttattacagattcaattttttttaaaaaaatacgnntgtagctcacccttagaaatnagttaattatgaaaatgtgtgaaaatatagtcacaaattagcagatgattgtttatcttcttctttgtaaattgttaatcattgctatcgtgagttttagatggggctctaattttttcttagtaaacaggaagctatttagagcttggtttgtatggtatcttgaaaaaagtcattctgtatatgatagtatacagaaaaatgcatgaacaaactcctagccatctggaattagaggaaattctctgtttattattctggttaacaatttttagttttccatagatcactttataatttatagaggatgagaatacattgcatatgaaagtgcttttaattttaaaagattnaattgtgagtttctggattttgtattacctcaaagtaattattaggcaattaatcaccattctgcactgttacagactattttaactgatttgaatgtggttaggattctggataaatgagaggtatctataacataattggtatatctgtttttatgtctgttattagcatcctattttgggggnttggcgtagtctaagcaatgtgtctgctaactttttctgtttcatttcctcatggagccttggattaccttttatgcagttaagtcaacattaaaaagtttcagtaggctgggtgcggtggctcacgcctntgatcccagcactttggggtgaattgtggggtgattcaccatgaggagggtgaatcacttgaggccaggagttcaagaccagcctttccaacatggtgaaaccccatttctactcaaaatacaaaaattagccgagtgtggtggtgggtgcctgtaatcccagctacttgggaggctgaggcaggagaatcgcttgaacctgagaggtggaggttgcagtgagttgagatagatggcgccactgcactccagcctgggtgacatagtgaaactgtgtttcaaacaaaaaaaaaaaaaaaaaaaaagaagcagcagcttcagtaagcaccggagagccattgcctcctttccacggggaccagctggttccataacagctgcttttaggggcatctacatgatgctctgctgggaggtcacaaggtacatgagctatgctagggcaggggcctgctgtgagttctcttctgtcctccttgggaaggagaagaaggttggttactttgtgtatttcagtttttttgtccttctgtcattctcctgtagcagctgtcgtcacccctttgtcaaacatactagcccaaaatatggactgttagctgataagacaataagtcaaactcttaatcatta

SEQ ID NO: 235698 - DNA, 985 bp, Homo sapiens
gagggtgctgtagagccaagcatggagtacataattttgggtagggccagccctaccttcaaggattcacctgggacgaccgcctggtttgctgccaactccgaagggtgccccaccagcaaattcttttttaaaattatgaagtgcctgatatgtcattgttaaactaatgaagcaaagttatgaataataataatgccttatatctatatataccatttttacagtgctttcacatagattatatgatttcattatattttacaggctgagataaaacttaaaacgtaattattcttacaattttagacagtaggttcactgatctgcttgattgttttattttataaaaatgtactctgtgcttctaaatgagtaataagccattcagactgtgacgtcatcagcatttcagcaggacacttattttgccgaacccattgtaacatggtcaaaactctgttgtgcctaaacgggcttgaatgaaatcttgagattttcccccaaacggatggaaacaaatggaaaacaaaaacagctttgttttctaaagaaaccttgacaaggtcccattaaaacatgtatatttttcctcagtctccctcgagacctccccgatgatcctgctgtctcagcagggctctccaacagccgctttgctctgttcccaagatgacagctcttgctcagcactgggagggaccctcttgtgatgtcaggtgtccctggggccccggaggccattgccccaatagtgtagtctgaggttcagcagagagtgctacctccttccttccttcacctctgccaacgtaagcgtagatataaaaaagcagaaagccagccttcgtctcctctggtaagggcaaaaacactttaatggcaccaatgaattgagcacaataaacttctaatctacattaaatttttaaactggacttttttcaaatttgcttatgagaaaggaataagctgagatttagta

SEQ ID NO: 235699 - DNA, 450 bp, Homo sapiens
ctccttgtttctctgatcctctttctagaagcacctggagggactggactgactctctggaattttcttatctaacaaagcttctttccaaaaaaaaaaaggcaattgtcttaagaccaccccccccatctttaggaatctcatcaaatgaccaggaaagaagcaaagagacggagttgtcactatacccagatagactactcatctattctcgagggcaggtctgacaacctttgtgcaaggtgacgtttcactcctcaccttcccaacacctcccccagagctcagaggaacttttgtcatttactcctacacacctcatccccgccttccctaagaagagagggtagacaggcatctggaccctgctgggttattaggccattactcttctgcaattccccatggtatgcacgttaaaataaacgcatgccttttctcctgttgctc

SEQ ID NO: 235700 - DNA, 446 bp, Homo sapiens
gaaaatgtcatgtcccagtctcccccatgttcctttcccttcatcccactttgtccccggggtctagcatgactgtgtgtttggattggggaagtgaaggcaggaaagtcgcttccccaaatccgcatccacacagggtcttatgttagagttgatgttatctctaggcgaggttatgcaatgtagttacagagacattgtgattagattcaaagaaaatgattttcatcattgaagtttacgcatgtgcccatttcctatttattacattccctggcccagaggacattaggctttcatttttaaaaaatgatctcattatctaatgaataattatatttcatatattttattaatttattaaatgtatgcatttaaaatggcatataatgttaaaactctatgttggctactatttaaaagtatatttactggtaatcttaaaa

SEQ ID NO: 235701 - DNA, 566 bp, Homo sapiens
ctgggattacaggcatgcaccaccacacctgcctaatttttgtaattttagtagagactgggtttcaccatattgcccaggctggtcttgaactcctgacctcaggtgatccacctgccttggcctcccaaagtgctgagattacaggcgtgaaccaccacgcccggctgagactaacattattgaagtgtatcattgctgtttaatcgtgtatcattgctgtttaatctcaaatttgtcccaccttggcctcccaaagtgttgtggttacagacttgtgccaccatgcctggcctccgatttgtctttttgaaacagaattgcttaagaaattgggccctggcatctgtttttgatatgtatctgtgtttttagaaactgtcttacctcaggattatgtagtaagtatatttatgaataaatattttaactttatcagatgagggccaatggcaattccctacctttcataaatttctcaattcagtgccactccttcagccaaaaaaaaaaaaaaataaaaggaaaaacaaattaggatgcaaaatgttgactctggactgaaa

SEQ ID NO: 235702 - DNA, 297 bp, Homo sapiens
caataggtattcatttatttccagtgttggtgtgaaggaacacccacgttttcaacacaaagggaagcagcagaagctcatcgaatctgtggccatgcgtttccccctcacaaagaccgtgctatttgtaaaacggccccatctgtggttcaaatgccttcataaaggaacacgtttgtatggtgcagcagcgtaacttttctttttcttttcttttttttttttttttgagacagagtcttgctctgtcgcccaggctggaacgcagtggcgcgatctcggctcactgcaacctcc

SEQ ID NO: 235703 - DNA, 2659 bp, Homo sapiens
  misc_feature (1271)..(1272): n is a, c, g, or t
  misc_feature (1441)..(1441): n is a, c, g, or t
aaaaatacatgattaggaagtgcatttggtgcattcgagccactgggctgcttctaaagtggttgctctggggaccagagagacttgttatgcctcatttgggtatcacatgaatcagcacacctcaaaaattattccacagtttggatgttagtattaggtattatataagaatttcccataatcaaataatattgagaaatgctgatttttgggaaggcacaacttttcccaaacttctactgtgctcctgtgcactgtgaatctgcagaattggcccttcccaaaccctttcaaccacagcatcctcctctggaggccagcatcttgcaagactacttattccttgaaatacactgtggaaaaaacactgatgtcaggggatattgaaataaactcactgcatgcggcatacccttcaaagacatttttcctccctttggaacagttgaaattcaaatgacatatcctagcatgatttgccacatgggttgtgttttgaaacccaaatctaacacaacaaatttcagatagagctttgtttagcccccaggccagtttttggtcccgtggataagggttggtatccagacctcttagagcttttctgcatcagctttccagggcttattcaaaccctccatgtgctggaagtccctcaccctttatgaggcacaggaggcgatacgcttgcatctcgatctctcagcctcggctcatgctgttctctcctttctcatcctgtgttccagccataggaattctgttcattgtgtggaaggctacgcacccccacatccccaaccttttgtacatgtgtttcctctatcgagaatattctctcctccaccttttactctcaacctgatgaccccatacttaatctttcaggacttggctccagggccacgtgcttccacagtattttctcacttgtttgctttatgcagtttatttattgagacataatttacatagggggaaatgctcagatactgtctactgtccagtcagttttgtgggaagaatatcaaggcacagagcactctgtcaccctagaaagttcccatatgcccctttccagtcaacccctccccttcaaagcagcgactcctctgcaatccatcaccatgggtgaatttcgctgattctagaatggaatggaatggaacactttgtgccttttggggcctagcttttttcactcagcatattatttttgagaggcaaccatgttgttgcatgagcccatagttggttcccttgtattnngtttcattgatgaatattccaaagtttacttatcccttccttgttgatggacatctggcttatttctaatttttggccagtctgaataaagctgctataaacattcttgtacaggattttgtgaattatgtttatatttctcttggattaatacttaggagaattgctnctaggataggtgtctgtttaactttcaagaaactgtgcaacagtttatactgtgaaatagtgattgtcctgactacaaacctccatggtgctgagaccaggttttgttcaacgtgattttcctggtgtccagcccagggcagggcacatgctagacattcagtgtttattgaagaatgaatgaataagaagttcaaatcagttttcattctgacatctctactactaactgagaaaaaatgaatgctctgtccatcaaggagatggaaattttattggctaaatgtgggctgattataggcaggcaaaaacaagagagacatagcttccttcttactgtgctcttggacttgcctctctcgtttcagggtggcagcatgtgcaggtaaaatcaggtgtgcaagttgacacaggccatagaagggtcctgatcaccagtatagctgagctcacctcctgcagttaaatctcccaacactcccattcaagaccctcccaaacctcctttttcatccccccctaccctttggttcacctgcacaaatacatgtttcagccaaacttgacaactctccctactttgtgacatcttgcattctctcccctttgcaatggccacagactccacccagaaggcctgccacatgcagccacagccatctctttctgtggacaccctgggcagctttcaaggctcagttcatgtgctttctcctctctgaagtgttccttggccaccacatctggaagcttgctctctttggagagtctttgagatggtgtccacctgtggacaatgttcattagccacttagcaggatattctgcttttattctacttgtctgtgtatttctgctctgtgaggtaataggcttcttaagggacacgtatgtagtggccctcagcagtctgataggagctgaggctgctggccactaagtagctgatgctagtcttcatgatccttgctcttgatggccgattccattaaagaggagttaattacatggtaatgccatagctccttcttaagaggaggctttagtacaaacttgggaattcatgtcacctggtggacaattgaaaggcagctgctttcttggccaggtgcagtggctcatgcctataacctcaacactttgggaggctgatgtggaaggattgcttgagcccaggagttcaagaccagcttgggcaacatagcgagagcccatcact

SEQ ID NO: 235704 - DNA, 614 bp, Homo sapiens
  misc_feature (614)..(614): n is a, c, g, or t
agccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttattttgtatttctacccagtgctaatagtgagtgtaccccn

SEQ ID NO: 235705 - DNA, 198 bp, Homo sapiens
aggctagattaagtacatcattattcatccaggcaagtatacttctgttctacctaatgctgtatctatgtcacctagcaaagtatagtaatccaataataagtgattgctggctcattcaatgatgatcataaagatataggagactactggagttcaagaccagcctgggcgatgtagtgagaccctgcctctcca

SEQ ID NO: 235706 - DNA, 1035 bp, Homo sapiens
tctcccgtacaggtagggctccccgggacacagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcgatatatttaaatggataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttttttttttttctttttttttttgaggcagagtctcgctccattgccaggctggagtgcatctgagcgacagcaagaccctgtctctcgaagaaaaaaagaaattagaagaaaaagaactcatcttgatgatgaagcacaaatatgcatctgttgtgtggcactttcctggcgtgggctccgaggggtccgtccaccaaggagcccgcgtcccagtctccaccgtccagc

SEQ ID NO: 235707 - DNA, 370 bp, Homo sapiens
ctcctgataccaaaatttattgccttaacctctaccctgagttcatgacatatatttggaaccactttcttattctcctcaaaatcagttccttcctcaacccaatgaaatgacaccaccatccagccagctgcttagactaaaaacccagaggtcattcttgcttctctccacccacctatccaatccagtccatctgagggatactggctccacctccaaactatatcccagatttgcccatctctccaactccagtgaaaccaggtcttctaatattctaataaaagctgaaaattcagaatactcccatttgacatggagacttatcagctactgtcatttagtaagtgttcttactttcagaaac

SEQ ID NO: 235708 - DNA, 343 bp, Homo sapiens
ctaagttagatagatacactaagaggaaaatgacctttaaatataaataattgtattttcccttacctccaggctattctgcacctaaatttgtttcaatctgttctaaatattactatagatgacaatattataatctttattggtcatatgtacccacagtacaggggaacatttactatcatgttctctcttttctcagttattttctttttctaaatccagtctctttcttgtagttatacaggtgtttgttttataattattttcttaaaactctacatatatgtttttatacttttgtctattattgcatattcttaataaaaaagttaaaaactcg

SEQ ID NO: 235709 - DNA, 135 bp, Homo sapiens
tgaaggcaaaggagaagccacaatagaaaaataatgcaggggtaagatgagctcagctctgtaggctcgctcctaacactgatcctctgctggagtcactctggctggcctgctattctgtgaaaatgccgggca

SEQ ID NO: 235710 - DNA, 399 bp, Homo sapiens
tgtatgctttcacttatatgtagaatttaaaagagttgatctcacagagacagactgtagaatggtggttcatagaggctctgggttgaggaggtatgggaaaaggggagaggctggtcagagggtacaaagtttcagatagacaggaagaataagttttagagagatctactgtacagcatggtgaccatgtttataataattatatatttcaaaatcggtaatagatgttaaatgttctcaccacaagaaaatgataaagtgtcatggtgatagatatgttcaatagttttgatttaatctttctataattttatatatatcaaaacatcacattataccccataaatatatacaattataatttgtcaatttaattaattaattaattttaaaaag

SEQ ID NO: 235711 - DNA, 1432 bp, Homo sapiens
catttcacttaccatttcaggcaaagttggctaagaacatgaggctgtttctgatatttccttttatttttatgtattaatgagaataataggtataggccatatacttattagagactctcaatgacttatacttattattctcaattcatattatatcatattatactcattgaaaataagccatatacttattagagacttatttagagtcttattagagacttattaagagtctctaataagtatatgggttgtcaagctagacacaaaatagtaccatctctctccacctctctaaagaggaccacatcatctccaaatgtaaatagacaagaacaaaaaaaattgtgcatttactaggcaattgaatgttctccaaaccaatattcctttgaacaaaatgagtttgtttgatttgagaacaatgaagtatttggctattttataatcataagtgattcatacccccacacacttagccctctagaaatggtgccagaagatgaaacacatttaattttgccatatagaagcattgcaaataactactggtttctaataatgtaccttataatgcaaataatgttttaatttttaaaaatatcagaaaaagtacaaccttttaaattatgtagttgcttcttcttcataatcatttttcttgaactggtgaaaaattttgtcagaagttaccacttgggacatattgtactacagcttctcgcttggctggagaaactggttttccagaagcagaccttatacaagaggtaaatgaaccattagacttctcccatgaaatcaacccagaaaaataaattaggactattttgtagaggaacagacagaatgctagaggctcagttgcctttatcatttatgtctggctctgcagcagcaggggtgtgaggtgctcctcattcagagtttcgaatgcaccaaaagggtgtttccaaaacatgatatgggaaggaggctgtgcacagagtatgaccactggattgcctaaattgacattgggtaggagtggagtatgggtgatcttcagatgaagcaagagtaatgctcaatgtgacctggttaaacaagtctcctgaatccaggggttaaagatggagaggaggaagagagggagtcaagaaggtcaaagggagcgtctgtctccctgacctgaatgacaactaacatagcccttgtttccttcttggtccccaggagggagagagaggcagctgtgtgggatcaaggcattttgtgagattgcagctgtgattcattttcctttggaagaacatccctagctccaggggatatggtgggaattggttagctaaaatatcaattccctgggtaaaagaggaaaaccatgagaccctctaatcttaacttttctccttcaaaagagtggaaaaagattacatagttcctc

SEQ ID NO: 235712 - DNA, 456 bp, Homo sapiens
agtgtagtgctttggattttatatgctattttgttttttcctcatgaaaagttcaagttttatgggattagtcttatctccatccaaaagatgaagaaactgagatgtgggaagttattctaaagcctcagccctttcccagtacctcgaaggcttgcaaattaatggtacaaaaggtataaaaaggtttatagaatttatgagactcaattatttttaagaaccataagcagcattcatttgttgaaaagtaaagtgatcttcgcaactagttttttttttctttttgaaaataagagccaaggaagagaatattcaaattggctagtgtgcaagtaatttcattatccagcttgatgtgtatgtagggagccagggcattcaggtgagtcagatattctgatttaacagtgggtggccctgtggaacacacacagattgtatactttccataaa

SEQ ID NO: 235713 - DNA, 603 bp, Homo sapiens
gtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatgctga

SEQ ID NO: 235714 - DNA, 1598 bp, Homo sapiens
atggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtagggcctggggaaagccaggatggcccgaggaagaggcagaagccgtgggtgtgcctagggcctacttcccaaggtgccacaggcccatgatgggatgttgaggggcctggactttgatgctattgctgccaggtcttgctgtgtgaccttgggtaggttgcttctactctctgggccttgttttctcctctgtgactcagggataggagtcatcagcctggatgagctatgtcagatgagaggtttggagggcactgttgctgggctgacctggctgagcaggcaaaaggtgggtgcagactggcctccccccagggatggagtgtcttggggcatcaacta

SEQ ID NO: 235715 - DNA, 158 bp, Homo sapiens
ttctcaggtacattcttagcagcaggagaggctaattcgttagaagaatgagacactttaacaaggacttcaggagctgaaataattaatggagttcactaaattcctgtattcacaccaagcctcctccttctggaggaaacatctttagaagtagt

SEQ ID NO: 235716 - DNA, 503 bp, Homo sapiens
agttacaaaagtgaagatggtgaaatttatactttatattactgctgagacagtctgaattagtcacagggcaattttttcctaagtcagttccatttgcttccacagaaaataagaattttagctttatcagagaaatgggcagtgaaactacagactcagaagccagtcacaaaagaccatatactagatgattcttttcatatgagatgtctacagtaggctaatttatggagacaaaaagcagttttggggttgctagggtaagggggattggagggagatgaggagtgactgtttaatgggtatggggtaatttttggaattgagtaataaaaatgttctaaaattgactgtggttatgcttacacaactctgtatatactataatcaattgaattatacacttcaaatggatgacttgtatggcatattcattatgtttcagtatagctgttaaaaaataagatgcatgagcctttgtagaacatgtcaatagtatt

SEQ ID NO: 235717 - DNA, 202 bp, Homo sapiens
gctttttaaatgtgttttgaatgagtatctcaatattttaatatcattgaataatcagttttatctttattaagaaggccattatggcccattcccatttttaaacacatagttttatatactcacttaaaaaaactgcggtttccacatctgtggattcaaacaactgagaatcgtaagtatccaaaaaagtaagtattaa

SEQ ID NO: 235718 - DNA, 426 bp, Homo sapiens
gccccaaaaacaaagacagaaaaaataacaaaaaaagaaggaagatgtgaaactcatgtggtggtgtttcagagagagagagaggccttaggaattaagccatatcgtgctagatgctttccagaatctcttctttaggccgggcacggtggctcacgcttgtaatcccagcacttttgggaggccaaggtgggtggatcacttgaagtcaagagttcgagaccatgctggccaacatggcgaaaccccacctctactaaaaatacaaagattagccaggtgtggtggcgggcacctgtaatcccagctactcgggaggctgaggcatgagaatcgcttgaacccgggaggtggaggtcacagtgatctgagatcacgcgactgcactccagcctgggtgacagagtgagactcagtctcaaaaaa

SEQ ID NO: 235719 - DNA, 415 bp, Homo sapiens
ttttaattagaaagaaaaatgtctaatgttcccagtagattataatatgtaatattccctggaaaccaagcaacaccatatatctgtaaattatccatccgaataggaaacaaaggcatcccagatcatttaaattcagcagtaatccccaaagctcaatttaggcatggttcttaatattctactccaaaacttcaatatagtttatttactatttatcttctaacagagtgaatagcataaaataagcaacttgaagaagggaactctaaaggaattaaaaatgtaaaatgtaggccaggcacagtggctcatgcctgtaatcccagcactttgagaagccgagacaggcagatcacttgagtccaggagctggagaccatcctggacaacatggtgagaccctgtctctaca

SEQ ID NO: 235720 - DNA, 449 bp, Homo sapiens
aggctcacttgagcccaggagtttgaggttgcagtgagctatgattatgccactgcactccagcaagaccctgtctcaaaaaaaaaaaaaaagagaaagaaaacatattcataatgtccaaaagcttccctgtgctctttgtactccctcttctttccttcccatctcccccacaccagggaaccattgatctgctttctatgattatagaattctagaattttatataaatgaaatgtatagtatgtgctccttttgggagagggcggtatctggcttctttcactcagcttaattattttgagattcattcatgatgttgcagtaacagtagttcattttcattgctgagtgaatatacagatacactataatttgtttagcctgttgatggacatttgtgttgtttcaaatttttggttattgcaaatatagctgctttgaacgtt

SEQ ID NO: 235721 - DNA, 894 bp, Homo sapiens
ggagatcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcactttctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaagaacaaagtacctgggcccaagggtctcaaagccacggcctctagtccatcaacaccatgagctaaattgcactacacaccccagttcccctagaccttagaaaacacacactgaactggtaggttcaacctggacaagcttacagtgtaaagagccgacagggagttgcaagctgatgactagcttcaattattgccaacgtgatctgctggggcaagctggccttcgggatgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctac

SEQ ID NO: 235722 - DNA, 840 bp, Homo sapiens
ggagatcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcactttctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaagaacaaagtacctgggcccaagggtctcaaagccacggcctctagtccatcaacaccatgagctaaattgcactacacaccccagttcccctagaccttagccgacagggagttgcaagctgatgactagcttcaattattgccaacgtgatctgctggggcaagctggccttcgggatgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctac

SEQ ID NO: 235723 - DNA, 450 bp, Homo sapiens
ctatttttaagtgggattttaaagaagtaatatcattttgacttttacaggtcataaccactaggcatgtgttcttcaaccagtgttgttttataaatatatgaataaaacaattggcatatcaaagaatttctttttgctcagaatactagttcactttaaatagctaaagtctcttacattctttttattctgctaaaagttttaatgatctctctatatatgatttttaataaaatagatgatgacatttaaagcagttaatttcagcagcaattctatgagcagtttttgagtattccccagggacccggtcttgtgatagattctggggctgtatagccaggtgaaaagatgtgggtccttactctcaagttgctgccagtcttctggagagacaagcttggaaacacaatgtgtgatgaagggaacaagagaaccgtgttccag

SEQ ID NO: 235724 - DNA, 416 bp, Homo sapiens
aagggaaagggccacaaaactgtcagacaagatgaaaaatttagatctgagcttcctggcaaccaaggaaaaatattaagcaacacagttacataattctcatttttagaaaagacaaaaaaagatttagttaaaaaattagaattatggccaggcgtggtagctcacacctataatcctagcactttgggaggctgaggcaggcagattgccttagctcaggagttcaagaccagtctcggcaacatggcaaaaccccatctctattaaaaatacaaaaaattagcccaacatggtggcacatgctggtaatctcagctactcaggaggctgaggcataagaatcgcttgaacccaggagggggaggttgcagtgagccaagatcgcacctctacactccagcctgggcaacaga

SEQ ID NO: 235725 - DNA, 384 bp, Homo sapiens
agcctaattcagccttaagagatgagaaggctgcttggaaagaaagaaaagtctgagaaagcagaccgtgcatgctagtaagggaacttgacattccttgctttagtggggaaaaaattaatttgagaaaactctgctattaagaaaatttcttcagagtgaatcttattttcctactagcaatcatcataaaatcacaaattacattgctatgaagctgctagagccttgcctaaagagctaagaacagataatcactttagacaaagactttacaaataaaactgtaaccccaaacgtctgaatccagtttggacaaagaaagacctaatgtatcaaactgttaaccccaaactacaataaaaaacactaagcttaaagaaa

SEQ ID NO: 235726 - DNA, 462 bp, Homo sapiens
acagataggcgcagagaggccaagtgacttgcccaaggtcttttgttaggacggctttttccgattggcaggcactttcgttgtgtgttcctcaaacatctttattttagaagtgagaaaacttgtgcctttttttgcagtttctcttttcctgtctgtctcctcaagtgagattttatgtgggaatttttaaagattggcgtcgccttgtagaagatgcggcttgtaattgaggccttgtaccatttactggatggaagcgcttgtttggtcacctgtccagcatgacttaggtcacttcagctaatcaaccaatcatttcttttcttttttctttttttttgagatggagtctcgctctgtcaccaaggcggaggttgcagtgatctgagatagtgccactgcactccagcctgggcgacagagcgagactctgccgcccctaacgccccgcccccgcca

SEQ ID NO: 235727 - DNA, 521 bp, Homo sapiens
gcagtttattaagtttcattaaaacatcacatttggataattagtgagattgcattgagtaatagattaatgtaccatctttcaatctgggaacatggtatgtcttttaattgattatatatgtttagtagatgatatttcagccaactttcagcataaaaaatcaaagtcaaacaacaaaaatgttagtgtacctaaaagcctttctgagaacatactacatgcaagtagatgaaacaaaatccagaataatttcatagaaatctttcaggatagacaatcacttggaaactacctctgccataaacaggagcaagggtaccttcgggaggggattaagttaaaagggatgatgtcaatttttagatcatacattcatattccagagagaataagaaatcgacatgtcctataaacatctgttctaaatccaggtaaaatacatttcagagaaacttgttttggtaacacaagttcctgcttttctcccaatcagaatggtggcactcataatctcacat

SEQ ID NO: 235728 - DNA, 366 bp, Homo sapiens
taaaacccacatagatgtcccattttaaggatttttggaaagggatgaaaatgatatttgattttaaatttcatgagataattcctacttcctcaccactgtctcacccatattcttcctgcagtgtttccttaggagtccactgcacaattccaaaatccctagctaattgaaaagaaatgtagaatagtgtctgcatttctgcaccttctctaaaccaataaggaagtaagagataattgacaatactccgaaaagtaggaaaagtttggcttaagggtccagagtaggggttggccagatagtaaatatttatgaggctttgcaggccataaagtctctgtcacaactactcaattctgccat

SEQ ID NO: 235729 - DNA, 422 bp, Homo sapiens
ggcacgtgcaacaacagagttaggaaactctttctgcaagtaaagttaacttgattacagagaatagggtagttctttattccttgtcatcattgctgctaccacttctgtgagttataggagaaagactagactttggtagcttagatgtatcttaagtgtaagtgggttttcatatggaccattacagtttacttggggtgttttacaaaatgataaattattgaagacatttaaaagtactgtcaatgcaaaggcagaaatgtaatgtgtgaactgtaatactgtaatcctctcatatcaaataattaagatttaggggtttagacttttaattcagtcaaaggcacacaatgtacaaatttagaattttccctcaaatcatctttaaggatagatatgtcatagtggtttgttagttt

SEQ ID NO: 235730 - DNA, 391 bp, Homo sapiens
taggactcccaggctaatccagatcttctcagagccaccctaattcaatacactcccatcttccctgaaaggccaggggtccccccaccaatcccaaatcccctcactgtctcctatcctcacgatctcacctgggtgcccctgtcccatcctctttccaagagcacagactccagcccgatggcctgggttcacatcatcactcctccacttcctaggtgggctggtcacctcgtctctgtgggcctcagtttccctatctgtaaactgggggggcggtcacagtaccatctagtcccgatgattatctgtcacaaagatgaagcaaggtggctcagggaacgtgctcagaaacctccctgctttccatcttgtccctggccctccccga

SEQ ID NO: 235731 - DNA, 360 bp, Homo sapiens
aggctggagtccccataggctactgggactcgccctgcttggaagtggacgaggcgtttctccggccctggctctcctggccttctccagcccaatgtgtgacccgctacagccacctggtgggccgcgggggaatacagcaacgatttcaataaaccccaggacataggccctgccgggaaaggagtctggggcctggcatggtctagattccctccccaaggactgcccagtccccttccccctccatcctcagttccctttagtaatagagaaagccgtcccccgtgttctctcggctgatctatagtaggcgagggtgggcatggaataaaacgaccgcttctgctgctttactcc

SEQ ID NO: 235732 - DNA, 419 bp, Homo sapiens
gaccagtgcaaaggcttttatatggaccaaccccagtcagaaagcaggcacttggaaacctcgtgtctgtgaagaacaaggggtggaacctctgaaatcctcccctttgagatttcccatgcattcacacatccttctgtgtgccttgaaaatgtaagaaacagatgtgggcaagaggcagccagaagactccggcacaggccctgcaacctatctgctcacatcctgcttgggagacatgtcagcgataaactccaggagtagtcacgagggctgacaggggttcctgcccggctctgcatccaacagcctggtggagcctaggctaagtctacaaaaatacggagctcagagctcctacctagatttctttgctttattcaggcagaattgacaaattaaaaggtatgtatttaagg

SEQ ID NO: 235733 - DNA, 169 bp, Homo sapiens
gcaatcaaattatgaatgtgccctggaaagtagtcttgagtatctgtcactggaatttgtataaatcactgttgacaacacaaagtgctttcacattatattgctgctattcttcattttcagtgtaatcaaaattcaattgcatttgtttgaccttaaacagacctta

SEQ ID NO: 235734 - DNA, 498 bp, Homo sapiens
cctatcagtatttgacttcagattgactcgtttatttattcttaaactcccttgaatctccaggcttttttcttatttgcattgagtatgttctccccattgacattcagatcactttgaattggcttttacttaggcttttcttttttggagacaatcagctcagagacaaaataggcttaaaccacaaagatgttttagtaaatagatacatttcattagttgctgagggctgtaggaacacagttgtcccaagtaatttcttctttgtatttggtgatcttaagaggaaatattagtgtcctttttcttaagccactggtctaaaatatctgtcaagcataagatttaaatccctgacaaacaacttctaagattttagaaaaagttttgagtaccttgtgattccaactcttatctctgcttttgagcctcgatttctaccccctcgtcatagtccttacccacctgtaactttaagacatcaaagttcatttt

SEQ ID NO: 235735 - DNA, 394 bp, Homo sapiens
ctagggaaagagtattccagacagagaactgccagtttaaaagcctagaagtaggataatgcttggcaccctcaaaaatcaagcaagagtggtataaaataagagggtgacaagagatgagctcagagacatagttggggcagatcatgtggggccttttgggctatgataaggactttggattttcttccccagtacagttagaagccactggggaagttttgagcataagaaagttataatctgacagggtttagacatgtgactatggctgcactatggactagtgaatagaagctgagaagttgatacagcagttaagaggctattacaatagcccaggaaagaggatggtagcttggactaagggaaggacaacgaagagagtaagaag

SEQ ID NO: 235736 - DNA, 381 bp, Homo sapiens
ttatttaattaatttggtgccctctctactggctttcttttctttatatttggtatttccttatagtatctgaatgaaactctttctatattataatatagaagaccacttctgatgtgttaccaagttggactggaactaactctgaatgtactgttttgtttggaagaagttatttaacctatttcctttatgtgaggatgtgtgggtttgggaagtttaaattaggaacaagctgctggttttcaaagcttctttctctgtaaccaaatggtgaaaaaatgccttgtaagcgtgattagcatggtatgttgtaagaaatagttcatttccatatgaaacagtttacttccagctgcagcccgaagtgtaggagccttg

SEQ ID NO: 235737 - DNA, 141 bp, Homo sapiens
tcagaaaagcaggaattaggcaggcaagttttcccttttactttaaaaaagtttggtgctatgtaataatatgtaaactttacatatatttgtaagttatgaagcatacaaataaatgagtgaacccacaatccaaattaa

SEQ ID NO: 235738 - DNA, 646 bp, Homo sapiens
attcttgttatagtgaagaagtctcacaagatctgatcatttataatgggtttccacttttgcatctggatcatttttctcttgccaccaccatgtaagaagtgcctttcacctcccaccatgaacctgaggcctcccaagtcatgtggaaatgtcttttattgggtgctggttcttaactctgaacttctctacaagttttgtcaaactatcaaatgcagagcaaattggaggcctgtcagagcacccagagggtggaatgaagcaacagagaggcatcaggaaaggagaacacagatggagacagagatgggaggcataagcaccacctactggcacaggctgtgcacttgcacggataggagagctgaaaagttggtcatggatggaaataactgctggtttcacaaatgaggaggcagaaaattccacttaatttcactattacaatgctcagaagaaaaaaaaaaacaaaacaacttggattactgagctacagaacacccagactcatagcactgggacttccaggtcttaccttacgagtgggtcacaacactgacaaaggggacaatatccattagccattatcttgctgcgtatgaataaccctctctcacaaaaattaaagataaatacggtcctg

SEQ ID NO: 235739 - DNA, 197 bp, Homo sapiens
gtggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaaaaaaaaaaaa

SEQ ID NO: 235740 - DNA, 1143 bp, Homo sapiens
ttggccagttggaaatgagaattggttgtctccaaccctgcaagccctagcatttctggacatttcctattgccttccatttttgttttgcaaaccacaaactcttgagctcattttttcttgtaatactttgtcaaactcagccaataacaaccagctcacactactaatgttatgtttccagcctcttctcataacatcacaagctcatgctttcattgttcatctttcaagttactgaaggcaatagtttcaccaaacagttcaccaccaaattacatgggttgccaccttgccaataagtttcttcactgcctggcctggatgccagtgtcatctatttttggctttttgttatggcagaactccactgtgagtaccagttttttaaggagtcagtataggctagttatgccatgatagcaacagcaaaccctcagagacttacaccatgaaaggttccctcttgcccatgttacgtgacagctgtggctttgcccacatcttcactcagatcatttgccatttgcaaggcagacaggaaaggacaattgcagaacccccactggctctgaaggcttttgctcacctgtagctcgtgtctttcacgttcagtttgagaaagcagatgacatcgccccacctggggcagggtgaggcagaagctcaattctttagggagggtcagtggatattttggacaaataatataacctatcaaaagaggtcactatagtagtgaatttttcatgtttgattattttggatgattttatattataaaattgttacttcagcttttctgtggaatcagtatctaaatgggatttgatttttaaatactttggtgtaaaagtaacaggaatttgtagtacttactttcacctattttgctctttagtggattgccatacaatataagctaaatgggaggtgttctaattactgagattgaaggtgacaggatagttctggccaggacctgtagaataattatgctttataatggtgacctgggatccagggtctcatgctcagctttataaacttaggaactgaataatgagtaggctttgggggaaaggatcatgctagtcaaacgcacaaaacttattgtttcatcataaagccacttgtgattta

SEQ ID NO: 235741 - DNA, 732 bp, Homo sapiens
cttggaccctgagatcatcctgcaggtattcaaacggctcttctacatgatcaacgcagtgactcttaatgacctgctcctgcggaaggacgtctgctcttggagcacaggcatgcaactcaggtacaatataagtcagcttgaggagtggctttggggaagaaaccttcaccagagtggagtagttcagaccatggaacctctgatccaagcagcccagctcctgcaattaaagaagaaaacccaggaggatgcagaggccatctgctccctgtgtgcctctctcagcacccagcagattgtccaatttttaaacctttagcctcccctgaatgaatttgaagaacaggtaacagtggcctttatacaaacgatccaggcacaactacaagagcagaatgaccctcagcaactgctgttagatgccaagcacatgtttcctgttttgtttccatttcatccatcttccctaaccatggagtcaatcccagcatgtctcaatctggagttcctcaatgaagtagatgcatgtttagtctgattcccaatgtgagcaaaaaggaagtatagacagtaaagtaaattcaaggatctgttaaatctggtaaaagtagatcaaatcagagattgacagcctgtggagggtgctgaactatacagaattaacacaactatggcgttattttttgtacgtactgctcagaataaaaacacttgaaatgtggaaaattt

SEQ ID NO: 235742 - DNA, 399 bp, Homo sapiens
tgagctccgcttccttcctctctaaaatgggaagattagaccaaaataacaagactgttttaaggttggaatcaaataaggaaaatttgtaaagctccttgtatgtgataccagatccacaattggcagataatcgcagcaggagcctcttcggggtaatcagatacgcggcgcagcaggggtctcagggccacagccaggggggcggcgggagacatgcggaatcgcagcggaaggcgggaggcagctgtgaactgtggctcggcctgcgtccgccctgcgcatgtacactcagagaagatgataatgaaaaagaaagcaaatccaattttcccacttactgttcatataatacagagtccctgagagtctagagtaatgtctcatacaaaaaagaaa

SEQ ID NO: 235743 - DNA, 306 bp, Homo sapiens
catttcaaacaaaccgtaaattcttcccctttcaactcctgtccatgtctttccctttgggctgctttatgtttcttcctatcaccttctgacatgatgtgatgatgtctgatgttacatctgactctccgggtgctgccggcagtggcagcttcagggggacagaggctttgcaagtcttttgctgcttccttccctgtgtctagaatagtgagttgtctggtgccttgtaggaactcaatcaagatttggtgaatagtggcactaagccattcactaaatattaaattattggacaacctatga

SEQ ID NO: 235744 - DNA, 711 bp, Homo sapiens
tttttttggagatggagtcttgctctgttgcccaggctggagtgcagtggcgcaatctcagctcactgcaaggtctgcctcctgggttcacgccattctcctgcctcagcttcctgagtagctgggcctacaggcgcccgccaccacacctggctaatttttttgttttgttttgtatttttagtagagacggggtttcaccatgttagccaggatagtctcaatctcctgacttcacgatctgcccgcctcggcctccgaaagtgctgggattacaggcgtgagccaccgtgcctggctgaaatccattttttagatgagaaaactgaggcttacagagatcagatggtttgtcctcagcctcattgtagctaacaaattcaaggtcaaatgtatacctaaattatttggctccacatttagttcaagtgctctttctgtacaaggctcccactggatggaaaaatctggctattattatttttctcttaactctccaatgttcaggttaaaaggacaatgttttaaaaaagtatgggcccatacttaataaatccttacccaacgtagttgaaaatgtttttagcattttgattctttaggcgaaatgtatttggcaattccctcttttaaggaatgcttcagatgtttgttacaccttatttgaatgattggcataaggatgtatataggaggggccataaactgcca

SEQ ID NO: 235745 - DNA, 278 bp, Homo sapiens
tcaggcactatgatgagcttagggataaaccagacacagtcttttccctcaaggagctcatagcctagtaagggcagtagttcccaaccagggctgcatataagaatcacctaggcatctgggctccacttctaggcagtctgtttatatggtgctgaagtctgacctgggcattggtatatattttttggaaccatcaaggttattctagtgggcaagaagattgagaatcactgagttaggcagctgggtctacaatacattgtcttataattaaa

SEQ ID NO: 235746 - DNA, 335 bp, Homo sapiens
acatgtcccgcatccatttggcttgtgatattctggaggaggatgtgtgaataccgttttttcttccctgcacctgccttcctaatttgcttagaatgtccttaccaaacacgacatatcttagaatggacttcctaattttcctcatcatatagctaaagccagactaatgccatgtaacctgtagccattgaattcctgcacatgcctaacctaaggtgtaaaaacaatttttagcaacgtaacttaacattattaatgaatggtagtatttatactatctgaaatgtggataacaaccctaagcctaattaaagacctttagctaataatga

SEQ ID NO: 235747 - DNA, 826 bp, Homo sapiens
aagaaaaagtcttgtggcacccacaccgagaagatgctaagcagagatgtgaggaaacaaagctgagaattgagggacaatccaagggaaagaagtggactgggaaatcggttctcctggcctggaaaagacacgtcaccacaggaaaaaatctggctccagagaacaatttattttaatatgcctcattttgctatttcattaattcagaaatacttggcctttttttctactgttactgtggaggcataataggaaatgtaaacatactggtacaaaataagaaataacttatttatatggcaggaagactagaaaaatcacagccattttcttcttcttactataagctctaattttccatgatactgctctacatacaggatctttatttaaaaaaacctgaagtgatgatattacattgccacatcaacatttgaaattaaatgatcaatgggtgatataaaaatggccagcacatggtacattttgtaatactttaagtcacattgttgagatccttgataaagatatgatttgcttttaatctggcaccatcatttattttgggcaaagctagaaaacaaataacataatttgcataatgaaaccattgagagaaaaatcactgtaatttgtcagaggtatctgcaccattttgacttacagtttaaattcattcaagtttatttctttccttaccccaactaaacaatgcttttgatttattcttgccatttagtgtcatataaaataaagtgttccactaggaggagaaataatttgtcaagtagaaactatattaaatgaaacattctctctgata

SEQ ID NO: 235748 - DNA, 343 bp, Homo sapiens
ccaccggtgaaggatggcagctttacagctccccgacgcatcagactaaagaacgttggccagggtctgcaccggtggttctcaaagtacagtccccagatccgcagcatcagcaccgcctgagaactacttagaaatgcacattctcggccctggataggcagctctggcagtggggcctagcagcgggtgtttaaacaagccacgggtctagacgttcctttctgtttctaaaagaggccttgctttcctaagacagttgctgtgaaccagctttttccttttgctgtcttgcccctgcaagtgtgaaatagaactttgacccgtgctcgaaattactttc

SEQ ID NO: 235749 - DNA, 817 bp, Homo sapiens
  misc_feature (97)..(97): n is a, c, g, or t
  misc_feature (99)..(99): n is a, c, g, or t
  misc_feature (133)..(133): n is a, c, g, or t
  misc_feature (138)..(140): n is a, c, g, or t
  misc_feature (152)..(152): n is a, c, g, or t
cttgcctgccggcacccagccaccatgtgggagctcgtggctctcttgctgcttaccctagcttatttgttttggcccaagagaaggtgccctgtgntngtccaagttttaccccaatgatgcccctttcccnttggnnntttccccccccntttgggcccccccgccccccattttggttggttttggggtgccaaaatgggccccccttttggtcccccaattttttccctttcccctccaaggacccgatgttggggccccaatttattttgcatttaaacaaaactttcctttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatccccaacaaaaccctggaaaaattaaagagccatgttaaaatacgaaatgatctgctgaat

SEQ ID NO: 235750 - DNA, 426 bp, Homo sapiens
ttaagacccatctggtattatctggatcccttggcctgaaatttttgagtgaggttagggttttgcatttctgaatcgaagcaactattgattagcctggaatcccgacctaaagcaaaggaaatcacaagtatgaaggcgtcgtcagtcggataaacactagtactctgcatgtgtaaagccactctcgtctcctgaaaaaaggccatgtccaacgtcagtaaaacaagaataggaggaaaaggcacaggggaaaggtacaaggaaatctctgagagctttgttcttgtttaaagatgtttggcaaagtcatgaggcgttaaagggtaaagacgagggtttgtgcattcaattcaaggcttctttacatgcctttacgtgccaatgagaagaaatagatattaaaccagacttgaacccagctct

SEQ ID NO: 235751 - DNA, 615 bp, Homo sapiens
caattatcttttctttttatttctttgacttctgcagaagttcaattcttgcttgttttcagtttttgagctttcactccatttgggagttcagccaatcagttgctgaaccagacaacttattataacttcctccgttggagcctgaaatatgtctttacttttgatttacatacaacattgtgggtgatatatcaagattattcactacaactcaaagacacaaatgtttcgagaattaattacgtcaacgctttcagaagataatgggtaagaagcaattcagataaaaattgattcatttcatgcaatcaatacctttatcacaaaatagaccagcatattagagaaagctttggagtcagaaggacttgagcttgaatctgggctctgcaacttaccagctacctgagtttgagtggcaatttaaacccctcagcctcagttttctcaaatgtcaagtagatccacacatcttacaggacagtataagaattagatgaggctgggcacggtggcttacgcctgtaatcccagcactttgggaggccgaggcaggtggatcacgaggtcaggagtttgagaccagcctgaccaatatggtgaaacctggtg

SEQ ID NO: 235752 - DNA, 162 bp, Homo sapiens
catgtggtcaaaggtttaactctctggtcactcctataaccttaagcttccatattagctaatggccagagagtaactgagtactattcctacaagcattctctcctcctactagcaggcagtcaggaagggttgtttgaggaatattatccattcaacttg

SEQ ID NO: 235753 - DNA, 1636 bp, Homo sapiens
tcggagatggggttttgctatgttgcccaggctggtcttgaactcccgggctcaagcagtcctccagtcccagtctcttgagtagctgagattacaggtacgcaccaccatgcccagcttgtgtggggtttcccttgaagatcagtctcaaggttgctgcttgaccggtgagcagcaggattcagacctagatgtgtctgactctgggatcctttcacctaaccctgacgctttcccagcaagcctggatgacctggcttccctccaccctgtgcccatgccctgccccttttccatcttggagtttctgaagccccagtgggctgtccactctgtgcttctttgggtcacttatgatgccagcctccctcccggcccacccgccaatcccaggccactgctaataggggtgtctttggcaggggaacaaagagcgttttggggctgccaggtggctgctctgagtgctccagtgttggccagagtggcttggcttccagaaacttcttgctgcctccttgcaggaggaggtcctggccatgctaggactgtgagctgctccccctgaacccctggcaggagccagacgctgctgtgctgccacgctggctcttcagcccctggacggacgccttggctggtccccagggcaggctcctcccaggcggctgtattctcttctcttcggggaagcacaaggcagatgttgtcgatttaaattgtttccttattagactctcgctctctggcctgggctgggtttcatcagccgggaactctgattgcatcactttgccgctcactcctccaggaaccaggccaagggctgggagagcaggcagggtgggagtgagcgtggctgagggaggggcagacggatggcaggcaagggacttaagtgatggacttaagtgatggggccctgttctgggggaccagcactgtcaggaacccaggagcacagctggaacctggagttccacacgcctgtcagagcgctactgtctcttagctgggtgcccagctccctgcatcagaatcacctgagagctcgtttaaaatgcccttttaagacctgcagcagtgactctcaaccagggttgatttggcgatctctggagacattttcggttgtcacacctggggctgtgctactggcagggtgctgctgaacatcccacagtgcgcaggacagcccctcacaaaaagaaaccctgtcctgcggagtctgtggttctggaagggctcactgggaatcttcgtttgtcatgagccagtggaatgttttttggtttttggtttttttttttttttttttttttgagacagtcttgctctgtcacccaggctggagtgcgatggcgcgatcttggctcactgcaacctccgcctcccgggttcaagagattctcctgcctcagcctcacaagtagctgggattacaggtgcccgccaccacatctggctaatttttgtatttttagtagaggtggggtttcatgtttcaccgtgttgtccaggctggtcccgaactcctgacctcaggtgatccacccgcctcagcctcccagctacttaggaggctgaggcaggaggatcatttgagcccaggaaacatagtgagaccccttacctc

SEQ ID NO: 235754 - DNA, 532 bp, Homo sapiens
ctgatttatctctagatagtaggataagagaaattttctgtttttactttctatatgtaatgtttcttataattaggaaaatgctgaatgtaatcatggctctcttattccagcctgactcaaagcccagtgttgtttatgtggtttgttagcttgcagttctagagacaccagaggtggaactggtgaattcattcattcgtgagggccccctttatgcctcaatttcccatctgtaaaactggatgatgatatacctcatcgggtcagtgtgagaattgcgtgagttaaaatctgttaagtgcatacaactagcactggctcgcaggaagcactaaggaagtctatgctgctgttattgtccattgagtgtcttctacatgcagaatgctgggtcaagccctgtaaggctgtaggggacgaagggaaagtgacttaaggagggacgagggaatgaagggcatgagaaaataagtggtttgctgccaaattctcttgtagaattccaacagaaatcacaccagacacacca

SEQ ID NO: 235755 - DNA, 499 bp, Homo sapiens
ttccccggataggctccttgcttccataggaaaagcaaacctgataccagctgaagtccacgcctgggggatattaggaagggaggggtctgtgttgcctactttttgtctgagctggtggctggccctttttcccccgagttggtggctggccctttttcgccttccctgtcttgttgtgatagctcatagtctgggcacactctgttcaaaatctgactttgccattttttgcctccttggtgtgtccaagcagtggcatctgtgattagttgcctcctgatgtaatattaactttacctttttctcactcaataccttcagatgcctacttcctgttttctaaaggactcaatgctaattataatgatattttcctttacttttccttacttctagatatattcttttgcattttatattatttcttcctctggaaatgaactatttctgtaatacattcttttcattaataaaggttttagtatatttgattatc

SEQ ID NO: 235756 - DNA, 423 bp, Homo sapiens
taggaatgaagaggaccagcacccagaatttctacagtgttacctggaatatccaattttcaacaaaaagttgagatatgcaaagaaatgggaaagtctaacccatatatcgggggaaaaaagcagacaaccaggcttgcctgtaagagggaacagatgtcagatttaataaaagatttcatagtagtcattataaatatgttcatagaaccaaaggaaatcatggttgaagaaataaaggacagtatggtgacaatcacatcaaatagagaatgtatgtagagatagaaattataaaaaagaaccaaatgaaaaattccactagaggggctcaacagtagatttaaactggcagaagaaagaattagtgaacttgaagattctagatcaatagagattatgcaatccaaagaagagaaaaga

SEQ ID NO: 235757 - DNA, 430 bp, Homo sapiens
tctgaggcacaggaagagagggaagtgaacagctggcctggctgggattggcttggagccgggagaaagtccccagtgtggagaacaggtaagagacagatccccagtgatctgtgttcccaccatggactcctgtaatctggcctcaggagagcttcttggccttcatgggccctgatactagaataggaaaatagggagctgcctggagcccccttgtccgagacccaatgagctgcagcagggtgccattttgacagtccagcccctattagaccacatctttctctggcgcccaattgcccttgaatctccatatccgtagtgctctgatgacatgttcctgtgtccatccagagggctgcagcatcacaatgccagctggacccagcagtgcagagcatattaattctccagaaagagtccaatg

SEQ ID NO: 235758 - DNA, 419 bp, Homo sapiens
tactaaaaatacaaaaattagccgagtgtggtggcaggtgcctgtaatcccagctactcgggaggctaagacacgagaatcacttgaactcaggaggtgaagtcgcagagagccgagatcgtgccactgcactccagcctgggtgccagagtaagactctgtctcaaaaaaaaaaaagaaaagaaaaaaaagaactaaactaaagcgtgatagaaataatgaaggaaaatgacaaacttttatacatgctaaaagaatgtgtatacttacttgataagaaaaaagtttaacatccccctccccccaaatcagtaaatgacctgagcaatttacagaaaaagaaatacaaggggtccgtaaaaatgtggaatagttcaacttcactggtaaagacatgcacatacaaagaggataccatt

SEQ ID NO: 235759 - DNA, 331 bp, Homo sapiens
agtccaggcccccgaatcacatctgatgagctgtggtgatcaccaatgccggagttgcctgcaatgactgcactgccacagcaattggcccttgtaaggccatttgtctcattttcttcccatctcccaacaggtggcgaagttgaatgcaccacattcagaatgcacagaaaacccagaatgggactgcttaggagtcaggctgtgctggctaattaaaacaggagcatttgtagacaggaatgtggctctcttgaaagtccaggaattctgggtaatcaacactcaaccatcaacaaacactctctattccaggcactgggagcaccca

SEQ ID NO: 235760 - DNA, 494 bp, Homo sapiens
acatattaaaatagaaattatcagtaaagaaatagatgatataaagcagaaccaaaggaaaatattagaactgaaaaatactataacattttaaaaattcactggatagactcaatggaatggagatgacaagagaaagacagattgataaaatcatccaatatgaatagaaaagtcactgaaaaatgaacagacttatctagaggatcctgtgggatgatactgacaggtctcacagtcatgtcacagatggataaaagagagtgcagtgctggccgggtgtggtggctcatgcctgtaatctcagcactttgggaggccgaggcgggtggatcatgaggtcaggagttcaagaccagcctggccaacatgccaaaccctgtctctactaaaaatacaaaaattagctgggcatggtggtgggcacctgtaatcccagctatgcgggaggctgagacaggagaatcgtttgaacccgggaggtggagattgca

SEQ ID NO: 235761 - DNA, 413 bp, Homo sapiens
acatattaaaatagaaattatcagtaaagaaatagatgatataaagcagaaccaaaggaaaatattagaactgaaaaatactataacattttaaaaattcactggatagactcaatggaatggagatgacaagagaaagacagattgataaaatcatccaatatgaatagaaaagtcactgaaaaatgaacagacttatctagaggatcctgtgggatgatactgacaggtctcacagtcatgtcacagatggataaaagagagtgcagtgctggccgttattatttaatagtttaatagctcaagtacattccaatagacgaagtgcacacaacacaatatgtgtgtacagtagtagtaaagtttcttttgagtagtcaaagactcacttttttattgcctttttttttttt

SEQ ID NO: 235762 - DNA, 685 bp, Homo sapiens
aggtgggtaggaagtgccagttcccagggaggatgctgttgactccttatccacggccattctcctcccgcttctttcttgctaaggaaaccccaagtttgttcaaccctcaggtagcttagggctgtagaggaagtgggccctccctaggcctgggggtgaatctcttttggtctaagccagtcctagtcattccagtcccttcctagtaatttgagtggaaatgggcatataatgctattctggccaatgagagggcaagtcagctggaaaagagggctctgagaaaatgttcatagacaagaaagcaacatttctgcatttggcaaaagggtgtaatgctccaagcaatggcagccatcttgaggccgtgaggggacaagtctgagatcaaatgtcaccatactgcatccttgaagacatgaagacctcagcgagctgctgaattaaccaacccctgaaagcgccctatcccgactccttgtctcgtgtgttagatgctatttaccatcctcaagtgtccattcttcttgtggtccttagaaaaagaacacagcgagttctaggcagacatagcacctccccttggcagctggctgtggccatgtgactaagtccaggccaatgggatgtgaacaggagtgatgcgggcaactcatggatgatcttaaagacatttgctttg

SEQ ID NO: 235763 - DNA, 809 bp, Homo sapiens
ccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcag

SEQ ID NO: 235764 - DNA, 309 bp, Homo sapiens
cgtggcagacggaaaattgaaagtacctcggattggttgctttccataactaattaaatgtttgcatagggtgtaacctttgtaacttcgcttcaggctctgattggttgctttccgctatcagactgattgtgggccactatatttgcgtggggtgtacacaagtggccaatgggaaacctctagagggtgtttataccccagaaaattctataacccggccgccccgctcttgagccccatgttccggctcttcacaccctgtggagtgtactttcattttcaataaatctctgcttttgttgcttc

SEQ ID NO: 235765 - DNA, 386 bp, Homo sapiens
aggcagtccacccgtcttggcctcccaaagtgctaggatcacaggcgtgagccatccggcccagcccaggtcttatattttcatagagaaaataagataggattttgacatgtccctgttactctttgaccactttcttgcattttggaagaagacgtttcaggctcatcttgtacttttcatgccctagctgtgggcagggcagcttttcctgttgtagccatttctccaaagagccccagttccttttagttgagaatggtatttagggccagaagtggtagctcacacctgtaatcccagcactttgggaggccaaggcaggagaatggcttgagcccaggagttcaacacccttgacaacttagagagaatgcctctctaca

SEQ ID NO: 235766 - DNA, 552 bp, Homo sapiens
aactgaaactctgttcccattaagcaatagcgtccccttcctctctcactccagccctgggtgacagagtgagaccccatctctaaaaagtaaagttagccataattggggtctttcaccacatactagtgtgactcagccagttgtttgtggctggcaactgccaattcatctgattgtcccaagagcctcagtggattggtcagtgcccatgactcccttgctaaatagtcttgaatgtcaccattattcattactattattagtattgtgggttccacgtgtcaggatcccttcctgggttgtatttcatcttacccctttgccaagtcttggttgatgtggtcctgcctcagtttccaaagggtgctggtgatggaaagcggggtgctgggcagattggggtgaaagctggctgctttggggattgtttgatgagcattatagtagattaagctacttctccccttccttccctgcccttattgaaaaggcgccaaagccaggaaaaacaaacagccacccataaataaagaggaccatgaaataaca

SEQ ID NO: 235767 - DNA, 949 bp, Homo sapiens
ggtgttcataagttctacccactagcagttgaaattgggacaaaaacatcccagatgtcccgtgactcttcctaattccttttcctgttgtcctctttctttcttaaaattatccccctttgccatggtactggtccactatttaaaggtcagtgactcatgttgtgcctcaacactctgccaatccctgtaccggatgctggggaggcaaagtgaataccacttcaggtttttgttactggagatttcatagagtgttagagcaggaagggctcacaaagaaacaatctcatctagcccttttattttacagagaaagaagccaagacccaggagagtgagtgacctgcttaagacccataggctcagaactggagccaaatcccctgacacttgcccacactacaaacccaaggacagtagaactaaggcgttctagataggtcatttgtagacagattcttcagtcgtttcacactgccaagtggagaaaacccaaactccccttctagtcaccgatcttgtgtttaggaccctggacactggtttatttatggtgaaaagaatctcactgttggagctgggctgcagatggaatgaatcaagtttaacttaggtcctcaatgcagttggatattttatggtaagctaccctttgtaagaaatgtgagcgcttgggtgggtgtggtggctcatgcctgtaatcccaacactttgggaggccgaggcaggcagatcacttgaggccaggagttcaagaccagcctggccaaaatgacaagaccccatctctactaaaaatacaaaaattagtcaggtgcggtgacacgtgcctgtaatcccagtcactcagaaggctgaggcatgagaattgcttgaacccagaggttgcagtgagcagagattgcgccactgcactccagcctgggtgacagcaagactatgtttc

SEQ ID NO: 235768 - DNA, 319 bp, Homo sapiens
cattgacaaagacaaaggaaaaacaatttcttcctagcaaatgtatatttaaaaaaaaaaatcaagtctgagaaccagaggacttttaataaagcaggggaggcacctttccacacatgagctctaggcacaggacaggagactgagcttgtaacaataaccgtatctaaatgctcagtatatgcaaaacattatggaaacacaccaaaagaaatagaagagtctttttctgcccttggggaatctgcaattcattctgaatatcaaacatatcaaaaatttagaaatttattgaaaataatttatagcttattggcaa

SEQ ID NO: 235769 - DNA, 716 bp, Homo sapiens
gtttcaccatattggccaggctgttctcaaactcctgacctcatgacccacccgcctcagcctcccaaagggctaggattacaggcgtgagccactgcacccggccaagaattttttttaacttgagtttacatttcttatctcttgccaccattacattggtagctttatagtaccagatcaggggcaagtcttgggggaaaaaagcgagatgatttcccctgcgttttggtctagatgctagatgttaggctaggcaggaatatttcagactggaacactgaagtagtaggctacttggagatttggaaccaaagctacagctaatcagtactgagttttgtgtaactttgtgtggtatatggacttactaggagtggaagtggccacagtagatgaatgactgaagatttaatattttgggattctgatcatctttctgaagatagaaattactaacacatacataaagtcaaggaaaccccaagagcttgttacttgaccaaggtcacaaagtaacatttaaaaaatcatctaagttaaacaagctcatgaatagtttaaagtgtgtttgtttttttttaatgttcaatgaagtaccttttatgttgcccctctctaaaagttgaaggcataacattaaattgaacctcagggaagatactttcactggagcatcagagagagtgattgccagatagtgaattggtttcttt

SEQ ID NO: 235770 - DNA, 415 bp, Homo sapiens
tgagatattgaaattttatgagtccaaattcccaaggtgtttgattttaaggataaattaatcccaccgtccagtattcaggactgctaaaaagtatagtagaattagaaagatattgacaataaccacagaaatagctaagctttgttgagaccttaaccatatgcaggcactgtgctgagtgcttcatgtgcagcaccttattttattttattttattttattttatttttttgcttttgctaattttttaaaattgtactttaagttctggggtacatgtgcagaacgcgcaggtttgttacataggtatacacatgccagggtgcagcacaccaacatggcacatgtatacatatgtaacaaacgtgcacattgtgcacatgtaccctaaaacttaaagtataataataat

SEQ ID NO: 235771 - DNA, 6783 bp, Homo sapiens
  misc_feature (3093)..(3093): n is a, c, g, or t
  misc_feature (3098)..(3098): n is a, c, g, or t
  misc_feature (3100)..(3100): n is a, c, g, or t
  misc_feature (3111)..(3111): n is a, c, g, or t
cagggggagcaccgagcaccacggtgtcgtgcgcttcgaggcgcggcgtgggaagaaggctggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcatcatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcctggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccnaaacntntctccatggtncagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacctgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctggtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacattcttttgtatttcaagataatttcacctgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtcta

SEQ ID NO: 235772 - DNA, 7032 bp, Homo sapiens
  misc_feature (151)..(151): n is a, c, g, or t
  misc_feature (3225)..(3225): n is a, c, g, or t
  misc_feature (3230)..(3230): n is a, c, g, or t
  misc_feature (3232)..(3232): n is a, c, g, or t
  misc_feature (3243)..(3243): n is a, c, g, or t
tcaaggtcttggagtggagttaggtgtccttctggtaactttctgatttgtctccctttcacttccgccggggcaggcgccgggactccctcctggccgcccacagcctgtgcgcattcctgcattcctgccgccgcccgggacccgagtnccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcatcatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcctggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccnaaacntntctccatggtncagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacctgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctggtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacattcttttgtatttcaagataatttcacctgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtctaaaaaaaaacaaacgccataacaaacacaaatatttggggggcgcacagggccccgaaaaagtttctaaacacacctttttgggcccgggccccatggtcactgcacaccggggcccc

SEQ ID NO: 235773 - DNA, 1663 bp, Homo sapiens
  misc_feature (151)..(151): n is a, c, g, or t
tcaaggtcttggagtggagttaggtgtccttctggtaactttctgatttgtctccctttcacttccgccggggcaggcgccgggactccctcctggccgcccacagcctgtgcgcattcctgcattcctgccgccgcccgggacccgagtnccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggctcatttgtaaaaattggccatatcagagcttgcagtgagccgagatcacgcgactgcactccagcctggacgacagagtgagactccatctc

SEQ ID NO: 235774 - DNA, 1655 bp, Homo sapiens
  misc_feature (151)..(151): n is a, c, g, or t
tcaaggtcttggagtggagttaggtgtccttctggtaactttctgatttgtctccctttcacttccgccggggcaggcgccgggactccctcctggccgcccacagcctgtgcgcattcctgcattcctgccgccgcccgggacccgagtnccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattgacggagtctcgctgtgttactcaggctggagtgcagtggcacgatctcagctcactgcaacctctgcctcccaggttcaagcaatt

SEQ ID NO: 235775 - DNA, 6915 bp, Homo sapiens
  misc_feature (151)..(151): n is a, c, g, or t
  misc_feature (3225)..(3225): n is a, c, g, or t
  misc_feature (3230)..(3230): n is a, c, g, or t
  misc_feature (3232)..(3232): n is a, c, g, or t
  misc_feature (3243)..(3243): n is a, c, g, or t
tcaaggtcttggagtggagttaggtgtccttctggtaactttctgatttgtctccctttcacttccgccggggcaggcgccgggactccctcctggccgcccacagcctgtgcgcattcctgcattcctgccgccgcccgggacccgagtnccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcatcatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcctggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccnaaacntntctccatggtncagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacctgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctggtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacattcttttgtatttcaagataatttcacctgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtcta

SEQ ID NO: 235776 - DNA, 357 bp, Homo sapiens
atgtggtgaagtgaaatataatttttacctcatatttaggaaggaattttaaatgacctttggatttttatcaagattcattagcactatttctgaaaacttgtttgttttattaaatattaaggtttcattgcctgttaagttcttatgaagctaataacctaaaagcaaagttaaagaaataatcatctttcctcctttagtccatttctttaatagcatactatgtaaactgttgatttcttgagaataagagcatgagttgtcatagtacattctcaagagctgtttgatgaaaggattttcttttattttgatggagaaataaagacacaaaaactcacttaaaattaatgc

SEQ ID NO: 235777 - DNA, 1917 bp, Homo sapiens
atggttggtgccctttagagataaacctacagccccagtacctggcccacctgaatctagagggccacccacccagctgaagtccctgggcaagtctcctgccccagtgcaggcagtgtttcctaacctcctcctcctcctgcacccaaccaggcccagaacacttcctggtcatgtgaacagctgacagttacaatcccccacacactgagagagcatctgtgttcctgagtggactgaattgctagatgtagtaacattgatttggtggctataggtttcaaacttcaagtcagagatcatagaactttaagccatatagaatcctagaattggaagactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaagtgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtggaggtaaaaaatgatcaccggcagcttcagatttaccttccaccagcttagcaaacaccacccactcccagcaagaaagaccctgtttcccaatgctcccagcagatgtcttaggccatcctcgggcctcactgattctgtgagccagtgcccacggccaggagaatggaatacactgacctagaggggacagggactctagacaggcaaaaactccactgtcagaagcagaatcctaaaatgtcagaactgaaaggtaggcccgcccctcgttttccagaaatatgaaagggaggcttgggataacagagaaatgctgcaggcattggccccaaatctcaggcctcctattcccagtatcaccttcaccagcctgggtggtctcaagattggattagcagccattccttctgggtagagtctgatggtcacttcagctctcaaagtccagctatccagccatagtcctagaaggcaagacatcactgtgcccgaccaacccaagggtctccacctgcccccctcaacacaaggtgccctgagtgcctccgcggggatagtccccgtccccacccctgcttcccccgcccatcgcgacagatgctcagagctcatccctggtgtcacaccacataaaggaggagggcggtggccaggctccgagctcctgccgtcctgggtgggtggcttctgtcctgcgtgccgccgggcagcccgggggtcctgcgcgcgggcgcggtcggtggagctgcaggggggcgctctgggatgtctccaggcagagtagatactgacccctccgcagccgggaccctcaccctttccttcatcactcaggaaacagaaaaggcttcagaaggagcggccatgcccccggcctaagcgctgcgttcccggcccagcaggcctaccctgcacctggcgttcctaggggcccctctgcgggacccactgcgcggctcgcagcggccgcccgcct

SEQ ID NO: 235778 - DNA, 541 bp, Homo sapiens
gtgttttcaggaagtgtgtgtgttggccacggctgcaggaggtgggggagacacaaagcaggaagcctccgggagaccagagctgggtgcagacatacacacacacatacacacagacacacagagtcacacacactcacacacactctctctctctctccctctgtctttctctctctctctctctctctgtcctttcctcctggacagatccacagttatacacagaaacaaacacacacgcacgtagagaagtgattcacaaacacttaaagacataaatcacaggtgcaaagccatacctgggctcaaaaacctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcaccccc

SEQ ID NO: 235779 - DNA, 715 bp, Homo sapiens
tgatgtctgcttttgacttttatataaatggaagttttaaaagacccaactatttttaacatgaagatgtttttccttaataaaacctggaatagttattcaaggttctttgcatatttttcaagcaaaatatcccaagtgtacttgaaaatgtaacttaaaatgtttctcacgttttcttaacttgtattttgatatgatgatgtgaggcataatttaagtgttattttaatgtatgttaggttatgctttgatctgaagtatgtataggttttgttctctattcattcacacctcaaccatccagcaaacactgagtgcccactcagtgccaggcatttgcggggagctccaagcccacagcagcacagcatggggcctgcgaaaagcaccagccctcagggagttcgtgttttgttggtgttttgttttgattatttataacataataacatgtgtttattactgaaaactgcacaaataaagataatcaaaaatcacccataatcctaccaccagaactaaccactgtttatcatcttagtgtatttcctttccaacctatataatatgtacagatagttggatgctattttaattctaagcaaaattgaaaatatttgaagctgttgtcaaagaggaagtaccctggtttgagtattttaactcatcatctttcagaaatgaaaaataaaaataatagaacttgatacta

SEQ ID NO: 235780 - DNA, 551 bp, Homo sapiens
tcctctttccagacccatgtctttgctcatgtagatcactacttcaggctgacataaaaaccgttctcttgttaagaaagctcagcaatgggagaggcaatcctccacccgtctcttgctctcctacaggtctttcctggaggtagtgggttgaatggtggcccccaaaaagataggtccaagtcctaacttctagaacctgtgaatgcgaccttatttggaaaaagggtctttgcaaatgtaattaaaacacctggagatgaaatcatcctgtatttaggatgggccctaaacccaatgatgtctttataagagaaaagagagagagacgcagagacaaagagaagaaggtcattgagatggaggcagagatggggatgaagtgtctgcaaaccaaggaatgccaaagattgccagcaaaccaccaggggccaggagagaggcctggccgattctccctcacagacagtagagggaaccaccctgctgacccgtcagtttcaggctttgggacctcagaactgtaagagaataaacatgttttgagccac

SEQ ID NO: 235781 - DNA, 481 bp, Homo sapiens
ttgctttatttgataatattgatagcaattaaaacagccaaaatactagattctttttgcgttatttgataatactggtagaaattaattaggtataagtgtattttttctaattgctattttactgaaagcatatatatgtatgtgtgtgtgtgtgtgtgtgtacacatgtatatatatatatatggcaaatgaaatcttaaatccagaatggggtagtcttaaaatagcgcaaaagacaaaaacttttaaaatgttaaacagaagtacagttgaactttgagtaatgagtgcaggggttaggagtgccatcccctgcttgcctgcaacagttgaaaatcagtgtgtaactttggactcccccaaaacttaactactgatagcctattgttgactggaagccttacctataacataaacagctgattaatacatattttgtatgttacatatagtatgtactgtatttttactataaaga

SEQ ID NO: 235782 - DNA, 362 bp, Homo sapiens
  misc_feature (296)..(296): n is a, c, g, or t
  misc_feature (317)..(317): n is a, c, g, or t
  misc_feature (332)..(332): n is a, c, g, or t
gaaagctgccaaggcagggcttttggcactttcagctttaacctttgctgggctttgctatttcaactatcacgatgtgggcatctgcaaagctgttgccatgctgtggaagctctgacctttttgacttcatactttgaagaactgatgtaagcctctttgcctctgctttgtcatgccattaagctcacaataaggggaagatatgcttgtgtcctatgaaaatataatcagacagccatgatgtcctccaaaaccaggaaaccgggaaataacccactagtcttgatgaacanatccaaagatctatgtcatgnagcataataaaaatngtgacagaaggaaataaattgccaagggga

SEQ ID NO: 235783 - DNA, 975 bp, Homo sapiens
cattattgcatatgtcctgtagacaagcctcagaataagtaggtcagaggttgctttccttctcaacttctgcagcccagatgagtttaataaaccacttagatcagcttagatggatataagtcaatcgacccaaatggcaaatgtgaatcacacaggcatacagtgagaaaggaagcagggccctgaaatgctaagctggaactagagtctaagatggctttaccaaaaacatacttcccaggccatgcacctatatgtgaagctttattgatgtttaaacataaccttgtatggctgttttccagtctgagatggtatggatccatataggtgagagtaagtttatatctgcatccgcagtgtaggctggggaatttaaaatgttgattaatatctattgtatacataaatatctacataggcaaagtcatataattctatatgttgtgtttacccatgtataatctagatacagatctagcattttttttcatatgcatacagaataaagatataggaggtcaaaggataaatgggtatttgtacttacagcaatgtaaagaaaaacgtcaataaatgcaaaatcttatttgccatttaaattttgtccacaagagcacacaaatggaggtatgctctgacctgcatcttgctgcatttaatgttttcttttttccctttttttctttttttctttttttttttttttgagatggagtttcgctccagcttgggtgacagaatgagactccatctcaaacaaaacaaaacaaacacaaatgaaagggaaggaagtggattactgatgataactaaggtatggaatcaacctgagtgttcatcagtaggtgaatggagaaagaaaatgtggtatatgtacacaatgaaatgccattcagcccttaaaaataaagtcttgttatttgcaacattcatgaatctgaaaggtatgctaagtaaacccagcacaga

SEQ ID NO: 235784 - DNA, 235 bp, Homo sapiens
aatgatttgaatgaggatttctgtccatggttgccttcttaaacatgccatatcaaccttccctaaatatgcttttctcgattttttaaagagcacactgcctaattgtgtctaacaaattctgaacactttatgtttcaccaggtgagagaggaagtatgcaaccaaattaaccatagtcttcgctcctgagtcccagttctttggtgaaactgacgtgtatatgtgtgactat

SEQ ID NO: 235785 - DNA, 311 bp, Homo sapiens
aagtccggtggtatccctaggtaaggccccgcttgcccagacccacttggctccgggccttcgggactcaccgcacgggaggagcaaccaggcggcgcagcgcgggcgaaaactatgattttcaaaactgaaggctcagccaatcctcggcaagtttgtccgggcggttgcaaaattttaagccaatcaaataacaggaagtaccagtcagccctcctattggccatatccactagcaatctgcgggactaagaggcggggaaaggaagcgaaagactttaagccccctcagcttccgggtgctgcggccg

SEQ ID NO: 235786 - DNA, 354 bp, Homo sapiens
atgagaatgtgccacctttttttgcagtaatggtgtgatcattttgttttagaagataatttgaagccgggtgcggtggctcacgcctgtaatcctagcactttgggaggccgaggcgggcggatcacgaggtcaggagatcgagactatcctggctaacatagtgaaaccccgtctctactaaaaatacaaaaaaaattagccgggcctggtggcgggcgcctctagtcccagctactcgggaggctgaggcaggagaaaggcgtgaacccaggaggcggagcttgcagtgagctgagattgcgccactgcactccagcctgggtgacagagcaagatgccgtctcaaaaaaa

SEQ ID NO: 235787 - DNA, 250 bp, Homo sapiens
cagttcattcatatgatggaatactatgcagctattataaattaaaaaacaaaacaaaacaaaacaccagacaccttagtgacaaggaaaatgttatccattcactgaagaaaaatgagaaacttaggccaggcacagtggctcatgcctgtaatgccagcactttgggaggccaaggtgggaggatcgcttgagcccaggaatttgaaaccagcctgggcaacatggtgagaccccatctctccaaaaa

SEQ ID NO: 235788 - DNA, 2131 bp, Homo sapiens
  misc_feature (1865)..(1865): n is a, c, g, or t
aaaagctgttaagaagtagtcccaataatgtgagaatttgggagacagaatagaagccaattgtaaagaaagcaacatggctctctacttttgttcctgggaggaagatgtgaatcttccatctgccaaggacatggaagggaaaatggtacataaatacataataaaggacactgtaagaattttcatgctccagagataaacagataatcactaccatatgcaagttaaaaatagtatggaaatagtttttcatgggagattaacaactgaagccccaactgtttgtggttgctcatatggaaattgctttgttagatgaatgtactgactgggcaagaagtagtcaataatttgtgtgagctgttattttcaaagtacagaattctgcataaggtggctctgatttcagataaagttgcataccttggtagaattatttctttttggcttttgaatcatttataagcataatttttcttttttaagggaaaagaataaccttccctctggcctttttatcagaatgtaatgtttctgtttgcttctttaagtgttcataacaagtttgtggattccaaaagggattgaagaattatttctggtggtctttgggtctaattgctgccagctgaggaagcaaaattccaaataagttgaagaaactttcacaaaaaaacacttaacataattataaggcataaaggctcaatatacagtttatgtaataaaatcttacctaaccacaaaacatccaaggaccagtcaagcagaggtcttcaaaaaggtatatgttaacattttgcttgacactatacttgcttagatttattaaaaaccttctggctatgcattttagattaatcctgttttaaaaacctttgcaaagtttttctgttttgttgtgagcaattcaaagagcatgtaacaattgatgtaaacatgatcttcaaaagttagaatatcattcatccttccccattgcttcctccaggaatactggaataatatggctttgagatattggccaaggattcctagtgttagttatttatgaatttaatatagtgtgttccacttaaaggaaacatgatacaaaaatccagacaacaaaacaggtatatgagtaagtgatcataatataaaatgtttctgtatttttcagaaaaaaattacatagtattcacttaagtcttttcacactacctttgctttatgattagatttagttgtgtgcactttttaggagcatttctaatattttgacaattaataaatttgtacatgatctggctgtgattcaattataatttacaaaagcaagtcttagaaatatcagggttgcccatatttttaggtcatttctgtcatcatttaatcttatttttgtttttacttatctgttgaaacttcagcaagtgttcttgatcattgattattgattattatacccttgaacaacattgggttggggcattgaacctcatgcagtcaaatgtatgtaaaacttttgactctccaaaaacttgactactaacctactgttgaccggatgccttactggtaacataattgattaatacatattttgtatgccagcaatccccaacctttttgtcaccagggaccagtttcatggaagacaatttttccatggacagaggtcggtgggaggatggtttcaggatgattcaagtgtattacatttatcattaggttctaacaggctatgggctggtagtggtctgtagcctgggggttgcagacccctgctgtatgctgtatgtattatatactgcattcttacaataaagtaagctagggaaaagatgtgaagaaaatcataaggtccgtgtgtggcgtcncacgcctgtaatcccagcactttagggggccgaggcgggcggatcacgaggtcaggggattgagaccatcctgactaacatggtgaaaccccgtctctgctaaaaatacaaaaaattagccgggcgtggtggcgggcgcctgtagtcccagctgctcgggaggctgaggcaggagaatggcgtgaacccgggaagcggagcttacagtgagccgagattgcgccactgcactccagcctgggcaacagagcgagactccatctcgg

SEQ ID NO: 235789 - DNA, 588 bp, Homo sapiens
tggtcaacttgtatgaaaggaaggaacagggcttagatttcctgcccagcaggtgtaaaggggcagaacagtgaagattcccaaagtccacagctctagggcagaaaagcctcctggacacttgagctgtaagtggggcagccacctccacagcccacacagggactctgcttgctgctctggcagctatcccttaaggacatgtggcccatgccctccctggtctctcagtttctggataagtcaagcattcagagaatagtcctctctatcctcaagacccgtgcttactctggggaggactgtgtgtgttgaggggagctcgtaaggccacaccctcaggtatgctgaaggcatgaatagactgacgagtgctagaaggaatctagacaagtctgtgacatccaaccagcttcaagtctgttggagccaactcatggagaatcccaaacctcctgaggggccagggcccatggagataatactgcaggtgggtccactctagagcattcctgggccaccttgttcttcaaggtttggcccgcaccagggcagtgcctccacagcaacataggttctcagcccaac

SEQ ID NO: 235790 - DNA, 339 bp, Homo sapiens
gagcccaggcaggctgtccccaaggccatggccctggccgaggttgcatcctggcctggccaggccctgcccccgcgtggccagacttagaagcggagagcaggtcaggcattgaggagtcccgtggggaaaaagggtgaagcagggaagatcagatgcaagtcctccctggggcccagttctgtgtccctgcctggcaagggctttggggggcttggagaacaggtagggcaaatgtaggcccagtggggaaaaggttgatactaaaaggtctaagggcaattttcaaaccaagtctagctctgcagagccttgaggctgatgccaggccctggggcc

SEQ ID NO: 235791 - DNA, 531 bp, Homo sapiens
gcgatgtggttccccagagcacctgcggggctcaggccaggcagggtggagggtggagggtggaaggccaccttccgcccgtcctggaaccacgcggcggcttcccggctgccccccacccgccaggccctgcctcccgtgggcaccaggggggcgtccacaccaagccggccgtgtgcttttcgcgcaggattactggggaaggcggctgctcggggcctggaaggtcccgggtctcgcctcgtgcccctctggcccccaaaccgaccggctccccggaactggccaacccgcgctgagagcccgcgcagctcaaagggcgcgagggcgggaccgccgcggccggcgctgggagctcggcttcccgaagacccaagcgaaagcctccgtctccccagccgtaaatgggcctgcagcgtctccactccgcagcgctgtccccagtgggagggcggcccgtggacgtgcagggagcagagcaggggcccctggcagcgtaggaccccgaggtcgcagcaaccacgcggccgc

SEQ ID NO: 235792 - DNA, 395 bp, Homo sapiens
gtcgcctacagctgaccaatagagggcttgggtccggaagtgatggactggaggcttgactaatgtgaaaggggcgtctgaaagagaagccagctgccatgccatgaactgcaatgtgaaaaggccaatgtagcaaggatatgtccagccaacagccagtgaggatctgaggccctcagaccagcagcccatgagcaactgaattttgctaataaccatgtaagtgaacacagaagtggatccttccccaggcgagccttcataagtccacagacccagtcaagactttgactgcagccttgtgagagcccctaagccagaggacccagctaagccacgttcaacttcctgacctgtcaggtaataaatgtatgttgttttaagccaaaaggttt

SEQ ID NO: 235793 - DNA, 392 bp, Homo sapiens
gaaactaaacaatttgcttctgaatgactttcgggcaaacagggaaatcatggcagaaacataaaaattctttgaaatacgtgacagcagagacacaacacatcaaaatctctgaggtacagcaaaaacagtgttgagaggaaagtatatagcactaaacacctccctgaaaaagttagatctcaaattaacgttctaacatcacagttagaagaactagaaaaacaagaacgaactaaccccaaagctagcagaaggaaagaaataacaaaaccggagctgaccagaatgaaggtaagacccccaaaccctggcaaagactcaacacaaccaaaagtttgtttattgaaaggataaagtgaatcgatagattgctagctatagtaacaaaa

SEQ ID NO: 235794 - DNA, 452 bp, Homo sapiens
ccccagcccccgaccccagaccccactaccagattcagggcaggtacttttgtatgtgctctgttgaccttggatggaggtgataaggaccttatgacagtcatccatttggagacaggcttgtgtatcacttgagcttagtacaaaacacaatcaatcatgttccctagggggacttcttgagactcttggactaatgcggttgcctggtctgaaaacacttaagctgaagaaaaacttctgagactagatgcattctcaggaagtgaaagaaaattccagggggagtgccaaggtgaaagggaatgactaaagaccttcctgcttcctcatcaaaaggactgctctatgtcttggaccgtcagcacacctgttttcctctctgctctggcttcagctcttctcacaggctttgaagatgttctcaagaatcacccacctttaaaatgaaa

SEQ ID NO: 235795 - DNA, 217 bp, Homo sapiens
acgcgccccgcggcccgaactatgcttttgcctgacactctggcctgggcctaggcagagacatgacaaattgtcccccaagtcaacgctgacagcttctgatgattaatggtctgattatgaagtggttttacacatatagaatttacatcacagagagttagaaattttgccatgtcacatacgccgaggcattttgaagagctttactatttgc

SEQ ID NO: 235796 - DNA, 444 bp, Homo sapiens
agcagccaaagggaatattttccagccaaaagccctctcatgacttccctcacacttatgcttcttatcatgccttatgtatatatgtataagcagcccacagcatacttctccaccctcatctcctactgctctcctctttgctcactgtgctctagacatactgaccttatttctcctccttaactatgctatatgtttccctcagggcctttgcggtagctagtatctgtacctagagggctccttttcatgatgaatgcttttttttcattgatgactaagtacacttgtcacctcttcagagaattcttccctgacacctaaagtagccattccatcactaagtcattcttatgttttattttttcttcaaagcatttatcaatatctgaaatattcttgattgtttattcttttactcagtaaaagcgattaccttgt

SEQ ID NO: 235797 - DNA, 499 bp, Homo sapiens
caggaaaatagaatattctaatttatgaaatattctgactaacggagtgtataggaattatttattctaaaagtatcatcaatattaaaactatacaggacatattttactttatgtttgataattcataaatcatttttgtttcatgctaaggtttgggataagaattgtgagcatctcctcaggtataataacaatagataggctgggcacaatggcttacgcctgtaatcccagcactttgggaggccaaggcaggtggatgacctgatgttaggagttcaagaccagcctggccaacatggtgaaatcctgtctctactaaaaatacaaaattggctgggtgtggtggcacatgcctgtagtctcagctactcgggaggctgagacaggagaattgcttgaacccaggaggtggaggctgcagtgagctgagattgcaccactgcactccagcctgggtaagacagagtgagactctgtctcaaaaaaaaaaaaa

SEQ ID NO: 235798 - DNA, 463 bp, Homo sapiens
caatattatgctttggtatatcctgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtattttatgtaaaactaagcagtatttatatgtgagaataataagcaaaaaaacccatcttcgttttgtgactaaacagagaaatttgtgtagatcaacttagcagctgtctaaagtaccaaaataatagatttttcactgttgataatttaaaataaaatgtccatttgtatatctt

SEQ ID NO: 235799 - DNA, 483 bp, Homo sapiens
gctgtaatctgttctgtaatcaaatctgtctgctgtagatgtataatttacttttgttaagttgtttactgcaaaatggtctcaagaaaatccttttctattcaccataattactaagatattaatcagctctcaaacataggctatatggggtctcttgtaaggcttgtttgcttttagttaaaagtaatagttcctgctttcagaatgttttaatgtggtggtgaaaaccacaagctaatgttatatggaatgattacttttgtggtattcccacatgccatgtatttccgtgtatatttacagatacagtacacatacataaaatgacttacatgtaatattaaaaaaatatatagcccaggtgtggtggctcacgcctgtaattccagtcctttgggaggccatagtggaaggatcatttgagcccaggagttccagaccagcctgagcaacgtagacttcatctctacaaaaaagttc

SEQ ID NO: 235800 - DNA, 701 bp, Homo sapiens
tagtcatcccttgatatacatgagggatgggttccaggatgcacccccataccaaaatccatacgtactaaagtcccttgactgcggacctcacatatatgaaaagtcacctctccatatacctggattttgcatcctgccatgtagttcaaactcatgttgctcaagggtcaactgtgtattgtaaaacgtcttggaatctagataggaaagtttgatttattgagtaacctgctatcaggttagagaaaaaagtgccggaactttttgctggtgtggaaaaggtggtatggaaaaatgtagaatagtcagtcagttaagagttctgtaatctggatatttggtgaggaggaccttgacaattggaataacagtgggaatggaataagggacattgaaggaataatggaaaataatggcaatttattaaattgtagaaaatgtgctagctgcttcacttttggagttggggttactggggaagttttgccagatgataaatagatggtaagcacaggttggtttggttttacccaaatttgttctagacacatttggcttggggcaggtgttgaggtttgattttttttttttttcaccctacaaacaggccccctacacagctggatgtgttggctagaagctctgatgagaagttaggacaagatctgtagcttggaattcttaataggagtgatagc

SEQ ID NO: 235801 - DNA, 329 bp, Homo sapiens
agaaatgattatgaatgacctataggggaatcaccctccttcctgaaagcatttattcagaaatatgctttgaccagagccagaaatacaaaggaaagagataagtattgcctgatttactgtaaaccagaattgatgcctccaaaatgaaagtcaccgtcttcccccaaaaactagctccttctcacttccctgtttttgtcacccagatgcaggtgtctctggctctttctactccttccatcattatgtctagcctgttatctagtttctgtgtttttaaaacttttgactgatccaggatacatgtgtgatacaaaagtttcatt

SEQ ID NO: 235802 - DNA, 319 bp, Homo sapiens
ccaaaatttctgctgtcaggtatttcattgaataattgctgtatatgtaacattctatgccagtcgctaagagtgaaaagaagtataagatttctgctcttagaacattttttttatgtagttagcaagataggatgaatatacatagaaactaaaatataagttagtgtacaaaaattgattgtctatatactagcaataaacaggaaacaaaaaaaattaaatatcctgtttaatatagcatcatgataacaaattcctaggggaaaagatctaataacagatgtgaaagacttctacatagagaactttaaaacat

SEQ ID NO: 235803 - DNA, 485 bp, Homo sapiens
gacgattccttatatttcttcctccctttctccattccttccatttttatccattttactattttgactgaagatcacaaaataacctctgtttctgattcacagctgaaaacctagagccctagctttgtttagaactttataaaataaaaaagaaaagaaaaggaaaacctagaacctagcacagtgcctggcatgttgtaggtgctgaataaatttgtcaaataaataaactttaaagaaatggccaacttgggaaggacattaggccatcagtttgtagtcttacgtcaattcttgatctccaagcaaaattagtttcagttctctgaaggagactgccctttcaaagatacattcaagtaacttatattttctgaagaaatgattccacatgtaaaatactacttagagcaaatataggaatctctggatatagctgtgtaagtccatttgtttattcttctaattaaaatttgatcatt

SEQ ID NO: 235804 - DNA, 440 bp, Homo sapiens
aaggtgaatttacaatactttatttcagatgaattagaatatttaaaaatatgaagactaaacttatacttaataagtaattagacatactttttttttttgagacagggtcttgctctgtctcccaggctagagtgcagtggttcaatcactactcactgcagcctctaccttttgggcttgaacaattctcctacctcagcctcctgagaaactgggacgacaggtgcatgccaccatgaccggctaatttttttttatttttcctgcagatgcagtctcgctatattgcacaggttggtcttgaactcctgggctcaagcgatcctcccgcatcagcctcccaaagtgctgggattacaggcatgagccactgaatatactatttatatatcatttataaataaatatataatatattaataataaatctgaacttc

SEQ ID NO: 235805 - DNA, 1167 bp, Homo sapiens
atgatctaaggcaagagaatgtaaagtagtcaaagtcacactatgtgcattttaagagacatactgcaccaaatgcaatagcgagcatggtctgcatccgggcatcttccagtgtgctcagtagcccttttttgctaagaagagctcttcctgccagggtccagaacttcacatgttttactcccactgagacaaactgggtatctgaatctggtcggaattctgccacaaaaatacgttgattgtgaccagctctgctggcaattttggcacctgacaagatacaacaaaattatctaggttattacaagaaccaagctaatcaacagcatcaaacaaatatgtaaaatacatagttcaaaaaacaaaggcttagaagagaggccaatggcccctgctctactacctagcaatacatgatttacaattatttgtgtattgagtccttttcacttatcttcgctccattaacttttctttatataacgtaaatgttttgtctaaagtgtggtaggtaatattatcctgctgatctgccattatcattagaaatatacataattttcataagaatctccaaaaccaatcaaatcattaataataaatacatagtttcttgctggaagaaaatagcagtgaatcatttataatgctaataatggtttcattaatttatctgttttgtgaggttacagttccactgggcttttaaagtgaaatatacctacagtaccactgtgtacagtatattgcataggcctccactgaatgattgtttcaaccaccaactttaagacaaatattaaatacagaattcctactaaaaaaaaaaaaacagacagaaaacaacctttgtggggcacgcgccgcgcccagaaaaaggtttcaaacaccattcggtgttgggaggacagggggcccacataaggacgtcgacactgtggccacaggcggggcccaaagggaaacctggcgacagagcaaaggtgggcgtcttcccaccaataaaaaaccccgggggacccgacgggtctgaccaatccaggaggaggtcgaggccaacggttcacaacagcgtcaaggagctgagtaataccagctcgcggtggaactcacaacgacgcggcacgaaacacagacacagccgcacacggcacaggacacacg

SEQ ID NO: 235806 - DNA, 827 bp, Homo sapiens
cagagtctcactctgttgcccaggctggagtacagtgtggctcaatcacagctcactgcagcctcaacctccccaggcctcaggtgatcctcctacctcagcctcccgagtagctgggactacagttacatgcctccacacccggctaatttttgtattttttgtagagacagggtttcaccgtgttgcccaggctggtctaaaactcctgagctcaaactatttgcccacatcagcctcccaaagtgttgggataacaggcatgagccaccatgcccagcctccagtagtatttttaagacattgatccaaatgtcttaagttcctactaagtatttagtaagctctctttagatgtttctttgtttttagtttttaaaacttcccttgataccgtgaaaattagtgcaagtattgttgttagcatttatcaagatccattttgttttgagactgtattgacttccatatcttttacattttctaaatcaacataaatgttctaataatcttgtttgttttctttctttcctattacgtaaaatttgctttggcttattcctactccccttctaacccatctcaataaatggcaccacaaaaaacctggacaccatctttcttgtccctctttttgcccactcacatccagtctgttagcagattcttatgtcacttctaccttgaaaatgtattttaaacccatccacttttttctatatccacccccgcccccgcaccatcctagtcccagccaccatgctagtcccagccaccatcatttcatacttaggctgctgcagtactttcctcagttatctaaagtt

SEQ ID NO: 235807 - DNA, 1102 bp, Homo sapiens
tgccaggattgaagtcaattctttcttctctcacaggtgcccaaatgtgatgttacacatttttaaaaataaaaagtagatgagaagaaaccgagtggtgagtagttgaagtcagtgatggggcctgttatgctttaaatcaagtatcgttggcatgccctgggagagttagttgctcttaaagtttctgcaggactttatcactcaaagcctgtgtggggggaaacaaaaaagtcaaagctccatctctcctggggtccctgcttttctacgttcgctttgctgctacccaccaggatgacagacgggtctgcctctcttttccagccccagccttgttccacagcatcccttcagtcagtcaggtccagagaaacccacctgtcactctggtgcaagggaactggctgtggcttgcagtgcgtgtgtgcatgatacagcatacgtgtgtgtggagcagccacgcagcgcagcacaagggaggcagctcagctgttgatgcccagaggagggccctctcccaaggttcctcatcagctcttcagctctccacacagctcagcatggatttcctcagaccatcccaaacataaccttacattttggtgaaaatttgtctactactttttgtatgacacaaatcgagcaaacagcacagaaaccaaaatctatttatttggaaatattctgaagcgattcactggtataatttcatagtgttaaagcgggttagaacccaggctctgttacttacttgctctaagaacttgggcgaatttctttgtgtctctgtgactttgtttccacatctgcgaggatgtacactttaatgcattttttatgcaccttagaccagtgcctggcatataaataataccttctgaatgttagctagttttagagatgtaaagcactaagccactatttccagagcggtggtcctggcactatttcaatacaccaccaacattttatattcgtatcactaatagttttggtgatttgataccacttttacctctcctcataaatcaaggcattttgtggtctctagagaagtagggttcatttgagccccagaatacagcttctggctttggat

SEQ ID NO: 235808 - DNA, 497 bp, Homo sapiens
aaagtgctgggattaaaggtgtgagccaccgcacctggcctgaagccatagttcttaacctcagttgtgcaatagaattatctggggaatttaaaaattagaaaaaacccatgccctgaagattgtgatctaactggtcttgcgtagcgcctgggcattggtattttttaaatgtttcccaactgatactaatgtggccattctgcaagccacagttgaaaggcttattcaagcatcctgttgctgaatgcatgtcgtccttaccacatgactctggaggttttcttgtattctgatgtggctgccctgttgaggcctgccccttagagtggagattatcccctgcagtaggctgcctggaatatgatccccagtgatccctgcttcctggtattcaggccctggtgtgatccctttcccttgaagcctgggctggattagtgacttgcttctaaccaacagcatatggcaaaaataaatgtttattgttttaaacc

SEQ ID NO: 235809 - DNA, 183 bp, Homo sapiens
gggtgtctgactaggcttcgaacttgggccatcagggccgggcatggtggcgcacacctgtggtcccaactatttgggaggctaaagtgggagagtggcttgagcccaggagttaaggctgcagtcagccaagatcgtgccactgcactgcagactggacagcagagcaaaaccgtgtctcag

SEQ ID NO: 235810 - DNA, 700 bp, Homo sapiens
cacattgtgttatagaggtggaaataacacaaaaaggcacaaagatgtgttttaggataaagacttccatttcaccacaggatgcttaaaaaatatttgtttcacctctacattgggtggggtacagcttcctaaatcacctgctgctttcaacagtaggcatactttcttgtcttaggataattctcaattaatagcagaaggcacaccagacttctgacataagagcaatgcctctaatctagagcagtgagccgagtattgttaaaaggatcaaacaagataattttttaaaaacctatgcaatacaaagaatgtatcacataattatcatatataatattctaactaaaatcaagatataattttatatgagtgatctcattcttgctgttttgttacctttttccactcggcaatgtatcatgaaacctcttcatgaaaatgaatacaggtcaactttactctttaatgactatgtagaatcctattcagattataccttaacgtatttagttagccaatctccttctaagttggtccaatttttcggcacgacaaaccaccccatagcaaacaactttgtacctacagccctgcatttacccaacttttttcttcaggaaagattcttaaaaatatacatttatggccgggcacggtggctcacgcctgtaatcccagcactttgggaggctga

SEQ ID NO: 235811 - DNA, 420 bp, Homo sapiens
tgagatgtatgcctgcctgtaaattcacgtttctgaggaagtatataaggtttgtttagttgaagatagaaagagaaaagacaatgatactgccattattgaatgaatgaatgaatgaatgaatgaatgaatgaatattttgagaatatgctcaggacactaagccagatggagaagatggattctttttcctaaaataggtaactaagccctctatctttatgcatcttacctttgtggagaatacattttcagtaataaatctagtgacattttctcaatcttcattcaattctatcctaaatgtaataatatatttgcctttagcctcattccatctcctgaaactgggtttttgtttgtttgtttgtttggcttctctgaaatggtacgcctatacttgcatttctgattgtccct

SEQ ID NO: 235812 - DNA, 581 bp, Homo sapiens
agcctaatgggaggtgactggatcatgggagcagagttctcttggatggtttagcattatccccttggcgctgtctttgcggtacttctagcaagatctggctgtttaaagtattggctggagttggcgatgactcagcagatcaaggctggaagactcattctcgtcaggtggttgacgttggctgtcagttggaacctcacctggggctgtttgccagaacacctacacatggcatgtccatggagctatttgacttcctcactgcaatggctgggttccaagagcagttatcccaagagaacaaggcagaagtgcatgacttttagaatcttgtctcacaagtcacacagagtcacttccaccatcccctgttggtcaaggaggacatgaaggtcttcctaggagcacggggagaagacagacttctaccacctgttggaaggagtgtcagtgttacatagcaagagaagcacatggaatgggatgtattgtgatgcccatctttggaacagacaatttggcatatctgtgaaaattaaaagtctgatttggatataacaaatgagactgattagcaa

SEQ ID NO: 235813 - DNA, 513 bp, Homo sapiens
tttctcagtctcaggtatttttttatagcagtgcaaaatcggcctaatatattgtctgtatagcattctgatgattagttcttcactgtgtattaagattgacttatgttgctgcatgtatggctaattcatccctctgactgcttcagaaatattccactttattcatatttattcaacattttacttatctattcccccgtgtactaaaagtcaaaagcattactaatttaataatgtcatatttgttcttctaattattttttgctgcataacaaagcactcctaacttagtggcttacaatgataacagtcatttattttattcaaaaatctgcaatttgggctacaattggcagaacagctcatctttgctccttacagtattggctggagttggcgatgactcagcagatcaaggctggaagactcattctcgtcaggtggttgacgttggctgtcagttggaacctcacctggggctgtttgccagaacacctacacatggcatgt

SEQ ID NO: 235814 - DNA, 1111 bp, Homo sapiens
ttccagaattatggcaaactaggtgttctgaacccctgaagcccttatatgtagaacatccaggattactgcataaaaaaatcacaagtttccttttaatgcataactgagatcaaaataaagtccctaagtttagaaactgcagaggaaactgaaactcagagaggcaaattgagactgggactctccaggggaaatctgatgacctggataatccagcaatttaagttttaatggctgcacagggacagggtcaaagcccatggcacaaggaaccagaagaatgaggagccaaagctgggaccactgaagggctacatcctcaatggatgggtggaggaggcagagaaagaccttagggaaccactctgccttgacctaggcgctcagctcccttgagaatgtatagccacaggtttactccctcggggtttgagattgaaaattgcactccttgcattgtccaagaaactacaagcagagacattccacaaggtggtccccacagccagtgttcccaggtccgctctggagggacacagctgcaactcagacccccataggatccccacttgagctcaccatcccacattacaaaatacacaaaagaacaagccaccatgagatgcagtcttcagaaagaacccatggaagagtcagacctcaagaacttcagacaatgtaattatcaactctagaaataagagaaggttcaagttgtgtgaataaatgaaaaagtgtatcaaaaataaaataaagaaataagatgctacttttagacacagaaatattaagtaaataaatggaatttctataacaaaaaaatataaaatcatggaaattaaaaactcaagcataggataaagtgcagaacagctgcatagagaattagtgaactcagacaggaaggtttgagggtaaaggtttgaggagagaggagagacctgtgtctggagctaagagccaagagatggagcacgggagggattaataaaaggattatcaagcagcaatgaagaggaagaaaactgagcataaaaaatttagaaactaggggaattttttaaatcagcatttcttaaaaccttctttactggtgcttggcagcttg

SEQ ID NO: 235815 - DNA, 422 bp, Homo sapiens
ttccagaattatggcaaactaggtgttctgaacccctgaagcccttatatgtagaacatccaggattactgcataaaaaaatcacaagtttccttttaatgcataactgagatcaaaataaagtccctaagtttagaaactgcagaggaaactgaaactcagagaggcaaattgagactgggactctccaggggaaatctgatgacctggataatccagcaatttaagttttaatggctgcacagggacagggtcaaagcccatggcacaaggaaccagaagaatgaggagccaaagctgggcatgattgctcacgcctgtaatcctagcactttgggagtccgaggtgggaggatcacaggcacaggccactacaccaggctaatttttggtatttttggtagaactggctattacatgtt

SEQ ID NO: 235816 - DNA, 682 bp, Homo sapiens
ccaggactgttgtgtagatggcaaagctgtggtcccgtcccttatcagcctgcctcgtctctcccagagccccgaggtgtgttgacctgctctgaacccttcagagcagcctgtgtgtgcaccttggaatgcaatgcaccaccccacagtctgaggctgcacccaggatcccaggccgagctgctgctcctgggatcgggcaacagacctccccccaactctgtccagactggagggtgggacattggcagctaacagatgtgggcatcgggttctcgggacagcatggaggctccaggcaggaagccgagcagggcgagcttccagtttccttttggtcctaggggtcccctccttccaaaccccaaaatgtctctccctgacactctcaggggaaaccagcctggctgtgacgccctggcccaggccctgccatgcctcacttctctcccacaacccccctgctcatggcacatctggtctctggctcctgtctactcgtgtgcatgcagcacccagcgccccctctcctcccacttgctctccggaggcctcagagctctcgggtccaggctcccagacccactctcctgagacagtgatgttcacttctgttatccacgtctcccatccatcttgcatgtgaataaagagattaaataaagctgcacctactgctgac

SEQ ID NO: 235817 - DNA, 356 bp, Homo sapiens
accagaaatggacccaatagagagtggggggagtaattatctacaggaaacatacacatgccatgcctccagctaccatgggctggatcctctgggatctactgtatagtccttattttttcattcagttcccacaaccaccctgtatggcagggtggtggtacagatgagagaactgaagccaaaagaagtcaagtgatttctttttcaggttggtcattggtggtgcagggatttaaaccctagtccagccaatggattccaaacacaaatggtcaactttacttcagcaccagtgtgatgagttttgacaagagacaaaaggaaagggtgggagaagttagaaatgtaaccca

SEQ ID NO: 235818 - DNA, 424 bp, Homo sapiens
caacctctacctcccagcttcaaatgattctcctgcctcagcctcccaagtagctgggattacaggtgtgagccgtcatgccccactaattttttgtatttttagtagagacggggtttcatcatgttggccaggctggtctcaaactcctgacctcaggtaatctacccaccttggcctcccaaagtgctgcgattataggcatgagccactgcgtctagcctctgctgctgttttgatcaaaggacatagttgcaagatagtgacctagtcaataccctcacccctttctccagctcctccctgtcctacctcactgtcctcttggggaacaggtgctcccattccagggccagccatcctgctgggagtttgcatctcaagcagcagcaggcccttcgggaggaggggagccaagatggca

SEQ ID NO: 235819 - DNA, 400 bp, Homo sapiens
agaagtaaaaaaaaaggacaagaaattaaatttttattagtacaattgtataagcttatatgaaaaacatatataaaatacctatgtactgatatattttgtgtaaatttaaagcaaaatataaaatatttaaaaggatagaaaatgttagtctagtgttgtgtttctttttagcttctttgaatttctaatcttatgctgcaaaattagatgtttagaaataaagaaattggggcatttagtttcataaacaatattcagcaaaaccaggaatttagaagaaggcatattaacatttgagattgtgactggtggaagtgatccaagttaccccatattaccagtggcctatcagtaccagtctgtagcaacttcagtccttgcttcctcaaaaagaaaa

SEQ ID NO: 235820 - DNA, 439 bp, Homo sapiens
ctggcgagcccagagatgggggaagaagggccctgagccatgagtgcacctcactgcatggccctggtcaggtccctctgcctcctggggcctcactgtgtccacagcctcctgcacgccacgaagcacctccccgatgtgccagctcccccagcaccagcctcatcccaaggaaggaggaggcgactcccactactcaaggggctgttccccatggcacccctcaggccgctgcaggagactataagcccctcacaaccgaggccattttccccactcccttccccgcaagccctaaatggcccagcaacaactctgaactctgatctcggtcagcccagcacgggtggggcaggaggttctgtcaacagcgagggaaactcgttaactgaatgtcaataggattaaaggctctgatggtccaggagaaaaatgtgac

SEQ ID NO: 235821 - DNA, 494 bp, Homo sapiens
ccattttcaaaggaagatatttttcttgacgtttttctacctttgaaaatacagcgatttgttaccctaggtttatgatgttggaacatactgaaacattagttccacaaatattctatacttaaagtttaactcttaagaagcaaatagatgatgagcagtggtcatttgagttacagctccttggagtaacatgctaggctttctataggcatgcaaacatggttggggtaaatgtgcattttttccaaaattgcttgaacaggtatgcatagataaaatagaactactaaggttcataggcagaagtacttctgtcgacctgaattagaatatttaataacatcagcactgaatttaacagctaaaatagaaagggagacttgatttttgttgttttacaaaagaaagcatacaaaaattcatctgcagaaagagctttctgaagctgaattaaagaatatttagctttttaagaatgtttgtcttcttta

SEQ ID NO: 235822 - DNA, 470 bp, Homo sapiens
ggaaaacagctacggagggaaggatgagaagcaatgcaaagtgacatataccatcctggccacagcttcccaagttgggtcctttgctgggtgcactcatgtggccatgagggacatctcagagagactgcagagatcagaaaaactcatcaaaatggagacctgcaaataagaggaggaagagggaggagagagagcacagaaatcttccaagtggcttcagtgacagaaggggaggagtcaccacctgccatttgcatggaagtgtttttgttcctctggtttattgctcctatttatgcatgcgtgtgcaggatcttcaaaatccaggtaagaaacacagtgaagaactcatctactgcaagcttggccccatccatcagtaccagtgaagagagacaaatcaggatagaaagacatcactaccatctctatggtcagtgatattatggactaatgaataaaaataa

SEQ ID NO: 235823 - DNA, 1842 bp, Homo sapiens
aaacacagagagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacagagaaagaaaaagaagaaccgttactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcaagcaaaaaaaaaaaaaaaaaaaaaaaccccacaaagtcaaaagacaagtttgaaaaatgtttacagctccacaaagatagacaaatttccttgatgtatgaaaaatgtcaacaaaccaataaaaagactaacaattcagtagaaaaatggacaaagaacaaatatggagattcatagaaatgagagataaatgtacatgatgagaaggtgaggtgctcacttgatttataagagaaatgaaaattaaaactacaccagatgccattttttaaaaacctattacattgtgaaaataaaaatttagcaaattgttagcctgaatggggagataggtacttgaattttgtgtgggaatgtaaattaggacagtctttatggaggataattttatagaatccatcagatttataaatgcacagacctatttgacccaacaatttaacatccagatttttatcttatgccaaactgaaatgaagaatggccaagttttattgaggcatcatttatagtagcaaaacactggaaacaagctaaatgttcattatagaagactggttaaataaaaatttgtccatcgaagatggagtagcatgtagttattaaaaaagaataaggaaaatactgatagaggatgatgtagatattaaatggggaaaaaagtaaaactccacaagatgtagaacagtatatgtgttttgctgccgtttgaggagaaaggagaaaatacagaaatatttatatgttgcttatgtatgcatacaacatttgtggatggattcacaagaaaatggtagccttaatttaccttgagacaaactgagggacaaggacaccctttaatacctttcagatatttttttttttttgagacagggttttgctcttgttgcccagcctggagtgcaatagcgtgatctcagctcaccacaacctccgcctcccaggttcaatcggttttcctgcctcagcctcccaagtaggtgggattacaggcatgcgccaccacgcctggctaattttgtatttttttagtagagatggggtttctcatattggtcaggctggtcttgaactcctgacctcaggtgatctgcccacctcggcctcccaaactgctgggattgcaggcgtgagccaccacacctggctaccctttcagttttaagccataataaaaattacatgaaattgggctgggcacgatggctcactcctgttatcccagtgctttaggaggctgaggcaagaggatcacttgaggccaggagttccagaccagcctgggtaatgtagcgagaccctgtctctacaagaagataaaaaaattagctgggtgtcgtggtgcgtgcctgtaatcctagctactcaggtggcggaggtgagaggattgcccgaacccaggagtcaaaagctgcagtgagctactgtgatcatgcctctctactccagcctgggcaatagggtaagatcctgtctctg

SEQ ID NO: 235824 - DNA, 410 bp, Homo sapiens
cctccatttccccattgctaaaatggggatcttgccagggggctgcgagaatcgaaggggacagcggcagagagctccaggcttgccagggcgcccaacaggtctgccttcctctgccccattcatttcctgctacctgggggcctccgggcgcctcacgtttctgagttttaggggccagacgtgccgcaagccaggtccccgcccggcccaaggccgtgcatctcccaccccctgctgaatctacccggccaggctgtcccctggggtgaggggacttggcctcggccagggcccggcccccctcggggcaccccggcggcggctccacgctcccgcccgtgcccctcttccaggccggccacaagtcccgctgcctcccaaccccggctccagcccctccgcggccg

SEQ ID NO: 235825 - DNA, 326 bp, Homo sapiens
ccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaa

SEQ ID NO: 235826 - DNA, 418 bp, Homo sapiens
ggcatctttttacctcttcatcaggctccttctggaagattcacctcaggagtttcttccttcaggaagcatttcctgatcactccattcagggttaagtactgttttcttggctgggagcagtggctcatgcctgtagtcttggtactttggaagacggaggcaggcggatcacttgagctcaggagttcgagaccagtctggccaacatggtgaaaccacatctttactaaaaatacaaaaattagctgggcacagtggtgcatgcctgtaatcccagctactcgggaggccgaggcaggagaatcgcttgaacacagaaggtggaggttgcagtgagccgagattgcgccaatgcattccagcctgggtgacagagtgagactccatctcaacaacaacaacaaaattaaattta

SEQ ID NO: 235827 - DNA, 657 bp, Homo sapiens
aatggaggccataagagaaaataaaatttattggaaaacaacgggatgagataaaaagggaaatggataaaatatgtaaggactgcaagtaaactacaaacataatagcagaattaaacttcactgtagagatcacattaaataaagacagtgacatagaatcccaaactgataagctttcccacaggaaaatcaaataagaaatcagaatattgtgaaagaagataatagatacagacaacagagaatggaaacccaaaataagctgtactcctgaaaaagaggacaaaataaatggaacacaaataataatcaaattaatatatggaaattttgtggagctgaaaacatacctgtatgcagatggcaagtgcctgatctaccccagtgaaagaagacatctatgcctaaataaatgttaagaaaactactaacttagttaaaagataaataaacatcttacaaatgtctagatacaactgacaaaaaagaaaacaagcaaataatgcatgaacgaaaataaggctggtgatattcttctcctattgtaaccctgaaagtcagaagacaatgaaacaatgtctgctgagtattcagagcctttcacaaatgaataagagagaaagagatcttcaggtattcacactgtaaaattta

SEQ ID NO: 235828 - DNA, 691 bp, Homo sapiens
aaatgctaaaggaaagattgttcaggctataaagtgagataacacccagatggaatcttaagtcttcaagaaggaatgaaaaaattttggaatttgtaaatataaaagactagtttttcatgataagatctttaactacacaggacctgttaaagcaaaaattataacattgtcttgtggtgtttataatgtaatatgtacagatgtaatccatatgactttatagcataaagaatggaggcagtggcaaatggatttatacagttgcaaggttttccaattttatatgagatagtataaaattaaatctaagtagactgtgaaagatcaagaatatacgttttaattcctagaaaaaccaccgaaaatccaaagataaaatagaatcctaaattaagaaaaaaatgatccaaaagttgcagagggaagaaaaagaaaaacaagaagtggaggagcaaacagaaaacatataataaacttgcagctctaaatgcaatcatatcagtaatcagactaaatgtcagtggactaatcactaattaaaatgtagcagtgtcatagcaaaattctacctgatgtacaaagaagagctggtacaattctactgaactattccaaaaaattgaagaggagcaactcctcccaaactcattctgtgcatcaccctgataccaaacctgacaaacacaca

SEQ ID NO: 235829 - DNA, 183 bp, Homo sapiens
tttttattttgctataaatgtctctacaagcagctgaactttaagaattatgacctgtcttgatctttgccaaagattggcaaaaacttagaaacagaagaaatcagcactgtaataaagttttaaccaggtggagagctcatatccaaggttacttgggtctgagtcttcccagcaaaaaaa

SEQ ID NO: 235830 - DNA, 417 bp, Homo sapiens
attctcattttttccttgtagagaaagtggggaagggatctgaataattttcaacttaagtagttctagcagctttgtcggtgaggaaaaggagaagccaaatttcctgggttctgggatttttaaaattgtgttttaagaagctactcttggcctggtgcggtggctcacgcctgtaatccacccacccgaggcaggtggatcacctgaagtcagaagttcgagaccagcctggccaacatagtgaaaccccatctctactaaaaatacaaaaatgtggtggtgctcgcctgtaatcccagctactagggaggctgaggcaggagaatcgcttgaacctgggaggcagaggtggcagtgggccgagatcgcaccactgcactccagcctgagtgacacagagtgagaccctgtctc

SEQ ID NO: 235831 - DNA, 487 bp, Homo sapiens
accatgcccactgtgtcagttctgccctgcgctcatgtctttgagcctttatttattgctccctctgctctctcatttatctgattaccatttcagtgacttcaaaactcagcccaagtgtatttggaaagccttcccaacctcctccaagatccatgtgacatgtgcgtccccaagccagataaccagggaggctctggctggccgtgtgaatgttatcttaagatgttagtgaaccttccatgcccaacaatacccaaaacaattaggtcagatatcctcaatgggaattacggcagcatcaggccactcaaggttttgctcttttcagggatgagaactcagtagaaaacaggaattccccaccagtaaacacagaccctctcttgcaaatgctggacatgtatgcaccaactgactcttaagggcatgtttgtatgtgtgtgtacatgtgttgatcatacaataaaattgactattttagtgt

SEQ ID NO: 235832 - DNA, 331 bp, Homo sapiens
tccagcctgggtggcagagcaagactccatttcaaaaaaacaaaaaaagtagaagaggaaagccaagagtcagagggacatgtgattatggaagaagtgggtgatgccgtgtgagaagccaccattgctggctatgaagatggaggaaggggtcatgagtcaaggaatgcaggcagcctatagaagctggaaaaggcaaggagatggattcttgcctagagcctccagaaaggaacacagccctgccaacaccttgattttagcctgctgagacccatgtcagaataaactagagatccgtgtgataataaatgtgtgttgttttaagtca

SEQ ID NO: 235833 - DNA, 347 bp, Homo sapiens
taggcccctttgtctgcagagtcagtcatttggggtctggccttctgcagggaaatgaagatgagcttggctcagagcccaaactcagggccgggggacagggggatgcacactcgccggggggcctttgacacagctctgtggctcctcccgacaacctgggtaggatgttatgatcagccccatttgacagatgagggatctgaggcacaaaaagggagagttggccgggcgcagtggctcatgcctgaaatcccagcactttgggaggccaaggcgggtggatcacctgcagtcaggagttcgagaccagcctggccaacatggtgaaaccccatctctgatta

SEQ ID NO: 235834 - DNA, 625 bp, Homo sapiens
agaaaaacacggcgtcaccgtccggtctataatgcatgaccttagtctaatcatgagaaacccaagctgagggacatggtacagaataactgatctgtacccttccggaaatgtctgtattatgtaagacaaagaaaaactgaggaactgttgccgattacaggaaacgaaaaagacaactgaatgcaagacatggtcctggatcggatcctgggtggggattgctataaaggacaatactgaaacagcaaaacttgactatattagataatagtattgtatcaatgttaaatttattaattttgattatggtacagggttatgtaagagactgcccttgttcttggaaaaaaatgctgaaataattagggacaaaaaggacatgatgtctgcaacctttatggttaaaagaaatatacctatacatatacatagagaaagcagagacacaaatgtggcaaaatgttaatcagttaatctggttgaagaatatgggagttctttgaacatttttgcaacttttctgtaggtgtgaatttaagcataaaaacacaaacagcgttttttttttgttttttttttttgagatggagtttcactcttgttgcccatcttggcctcccaa

SEQ ID NO: 235835 - DNA, 497 bp, Homo sapiens
gagtgaaaaaacttcagatggctttctcagtgccagaactgtgttctgatcttgtgtctcaccctagagatgacagcacttctgagagtggaggggttgggacagattttttgagatgatggggagtttgaagaatttctttgggagacttgagagtgagtctgttagaggtgaataaataagctgcttaaggtaggaaactctagcatggggtattaggaagtccaggcagcatggtaatttgacctaaccggcaatgcttagaagactgggaatagaaggaataaatttgtggattaattctttagtgggggttggaagatagacatggcagaaagccaagggaggtgctggagtcctaccaaggatactggggaagcatcgtgtggtccaggtggggtggcaagtatagctcaaggaaggattagcctcacagcctagcagtgtgcaagagggctcaggatctaggggttctcaagcctaggaagttgtggtca

SEQ ID NO: 235836 - DNA, 416 bp, Homo sapiens
gtctctttccaagaacaaagaaacttttccctaaagaccctaagcaaacttcttttaatagctttttgccataattatgtcatataaatcaatcaatggcaaggagaatggaattatcatgattgaccatcataatcagtatttactcccaaggaacactaaatgagacaatataggcagcttccttagcaccgtcccttagcacaagatgtcggcattcagtaaatgtgaaggattttctccattagtcaagaaataggcatattctgtggaattatgaaggcaaccaccaaaagaaataacactgggccagataaaatacagtttctcctgtaaactgtgtctgtattaaaagagaaagggaagatcatattttctttttaatatgtttttaattatatggttgaaattgcttt

SEQ ID NO: 235837 - DNA, 354 bp, Homo sapiens
atacgatgcaggcaaatccataaacatttgctgaaagaatgacagaaatcagtgtatgactataccaggagatatgagaaagaatgttgatagcagcaaaaatatagttttaaaatcttgcttctttttctgcactgttgccaactatctaaggagaatatgcaaagtgaaagattatcttgaaactaagatttatgagaatacaaaaaatagcatcaaatgttattcttaggtatcaaaatgtctaacaaatactacaaaagtcgatagtacaaggaattcttttaaaaccaccaggccaggcgcagtggctcatgcctgtaatcccagcacttttggaggccaaagcgggcg

SEQ ID NO: 235838 - DNA, 721 bp, Homo sapiens
ctagcatccgccacatctaccccagttctcatcagaacaacaccatggacagctgtttccatagcctccagtgtttgcacatcactcctcaccctgtgtgctgctggaatgttagtagagccatccctgtaaccaaggaatggcctgagcggaatgctattgttcaatgttgtttacagctcttaaaacacagtgaggaatgcctaagtcatagagaccaaatttgaccttgaaggcagacatgacacaccttgtccaagggggaccaaaagggtaggacattacaggctgaaaccctctgacccctcatgacaatgtaggacgtgacttttgtcttcttaagaaataggtcatggagccaagtgaagtgcactttgtcaaatgtaagggtccgcttgttactcattttctgtttgttaacctttttttccatcatttaacaaaaaccaatcttacatttcttgtcaaatgcagaaatgtttattctggcaatcagtgaagttttgcattgtgtgtcagatatatagccggacatgttctctgtccccatttttcagattctgttcagatgacatcaacccatttcattccccccaccacctcacccttacaccctttgggaaaagaaaatcaccttgtgtgctgtagctcatttgtttcaagacagaatcaacagatcatatttggcatcatgaataaattgctctattttgatactgaa

SEQ ID NO: 235839 - DNA, 478 bp, Homo sapiens
gcaacagcaagactccgtctcaaaaaaaaaaaaaaaaaatgcaagcagaaaggaagtaaaagaaaagagaagaaaagaagaaaggaaaagtaaatgagcttcttggaaagaaatacacagaaaaaaggccctggaatttaaataaggccttggaagatccatgtggcttcatttgtaaaactggtgagctactcaagaagtaatgaagaaagagcactttaaatcaccatcaggccaggcgtggtggctcatgcctgtaatcccagcactgtgggaggcagaggtgggcggatcacttgaggccagtagttcaagaccagactgcccaatacggtgaaaccccagctctactaaaaagaaaacacaaaaattagccgagtgcagtagtgcacgtctgtggcttgagcctgggaggcagaggctgcagtgagccaagactcactgcactccagcctgggcaacagagcaagactgtctg

SEQ ID NO: 235840 - DNA, 408 bp, Homo sapiens
aatacaaaaattagctgggcgcggtggtgcatgcctgtaatcccaactactcgggaggccgaggcaggaaaatttattgaacctgggaggcagaggttgtagtgagccaaggtcgcgccactgcgctccagcctggacaacacagtgagactctgtctcaaaaaaaaaaaaaagacattatgacagattttatcttttaataaaaatgtattatatccctaaagttatatctatatgtaattgagtcagaaacctagggggatgtcgattgaagtcgactgctggaaaaaaatagcagagcaacaagatccacacatttagaacctcatagaatttgacacattattcataatggtgcaattctttcttttttattccagtaagcaaatttactaaatcactaatttg

SEQ ID NO: 235841 - DNA, 417 bp, Homo sapiens
ctggggatttgtcctagaggtatgacaccacagcctggggccctgttatgggctgaattgtgtcaccccaaacccctatgttaaagccttaaaccccaatgtgactgtatttggagaaggggaccttatggaggtaattaaggttaagtaaggtcataggggtggggccctaatccagtaggactggtgtcactgtaagagaagagacacttcagaaccacctcccttgccctccacaacacacacacacacacacacacacacacacacacacgaaaggcagtgtgaggacatggtaaaaagtagctgtctgcaaaccccaagcagaggcctcatcagaaaccacccctgatggcaccttgatcttggacttccagccaccagaactataaggaaataaactcctgttgtttaagc

SEQ ID NO: 235842 - DNA, 394 bp, Homo sapiens
tggctagcacctgactgcagtggtccttgttcagctgctgagagtaggaggcccgcagggcctgcgcccggcctaagaggccttgtgcacgatggctgcccaggtctgggcaaaggaattgtttgggagatactctgtgttttgtccagacatgagaccaggagcagtggtgatcagaggctgccctctgactcctggtgctcaggagctggtgcctggagtatggagcgcacccaggagacgtttgccaaatgcatgagcttcatgtgacacctgctgtgcggaaatggacacacaggcggcagctgcgctgcggacacatattccttgtctccagcagctcagcagaagctcctgctcttcctgcttgtggccaccttcccatgagcaagca

SEQ ID NO: 235843 - DNA, 468 bp, Homo sapiens
cgaagagcatcagagaataaataagtgaaagtaaaataaaacatcactataccttgagtggtaattaggttctcaagtttttggttacatgaatccttcagtcaatgtctctgatgagaatcagcttttgccagctttagttagaacgtgaactaccttgatcaagtctcaggacttctttctttcatttaatgttagtagatagcactgagtgttttccatgtttataatgttaatatcaggctacagtattaccatgttggtatcagacggcaatcattgtaataaaaccacaggatcttgctctcttgtgggattctaggctcaggcgtttgactttagaaagttcatgaacaccctgaaattatatgtactatgtatttatgcatgtggtatgtatcacacgtttttctgagtcaaaagattattagttcatcagatttttgtaggtaactgagatcccctgta

SEQ ID NO: 235844 - DNA, 2132 bp, Homo sapiens
catgtctggagaccattttcaacctgaatttatctctgatgccagtccccaagatgagccattggttgcttattctttggggtcacccaagatggcagcactgaaggccacatggctggggttttctataccttgggattacatgttatacaaaacagctgactgacaatgcagaatgagggaagggacacctccaaattccttcagcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtccgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatatggggagatgtaataaaacaatattaacttggtttcttgtttttgctgtatttagagattaaataattctaagatgatcactttgcaaaattatgcttatggctggcatggaaatagaaatactcaattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgatcgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataatgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaattagttaatatacctaaagtacatagaacactgcctgcacatagtaaaagaattataagtgtgaggtagttggtaaaattatgtagttggatatactaccgaacaatatctaatctctttttagggaaataaagtttgtgcatatatataatcccgaaacatg

SEQ ID NO: 235845 - DNA, 406 bp, Homo sapiens
taaggactgtgaccctatctggaacttcggtgaatggaatgagtgcctaactttctggccagcccttttctgcagactgtacctacctgtcccctaggtatcccaccactggcctggctcttcctctgccttgtacatagttcagaaaaagcctgaggggccatttttaaaaaaataaataggcttgggtttgccattccctctggagactgtgctttgatgttttgatggtttgaagttcatgtttgcctctgggtcggttacgatgtcaccacagttctcaagttaggttgtggaatctggactttcgtactctgcttaatgttgctgtgtgatctatcagcattgcatccaaacacgctaagctatgactcacatgttgtatacttgtgaaattggattcttt

SEQ ID NO: 235846 - DNA, 416 bp, Homo sapiens
tctctgcttaagtggatggcctagtcaagctccaaggcctggctgaggctgaagaaaaactggccgccttctgaagctctttctaaaagcctgtcactgtcatctgcttgcatgtcaactcattggctgtgaggttgagctgagtggcctgtgtccatcttcttggggaagcatttgaagccatcaatcttgctctcccacccctaaaggttgatggtccccacctgggggtgtgctgagggtcagaaagaagccagcactcaccatctcatccttctcagccttcctcttgcactctctccaggctgtctcttcagtgctggtgggatacatcagaaagtgatggaagatgtggcactgtgcccacacccagaagctggccatgtggttggctcatccaccagaatggacgctct

SEQ ID NO: 235847 - DNA, 282 bp, Homo sapiens
agagagagactgtcgcaaaaaaaaaaaaaaaaaaaaaaaaagaagcccctgagatcaaagattcatttgcagcagcctagttgcttgttctgtggtgtttcacctgtcttgaggacagcattcttgttttcttgataataaaaacataaatacatgaaaatctgtctaagtcacccaatctcccacaaaacaatctgcctatacatcatttccaagcacgattagcatttgaggtgaagttctgttatacactcaggctgtggctctctgaaagtcagtgca

SEQ ID NO: 235848 - DNA, 512 bp, Homo sapiens
tctctacagcttctttccccatctcctaaaatccaacccttttgtgctccatgtgggcaaagttgagtgggactgtggttacaagttgagagtagttcaccagctattagcctctatcgtagagtctgcttttagtccaggacctcttttggatcgagcatctagtatattttgatgttttagcaaaacttccattttaacatcctgttgcaattatcaaatatttgcgtggggggtgtatattctttcttcttccctagagcaactgtgttgtgtcatactcagtaaaactgtattcatgccaagatgggcttgtacacagagcacatttcctgagatgccctgtggatgcttttttaaatgtcccttttaaaacagtgcctgaagttcgcagatggatttaatttttttcactggtttatagatgcacttcctttcataggcagtccctggcactttcttgccctaactcttgcataggttatatatccaaataaaaaatgcttcttaca

SEQ ID NO: 235849 - DNA, 288 bp, Homo sapiens
tattcaggaggtcaaaggcagaaggattgcttaagcccaagagttgggattcagcctgggcaacatagcaaaatcccacctctaaaattacaaaaaaaggaaaacaaagcaatcagttgtgtaaatacaacagcatctcagagcccctcaagtgtgatcctgacatagctgaagccattgtggatgctttcccaccaccatgtatagctgccttatgtagcacgcacagatgtgagcagctggttccaacaccagaaaaagaaatgaaacttctcttgaatacgagct

SEQ ID NO: 235850 - DNA, 419 bp, Homo sapiens
agcctcctctaacctccgcaggatggggcccggcctggcagctgcccccagtggccaacgtgggcctctgtggacaagacaggtgcagctaaggctgcaggtgcaaagcaatcccagggtgggcgggcagggggccacctgaacctctgtacagcaaaacagtgttttcctgggatctccctcttcctgttgttctgtgaaagcacctaccagccatgtgaaaagccacccggctaaccacccacatgcaggcgtctggcacagggtggctcactggccgttcaggggtcggcccctcctgatgtttgcatgtcccccttgtgtgaaactcagatttaatttggtgattattaaagtgcaggaacctggggctggtagaggttttttgtccacagattttgcaaagtgccgttaaaaaa

SEQ ID NO: 235851 - DNA, 275 bp, Homo sapiens
gttattctcattatccccattttacagctgagagagcaaagcttcagagaagttgagtaacttgtgtcactggttgcaaactggtatagccaggtttcaaacgtggtgagtgtgactccacagtccacaccattaaccattaggcacatgagcgtgcatgtgcattcacacacacacacatgcacaattgtgtagtcaatttcaagggatttgtggctctgaaagtcctcttttggggaccagttccaggtgagcaacacttcagaattaattaa

SEQ ID NO: 235852 - DNA, 626 bp, Homo sapiens
gggcaaggttttggcatctgcttctttgtaaaggtagatctgccgggagcacttggtgccggcctacaggaagtaagaactctgcaccaccaaccccaggcacacctctgagtcataagtcttggaagacttctgaaagtcataagtcattagaattatgcaacaggctttgggacaaatgagacgttggagagagctattctaaaatctgaaagaaaaaagctagttttaagaaaaaaatcacaaatgatagttacatctttgaatattgtatttttaggaaaatgcataccccatttgagaaggttagcgaccttggcctaaagcgttgtttatgttagacatgaggagttgactgaaatgtgctctcataagcatttctagcaccatatttacaacgttggcccacagccagaataagacgtgatcttcctattggactgggttcataggagcgtttgttccttaaataactctagtctaggctgggtgtggtagctcacgcctgtaatctcagcactttgggaggcccaggcagacagatcacctgaggccaggagttcgagaccagccgggccaacatggctaaaccccatctctactgctgtaatctcaggaggctgagg

SEQ ID NO: 235853 - DNA, 1989 bp, Homo sapiens
  misc_feature (842)..(842): n is a, c, g, or t
  misc_feature (981)..(981): n is a, c, g, or t
  misc_feature (1920)..(1920): n is a, c, g, or t
aaaaaccacataggtggtgtgccagtggctaaagtttgagaaacactgatgtaaaagctaaaagtttgaaatcagacagctctgactttgagtctcagtttgtctctatgagctttcgtttcctcacttgtaagatgcaaatgataatagtacctatgtcatacaaatgaatacaaatgaagtaaggattaagtgaaataatgatggtaaaacctccaacactggacctagtacaaaagtgcccactgaacagtgttacctctcatctatttcctccgtgctcaggagggctgaagaactaaccaggccgacgtctttatctttctatactgtccagtttgagaaagctgctaaactattgcctcaagtgcttatttaatgtttggaatctacaagagatacagtggttcttctttgaagttcaagctattcctttgaaaaacaatgtcaggacaacttgacattcatctccctaatgatagaatttcatttatttcagtctcactgtcttttgagccactatttagctttatttagtatatcattaaaaatatgaagttaaaagaaatcaaaaaccaaatcccctgtgtctctccttcttgcacccaatcagaagaaaaggctcttcgtcaaagttttacttattcaacaatattgtaattactttatttgtgctaagtactttatttgtgctaagttgttttgtgctatatagtttgtgctaaatactaggcattgaaaaagtagcagtaaacaaatgtctgccctttcctagcttatattcttgtaagaaagcttatattctagcagaaagcaaaatgaggacctttgttttcttttcnttaaattacaaagactatgattataaaatcacccttgtaaatttttgaagagttttgaaaaatgcaaagggaaattctaggaaattcttacattttcttatattttcactgataactaacctaacctctctttcttctntcatttttagttgaaaagctttcaaacatattgattttaaagtttataagcctgtagttacagacagcagaaatgaatttttcccagaacaggctatggatatgaaagtataagttgttttgatttatagtctttattgctagagtagttattattataaaataaaaaaatacctttaaggaaaccaatttcaaattatgttgtactttccaaaaacgtgtttaaaatgcagttaactggagtaaatatgccatttattgttctgagtaaattggattctcacttgctctgtgaccttacataagttatttacactatttgagtttcttttcctcatttgttgaataagaggattgggatacacagtcttgataattcttgtgtatggcaaggcttacacaacagaatcagaaaggttgagctgtgtatccctggacaaattggttgaccactcaaagaccctcctttctaatctgtaaaataaggactgtgtttttctcacagtgttgttataagaaaccaataattgtacatataaagcacctaatatatagtatgtgctcagtgaatgatgtcatcatttcttcaagtatgaacaatcagtggtcatgactaaacacccacgtgtggcttctggtgttaacaccacctaagtacaaaacaagtataaaattcatttgctagcatcaaaagatttgaaatccatttggaggaacatgatacacacacacacacacacacacgcacgcacatgtatttgtaattaataattgatatatttggaatatcttcaaaatatcccttttctgctttcctttgggggagacaaagagtggagtgggaaaataatgtgcactctgaagccacagagacattatcaaatctcagttctgacagttactgactgtttaaattttagtggagcacttaaactcttgngcctcagtttcttcagttataaaattggccaatgacatctatctttcgtgtttattgggaggatcgagt

SEQ ID NO: 235854 - DNA, 212 bp, Homo sapiens
ggcagcagggacacttccgagacactgtggagctttcagacccgaaagtaaaatgtgtgtccaagcccaagggtcacggctgcacgaggaagctgagttgccctgcgttccactgtctggacgttcaaatggtggtaaagcagcggtgttcactcgcatttgtctcacagaagcttctggggcagggggtggggggacctcagtgctacact

SEQ ID NO: 235855 - DNA, 473 bp, Homo sapiens
ttttacagaacatttccatcaccccccacaaagatctcttcatgctcatttgtagtcaatacaaatcccagcccccagtgcccactgatctgttttccattccttattgttttgcctttcccagaatctcatctagactgaatcatgtagaatgtagtcttttgagtccagtctttctcacttagcctaatgcatttgcgattcatcaatttagttgcatgaatcaatagcttgttcctttttatgggtgagtaatattccttggcatagatataccacaatttgttgatcctttcaccagtggatagatatctgggttgtttcaaatttggggcaattatgaagaatacatgcatacaagtttttaggtagacatatattttcatcgttcataggtaaatatctaaaaatgggattgctgggtcatattgtggatttatgtttacctttataagaaactgaagggcagaata

SEQ ID NO: 235856 - DNA, 628 bp, Homo sapiens
gtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatac

SEQ ID NO: 235857 - DNA, 511 bp, Homo sapiens
ctagaaagtcatgctggcccttttgggtccatgggccaaaggttcatgaaggtggctctgcctgtgagacatcaagctcctgggttgaaggacttggattaagaagagtgacatcagtgcacagtttatgccaagggcttggggcctcagtccagcttcttcctggaccaccaccaacaacaaccagtgataaaaataattatactagtggctgacatttatggattcttcctacacactaggctataccacagcgagtgcctcgaaaggaaatatagtatagcactgtgccgtccaacatggcggccactagccacatgcactactgagcacttgaaatgtggctagcccacattgagatgtgctgtaaataaagaatagacaccagatttccaagacttagtaccaaaaaaagaatgtaaaatttctcattaacaagtttttttcttacatttattacatgttaacatgacgctatttggagtttaaataaatgcattattaaaattga

SEQ ID NO: 235858 - DNA, 306 bp, Homo sapiens
ggacagggccttgctgtgtcacccaggctggagtgcagtggtgtgatcatagctcactgtgaggcaggaaattaaggaaagaaagaagaataaaattttaaaaagagaaaaataagctttctatattaggctgactcatcccaaaggcagtaacagacaaagcccagacccagacgaagtcttgataacatcatcaaagaagcagaggctcaaaggagtgtgctctggagactctcccagcactccctcaacataaggataagaaaaagttccccctcgaaccccaaccccctccatgtgattgta

SEQ ID NO: 235859 - DNA, 818 bp, Homo sapiens
gtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctct

SEQ ID NO: 235860 - DNA, 942 bp, Homo sapiens
attccaagaaataaagacaaaaatgtctgggaaaaatcttccttgtggcagctaggatttgttttttgctttgttttgttttaactcttcctcccttttagttcttggtaacacactatttctggagagataagggagggagggtccagtgcctagtggcagggactggtgcagcttctgtggggtggagacggagatggggatggagagcgccattgcagagtgcttgtgaagagcctcccaggaactgggagctaggagcctcagctagggccagtaaggtgggctcacaccagggaccagctcatgggtcacataagccctcagggcctttgctcatcccacgtgggacatgccaggtatggaaccagcaggtggtcatatacttccaggctacgatctcattcattctttcattcaacaaatatttcttgagattctactatgtgccaggcattgtgcttagtgctagttaaacaaaggtgaggaaaatcaagacatggtgtctcccttcatgaagcctgcagtcttgtggggaagacagatgttaacaaaacatgtcttgttacaagttgtgatacatattctagagaagaatgctgagaaggaatggtgggagagggtcagaattgagaccaggggtcagaggagatctctggagaagtgacatttaaactgagacctgaaaaatgagtaggaacttggcaagggagtgtgtggtggtcaaagtgtgtgtgtgtgtgtgtgtgttgcatgtgtatgcatgtatgttgtatgtattatatgtattgtgtgtttcctgttgtgtgtgtgctgtgtgtgtagtatgtatggtgtatgtgttgtatgtgtgtatggggtatgtgttcatgctacatgtgtgttgtgtgtggatgtgtgttctgtgtgtgtgtgtggggtaggtatattgtgtgttgtgta

SEQ ID NO: 235861 - DNA, 1321 bp, Homo sapiens
  misc_feature (850)..(850): n is a, c, g, or t
ctggctggtcggaatggcatacttggctgaatgcacagccaggtggcttgggcatattggcaaacaactggcaacctgcccaatacatatggcttagattgctttgctcttcccatgaagccttcttagactcttgagcaagcattcgttttagaataaaatgtgtctgagtgttaaataaaattttttaataatatctgtctgatgtaaaatccctttaccaaaaataaaaataaaaataaaaagatgggaggggttggttgccaaatgcatgaaataaagcatttctttgtgggaggagactttgcagatcccttttcaaccatctttggactgaattatttggacctttcaggttcatgggggttaaaatgacccctgcaatccctgagaagcagggttaatgtgaagtttagggatggctgccaagaggtcaggtgactatgaattcctaataaatacataaaaatacaaagtaagtagagtaggataatggatgtggacagcagatacattttgtaaaggaatattatgaaatcttgattgacagataacactaaaaggtgttagtatggtctatcatgtaaatacatatctggagactcgttaaaacacagtctttaagtgctaactgttgaggcacatgttacttcccaggctttaccaagtggctgcttaacgtcgacagcatgaggcaaactttggtttaataaccccagctgatcactaatcttgtaatgctactactatcgtaccacattaaatattacacaaatactactttcttctaaagttgggttttcttctgttacacatgtttgttgtatgtccactgtttcattttagtttnctggatatctaaaaagtattcacaactgatacattagtgaattagattacatgcattactgtcagaatcctgttttacttatgataatttttaaatataagtttatggtcccttaaagttgcaagccattcatctaataaactatgttaaatcttctggaattattatagtctactcggtaaaaagattacagagctggtgttgtattgtgtgtgttttttaagattttaagctcagtaacagctcaaacactgaaataaattaatctctcatactaatgagggctccatacactcacaaatctaaaatctcttaggtagatgcaaacatatatattgcgatagaaaaggaatcatttgtgcttattcagcaagtactgaagatgtcaatcgtagatacgaacaagcaaacttccttttggtgatacaaaataaaatttcctgctatagttgctccatctctttcacatgc

SEQ ID NO: 235862 - DNA, 385 bp, Homo sapiens
aggtttcccggttttattcccattggcgtattcaggggtatttatgtcctcattcctttggtgacagtcttttaaaatctttgccaatctgataaaaccatgtgttaacgcttttaaatttatatttctttaatgattacgtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgcactctccctgaaataaagaacagcttggcaga

SEQ ID NO: 235863 - DNA, 556 bp, Homo sapiens
aggtttcccggttttattcccattggcgtattcaggggtatttatgtcctcattcctttggtgacagtcttttaaaatctttgccaatctgataaaaccatgtgttaacgcttttaaatttatatttctttaatgattacgtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgctgtgtgcaaggcctgtgtgtgtcagggaagcctttcttgtcacacatgtcatactttttccaatttgttttttgcatttgtatttttttattcagctcctatacatttaaaaaaacacctcagatttaatggttgtttttgttttatggcttctgggatgtgagctttatttatttcctaaagatcgtctcaaggaaaacaca

SEQ ID NO: 235864 - DNA, 168 bp, Homo sapiens
gacgggcagctagatttctcagaatttcttaatctgattggcggcctagctatggcttgccatgactccttcctcaaggctgtcccttcccagaagcggacctgaggaccccttgggcctagccttcaaacccacccccttttcttccaacctttctgtcatcatctc

SEQ ID NO: 235865 - DNA, 849 bp, Homo sapiens
ctttgaagaattagcctttcaagttcaaatctatttaataatgagaagtctcacaagtgaatttttaagtacaggcatacctcagacgtactttaggttccagaccatctcagtaaagcaaataccacaacaaagcgagtcaggaggaattttttggtttcccagtgcatataaaagttttgtttatactatattaagtgtgcaatagcattatgtctaaaaatatgtacataagtttaaaaatattttattgctaaaaatggtaacaaagtgagcacatgctgttggaaaaagagcaccaatagacttgcttgaagcagggttgccacaaaccttcaatttgtaaaaaacgccaatatgtacaaagcacaataaagcaaagcacaatagaacaggattgcctgtattagacatgctacaaacttcataactggaaacatctcaaagaccccatgaagctcatttgaatgggacttaacaattagacagttattttagaaattgagtgcagacctaaatacatagttttccaaaaagaaaattattgtctctgatatcttaaaacataaaaacccaaaattttatatagaagaaattgactctgtaaaacgcaatgaaatagtcctctttttaaacagtttaaaggaagcattttcaccgtttgtaaaaattatttttaaatatttagggcaaaatttttgttagataataatggaaaagcttgtgtgagtttagtggttaaaatatcttgtaattcatcattatttaagtgacttcttgggagccgtctttgtacctaaaatggagtttttttttaagcctccacagagatagtcacccaaagtattt

SEQ ID NO: 235866 - DNA, 308 bp, Homo sapiens
ccatttgctcacctcccgcagcggaggagactgggcccgaggcgcagcccctcgagttgcaggagagccgggacccaaaaggcttcccaccgtgtccggacgtcgcagggccgaggtctccctaatccggccttctccgcggcgcagtttggccagtgtctccacgtccgtccacccacccctccatccgcccttccatttgtccatccacccgaccctcggtggtcggtgcccagacgcacgggtcagacgcgggcgctgcctcgagggctcccgggccgggccctcgttcgcggcaggagcggccg

SEQ ID NO: 235867 - DNA, 491 bp, Homo sapiens
agtgggacaggtgtgtccataaatatgaagatcattctctccctataccagtcagtaaagacaggaggaggagactgcttcttcaaatgtgaaaacagcaacacaagccttcaaggaaaatgaagaatcaaggaaacttaacactactaaaagaaaaaaataaagtcccagtagctggccccaaagaggtgaatatctatgaactgcctgatagagaattcaaaatagttgtcttaaagaagctctgtaaactacaagagaacggagacaactaaatgaaatcaggaatacgatactgaacaaaatgataagttcagtagagataaaaatcatacaaagaaccaaacaaattctgaagcagaagatactgtgctaaagtgaaaattctacagagagcctcaataacagactcaatcaaacagaagaaagaatcagtgaacttgaaaacaggtcaattgaagtgattcagtaagagggagaaacaaacaaac

SEQ ID NO: 235868 - DNA, 98 bp, Homo sapiens
ctgtaaagaaattgtaaggttcaaggactttttcaagctcctcactttcaatttcttggttttattaaacagtgcccaaaagttgcagttacttaaaa

SEQ ID NO: 235869 - DNA, 458 bp, Homo sapiens
atccccacctcgccccaccgccccagtttacagatgggtagaccgaggccgggagcacctcgtaactccgcaaggccacgggctagacagtggcagagccgacgtctcctgtacgctctccacccccacccctctagagggagtttattttattccaatctaaaagttcccccctccgcccccaacctaccacccacccccagatccgccggaaaagtaaactgtggctggagaggaatctggggtgtgtggggagcggggaggcagggagcgggaaggatggatgtaatcagtgggcctgaacttcattcctgcccacgggccaagagacccttccctgcagaagttccaaactaggggttcttagaactagcttccccactcccacctcaaccttcccttaaaaaaataaaaaggctggtttcttccgggccagatcttggccacttaaaatggtc

SEQ ID NO: 235870 - DNA, 328 bp, Homo sapiens
cagtatataacattaagcaagaggctttataaagtgctgtatgcattatttattcttggtttttgttgttgctgggtgttttttttgtttgttttttgtgacagagtcttaccctgtcacccagactagggtgcagtggcatgatctcagctcactgcaacctctacctcccaggttcaagtgattctaccacctcagcctccctgtagtctcagctactcaggaggctgagacaggagaatcacttgaaccctggaggtagaagttgcagtgagccaagatcatactactgcactccagcctgggcgacaagagtgaaactccacct

SEQ ID NO: 235871 - DNA, 436 bp, Homo sapiens
tctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataatcact

SEQ ID NO: 235872 - DNA, 1588 bp, Homo sapiens
  misc_feature (1177)..(1177): n is a, c, g, or t
  misc_feature (1271)..(1271): n is a, c, g, or t
agtgcggggcgggtctagaactcacctgcggactatggaggccgtgcgtgtgggctggggcagggctgtgagcacaagtcaggggtgaggccaggacggccacagagggtgtggtgtggcaagtcaagtagctccttgaggaatatcgcagggttcttctgaagactggggcctggggcctggggatgggaacttgcgtatccctcccaaaaccctacctatggggggagaatgtggtggcccatgcctgtaatcccagcactttgggagggcaaggcgggcggatcacctgacgtcagaagttcgagaccagcctggccaacatggtgaaaccccgtctgtactaaaaatacaaaaattagccggtcgtggtggcacgcgcttgtagtcctagctaccctgggaggctgaggcaggacccaggaggcggaggttgcgacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcaaccgagacaaccagtccatgctgatcacgtgagtgtggggctctgggggtggggtggaaaatgctggccatctggcagaaagagggcggtaccacagtcatttcccaggattgaatccaaagtgcttaggccaggacttttaccacctggagctagtgtcccagctgaagctaaaattggcctgagcactttccctgcccccattctgaacagatgtgttcttgatgggggatagggaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggagnctgaggtgggtggatcacttgacgtcaggagttcgagaccagcctggccaacatggtgaaaccccatctctactaaaaatacaaaaaattagcngggcgtggtggcaggtgcctgtaatcccagctactcaggaggctgaggcaggagaattgcttgaacccaggaggcggaggttgccgtgagccaagatcacgccactgcactccagcctgggccacagaatgagactccatctcacgaaaaaaaaaaaaaaaaaaaaaaaagcaagtacctttaacccagacgggcccggctgagtgtggtggctcacacctgtaatcccagcacttggggaggctgaggcaggaggattgcctgaggccaggggtttgagaccagcctgagcaacatagcgagaccccatctttacc

SEQ ID NO: 235873 - DNA, 1578 bp, Homo sapiens
  misc_feature (1167)..(1167): n is a, c, g, or t
  misc_feature (1261)..(1261): n is a, c, g, or t
accgtggtgccgagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacgggaagaagcgagtctgggtgcctgatgaacaggacgcctacgtggaggccgaggtcaagtcggaggctaccgggggcagagtcaccgtggagaccaaagaccagaaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcaaccgagacaaccagtccatgctgatcacgtgagtgtggggctctgggggtggggtggaaaatgctggccatctggcagaaagagggcggtaccacagtcatttcccaggattgaatccaaagtgcttaggccaggacttttaccacctggagctagtgtcccagctgaagctaaaattggcctgagcactttccctgcccccattctgaacagatgtgttcttgatgggggatagggaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggagnctgaggtgggtggatcacttgacgtcaggagttcgagaccagcctggccaacatggtgaaaccccatctctactaaaaatacaaaaaattagcngggcgtggtggcaggtgcctgtaatcccagctactcaggaggctgaggcaggagaattgcttgaacccaggaggcggaggttgccgtgagccaagatcacgccactgcactccagcctgggccacagaatgagactccatctcacgaaaaaaaaaaaaaaaaaaaaaaaagcaagtacctttaacccagacgggcccggctgagtgtggtggctcacacctgtaatcccagcacttggggaggctgaggcaggaggattgcctgaggccaggggtttgagaccagcctgagcaacatagcgagaccccatctttacc

SEQ ID NO: 235874 - DNA, 234 bp, Homo sapiens
ccacacagtatgtaaatgaaagtagggtttaccatccagggcattaacttcattttccttgtcttcgagatccattaaatgctagtactgtatgagaagcgtggaccttaagtattaaagatggctttttcttcttcttcttcttatttagcgtagaaactagcaacagggaacaaggtaactgaattcacggtccactcgcaggcgcgcacgtccccagggctccgggacggc

SEQ ID NO: 235875 - DNA, 387 bp, Homo sapiens
ctcactaaatccctttcttcttccctatgctgtcttattccctttcatcccttactttcattcacaactttgtacaaaaagaaagctggatgactttcaaacatatgcacataagttgagaggtgctaacaatatagttggaatcattaaatactagagtatctcatggtgtttacattaagtgttataacacttggaatctgattctcctatataaatcactcttgcttagttattgttttatttgcttaacagggaaacaattacattttactttgatagtctgtgtattctgtaactatttaattgattctattagttttgtgactctgtatgtctttctgttattattttaattgtagcctttctggattaatatccaaaaaa

SEQ ID NO: 235876 - DNA, 523 bp, Homo sapiens
atcaaaatttattgagtagcttctaggtcatattcattcagctaggcacttggcagatacattactttgttaaaatagatggtctcatcaagattttacatatagtttctaagaagttgaaaaattcacatgcaactcatcaaagaaacaatttaaagataaaataccaagaaactccagctaaagataaaataccaagaaactccagctagtattaacaatggactacaataatcacttctttggaccctactgaggtgtgtgtatttgcccatctggatatacttagatgtgcttggatcctgggtgggaggcttggttagaagtcacgtggattcttctagggaatttatcaccatttttcttgtgatcttatgaccttgctgaaacttttaaaacaataataaagtcattttttttctctttgagatggaatctcactctgtcgcccgtgtcagagtgtggtgagctgagatcacaccactgaactccaatgtgggtgacagagtgagaccatgtctca

SEQ ID NO: 235877 - DNA, 513 bp, Homo sapiens
cagcccctggcaaccacccgtctgctttcagtctctatggatttatctattctggatattttatataaacgggatcctacaatatgtggtctttgtgcctggctcctttcacttagcgtaatgtttataaggcccatccacatcgtagcatgtactagtacttcattcctgttcatgaccaagtaacattctgttatctgtaaaccacaatttatttatgcattgaagtgtctaatttttcctcaggatatgtttgtgtatactagaaataccatgtgaaaggaatgtagctcattttctagcccagtgtattcccttttcgagggttgggacccttctgttttagcctttgttggggttgtttttccagtggaaatcataaactggcagaagaaatatattttttttgtttactagaaatgttatagccctcaggaccagtaaagttaagtataggtattgacaacaaaatatagaatatagtaaatacagaatttacttttcctttgcaca

SEQ ID NO: 235878 - DNA, 1465 bp, Homo sapiens
agccggccgcgcccgggtcgcgcacgcgccctgacggagtcccagcaagcgcgggcccgtcttcctcgcgtctcctcggggagcgtcgtcgccgctaccctgggcgctgagagcttgcggagccgagccgctgtcgagtcccagcggaaagaagcccaaggtgccggagaagcccggtcgtggacgttgttgctccctcatcttcgagacccgcacgccctgcggagaggaaatgacaggcacgccgcgaccgtggggcggggctcgcacgagctccgggtttccagaggcaggggccggggccgtagaaggcagagtcgcgcggggaaggcccggtaccccgccccttccgcaccgacccctcccccgcggagctggccccggccccgggcctgtggagtggacgccgagggcggcgggcggcttccgagttggacagaacgggagctgccggcgggagcagagctgcagaggaggtggcctttgacgggcagcgcggggtcgaaatcccatcccagcgctgtgacctcttggagcccacattgcctctttggtggaggggagggagtggtccagctccgagccgagcctgggagctgaatgacccagtgtgcaaggcgcacctcggagaccgaaagcaaccgctcccccggcttcaatttcacaccacctgcagatacacgtctcagaatctgcggctaggaagacctgggccgccagaagctaaacgtgtgcattttgtcatcagccccggtttctcgttttagagtgagttcccacctgccctacctaaactgacctgaaacggaaagttgtatgcccccacgaccatcctcactgcagaactgcagagggttttaagctccttattacctgtttcttataatcctgtccctttccaggcgagtatttatcggatagttctacttgttttatcaaacttccttttcttttgactttataaaaagcaatgccgggaggctgaggcgggagaatcgcttgaacccgggaggcggaggttgcagtgagctgagatctcgccattgcactccattctgggcaacaagagcgaaactccgtctcaaaaaaaaaaaacaatgttcgtccttaaaattatgtgcagaagtttactgaaaagtacaagttactatttttccttctgaagcactcctcacaggtaacccctgttagtttcacaggtaaccttaaaatgcttaacacatatttgttgaatgaataagtgccccccagtgaatttcctttgcctgtacaaacatatatgtacataccttgctttttctatttaacagtacacttttatcatttaacatctgcgtggtatggtactccatccgataaccatcggatgtactattatttaaccactccgctattaatagacattcatgctgtttatattttttggttataataaacattgttgcaggcgggatcattgaacaac

SEQ ID NO: 235879 - DNA, 491 bp, Homo sapiens
cattcaaaccatagcagtaccatctgaacactgggaatagcaatatcattaattgacatcctatgtgatattggccattcaggggtgttgtgagggttaaatttgatcatgatgcacccgtcttgggatgtacaggaactcaacagaagataatgtctttactctctaaggagtggcctgacaatgatgccactgaatggacagcctgatgggtgttctctgggacaacttaaaggaaataagatgtagttatatctggcactagtcataattctttcctctcttacaactatgtcatatgaccttttttcttgcaagagtccatattaaccattattatactagtacttatcaacaggggaagggatatgttatgaattggagaaggccatttagtcgtagcttcctcaaatgcatttgatttattcctatatgcattttctttggagataatgaatccaagataatgtctccttctaaaacaaaagaaa

SEQ ID NO: 235880 - DNA, 381 bp, Homo sapiens
gaaacagggtcttgctctgttgcccaggctagagtgcagtggcatgatcatagctcacggcagccttgacctccggccagtgatcctcccacctcagcttcctgagtagctgggactataggcatgtgccatcaagcctggctaattgaaaaaaaatttttttttatagagacggggtctcgccatgttgctcaggctggtcttgaactcataggctcaagcaatccacctgcctcagcctcccaaagtgttggaattacagacatgagccactgcacctggcctgtttcatccttaatagcctatagaaacagcctagtataatgggactcaggagtcctggattccccgcttccagcttcccccttcactaatttgctg

SEQ ID NO: 235881 - DNA, 680 bp, Homo sapiens
cactgtaaaagttttagaaaaatgtaataaaagaaagggaaaaaagcattcactatctgagtatctacagataatcatcactatcattttgatgcatttctttctaatctttattcaaaattattagaagtatatataaaaatatataaaatacatatacttatatagaattagtatttattgaataagttatgtataggatatatttctctgcatataaagtgaaatcctttaaaagcagaattttaacaactgcataatattcatgtcatgtacgtagcattattcatttcatcatttccttaccggtggccatttctttgccccatattttaagttgttcattcttttttctgtattttgtttatttacatatgtaccctaaaacttaaagtataataataacaaaataaaatatatatatatatatataatgcccacaaaataaaggaactaagtcataaatatgcatatgatttacataaaggagctaaaataagaaaaaaaaaaagaatgataaaagtcagcagggaaaagaactaccaaatcacctagtcaagtaaatgatttacaataacaaaaacaaacttaaaaactctacttgtaacaattttactggtgactaatacttctttaattaataaaacctattggctgcatatggcaatcagtggtaaaaa

SEQ ID NO: 235882 - DNA, 369 bp, Homo sapiens
aaaacctgtggcctaagaaattaaatgacccacttacctgttgtcttagtttgtgtgtccccagaccttgaaacaagcaatcaaatacaagtagtgtatttaagacaggcaagaaaaactgtcagaggagtggaaaagtgaaccaaggaagagaaggtagccagtaaaatgatttatcagtcttgctgccttggggacaactgaaagttaattccctgaggaaattctggaaatggagtacaatgcaggccttgaagttatcctgcccatggaataagggagcttgggtgtttgcatgccagtcttgcagagtccttggttgaggctgctggggcaggatgtgagcagagtggacttcatggcccttta

SEQ ID NO: 235883 - DNA, 513 bp, Homo sapiens
atctcaaaccactgcactccagtttaggctccagagtgagaccatgtctcaaaaaataaaaatctagggagaatcaataatatttttgcttgaatttccactaaatgagattgagggtagcccagcatctaatttagttttatttaaaatagtaattttaatatcaatagattgataggcaggggattattattattatagacataatgatctaagtagagaaatacacagatagaattatggttgattaacccacttgtattacttgcaattgtacagttagtatgttttagtatcttagttactaatctcactttttacatttagctctataatcaattaaatatgagttattttttgtgtatggtgtgaaataagaatagaaatttatctttatgcatgtggatattcaatgttctcagtatcatttgttgaaaaaatgattaattcctattgaactgcagtggtaccatttttgaaatcaattaccatcaatgtcagtgttaatttctg

SEQ ID NO: 235884 - DNA, 538 bp, Homo sapiens
ttttcccgggccccgctgcaagggccgggaacgtttccgccacctggccgggctcgaccgcgcggcgctctgcggggcgctgtccccgctccccgagtgcgcagcggagcgtcctggaagacaatgaccatgggaacaatttgcacaggaggctaggagcccaggaaaagccgcctgggcgccaggcagaggttttttgaaaacacaaacggcgcgttagatgcttggggactcccagcatctgtccttcctattgtttagctcggctccggagttcacgggagcctcgtgaaatgtggagacgtcctgcaaagtttcttgaacacttcatgtgcgtggtaggaagtcgaggaaaaaggtttacggttcccccgctggttgcattgtttgtcctgcacatgttcgagcgaacatggcagccgcaaccctggatgtgttcgaattgacatcgaggggggagcttcacgtcgtgaaataacttttttctgggctttcgagattctaaagcattgctgatgaaaataaagcaaatactttc

SEQ ID NO: 235885 - DNA, 375 bp, Homo sapiens
agtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaa

SEQ ID NO: 235886 - DNA, 441 bp, Homo sapiens
atagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgc

SEQ ID NO: 235887 - DNA, 401 bp, Homo sapiens
ggagacagtgtctctttctctctgtcacccaggatggagtgcagtggtgtgatctctgttcactgcaacctccgcctccccagttcaagcgattctcatgcctcagcctcctgagtagctgggattacaggcatgcagcaccacacccgactaattcttgtaattgtagtagaggcagggttttaccatgttgcccaggctggtcttgaactcctgacctcaggtgatctgcccaccttgacctccccaagtgctgggattacaggcgtgagccaccgtgcctggctaatacatagttttaaagacctcgaatttgtactgatacctctaacttcgtaacccaacaccaaagagtttgcgtcttcttcctttactccatatctcttttaaaaaacaaaaaa

SEQ ID NO: 235888 - DNA, 239 bp, Homo sapiens
ccatcacctccctcctccccctcctcactctgctccagccgcatgggcctcctcgctattctttcaatgcacgaggcgtggtcctgccccagggcctttgcacagcctgtgcctctgcccagctccctccttccctagaccttctccctcccgcccccggtctctaccttcacgccagcctcccctcctccagaactccctattaaaattgcagcccctgccacactccaaatctgact

SEQ ID NO: 235889 - DNA, 307 bp, Homo sapiens
caggattttgaaattcatgggtcaagaaaaagactccttacttctgctttctactgtcactccttttctgagacagtatgaggctttctgctggttgcatggatgacgaatctaaggacaattaggggaaaagattggctagtatttaaaaaatgttaaactattacaaggtattatcaggattttattttactaatttaaaaatgttttgtcaagtcaacttctaaaactcagctttactgaggtataaattacataaaataaagttcaccaattttaaataaacaaactattttattaatggttg

SEQ ID NO: 235890 - DNA, 476 bp, Homo sapiens
gctcccatggtagctgtgggatggaggttttcttggctaaattgattttttaatttgtgttttttaggtgctagtatgataaattcgggagcatagaagttaggacttgcatcctcattggaggcaaaaattggttattggggagcacaagcatcttagatattataatggtgtgtggccatttaaagctcaatcaacaaaagcttgtttcttaatatttgaatttctctcattgggttttcttgtgtattacactagcaacattgataatggattcatggaagatgtacagaatatattcaaggtcaatccaacaaatttataacgtagagatggctgtggttggaagactttctctctagttgcctgatcttgaagtcattttagttggttaccttcacatacttatgggctaccattgggtgccttgtggcttgcttatatttggccctcaaatataaggatttgagaattga

SEQ ID NO: 235891 - DNA, 411 bp, Homo sapiens
agcggattggagcccgggaagctcattgcgattccaaaggtcacgctgatgcaagagatgggttcccatgatcttgggcagctccactcctgtggcatttgcagggtacaggcttcctcctggctgctttcacgggctggtgatgcggaaactgaagctcagagagcccaagtcatttgcccaaggtgacccagcactgaagggagaagctagccattaagctgtccccaaacccgtgtactcaacgttgatggctactcgatggtggctgagaggcatccaacctggagcctgggaagcttccaggaaggcttggggggaatccaagaggaaggttctttgcgggagaaagagtgaggcaggggagtttaggaggccgcttcccagccctcgatcgccccacagccacca

SEQ ID NO: 235892 - DNA, 563 bp, Homo sapiens
ctacatgtcataaattataattgatatacatgtgtatgcctccacagagagctttagtgtagagctttctaaactttggaactgaaagtatatacctattagtgaaactagagtgtattgtaatcttatctttcctaaacagtgtttatattagtctgtcctgggaactgttaatattacacacacagatgcacatgtgtgcaaaatatacacacgtgtgccatggccaaatatatttagaaaaacactatatactgtacgcccctcttggagatttgtaacaacaattatattaatgggtttgagaagtgctgtaatacataaggtagtttaattgtttgtcatataatcttgtttcacagcattcttagaaacatgcagttcttagaaactgtttcatggatatggtttgttaaaagttatggtaaccaattacatatacaggcataccttagagatattgcagagtcagttctagaccaccacaataaagtaaatatagcaataaagcaagtgacatgaattttttgtttccctgtgcatataaaagttatgtttatact

SEQ ID NO: 235893 - DNA, 651 bp, Homo sapiens
tcttctctccatttggagaatctggagcttcagaatggggatgagggagggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctgg

SEQ ID NO: 235894 - DNA, 162 bp, Homo sapiens
caagcccgagaccttctcctacgtcaccctccccaagaaggaggaggagcaggtgcctgagcgagggctggtgagtgtccccaagtaccacttctgggagcagaaggaggacttcactttcgtgtccctgctcacacggccagaggtcatcacggccctcag

SEQ ID NO: 235895 - DNA, 520 bp, Homo sapiens
cagacggattcatgtgaatgaagaaaggacattttgacttggaacagagggctgggcctctggcctagcaagaaaagacctgatttagtttaatcaagttgatcagcctcagggtaaaacaaattagaagtgtagacaacagtcccttgtgatatgttgagtcaagctggactaattaagcaagcaagctgtgtattagtaatttccctgtatgtatgtcattctcaaccctgaggttctcattggcataaagtggatggtacatcccagttggtgctgaacatataacaagcccacatggaagaggaagagcgttgtgcaggctggttatgaagttggttgaattctgtttacaaacaaatgttatctttgtcaaactgaggctagtggaaatagaaagtactgtcctcaagttttgtcaccacacttccactttatgtttagaattttttcttacttgctaatgttgagtgtatttgatagtttttttaagtaaatgaatgaatctagaccactgatt

SEQ ID NO: 235896 - DNA, 476 bp, Homo sapiens
gcaatgaatgcaaaactaggcaaatgggactataccaaactaaaaagcttctgcagagtaaacaatcaacaaaatgaaaagacaatctgtggaatggagaaaattttttgcaaatactatatctaataagggattactatctaaaatagatccttcaactcaatggcaaaataaataaataaataaataaataaataacagccaaataaaaatatgcaaatgacttgaatatacatttctccaaagaccacatatgaaaggccaacagatatatgaaatgctgcccaacatcactcatcaccaggtaaacgcaaatcaacaccacattgagatgtcaccttacacctcttaagatggtttttatcgaaaaagacgaaataagaagtattggcatagatgtgaagaaactgattatttgtgccatcctgagaatgtaaaacagtgcagctgctgtagaaaacagtatggagattcct

SEQ ID NO: 235897 - DNA, 479 bp, Homo sapiens
atgactgtgttcctggttgctaggtctgcatgctctgcactttcccccaagacccttctctttggccacttcccttcaatgttcagatttccaattaaagattatttcctaatgtgaccttggagttcatacaaatggttaaagtcctaagttctaagtggaaacaaagaacagaattctgagtaactaggactcatgaagggagaacatgagcagttatgtaggccacagattggggattagcatggaaggtttaggtaaaggaaatggatgaggctgaattatttgatcactcttgggaatcagatgagctcagcaccacctgagctgaagccacaactgtcctacaggcaagctcagcaatctttaacagctcccagatctggtgtgtgtaacattgccttctggtttctgtaggattctatggagttgcctttgcattcctgagtcttaccctgggcccagccttcaagagacca

SEQ ID NO: 235898 - DNA, 2050 bp, Homo sapiens
  misc_feature (891)..(891): n is a, c, g, or t
  misc_feature (1742)..(1742): n is a, c, g, or t
tattgctaagtggaaaaaatgcaattcgaacctagctccttttgcccatggagatagtgcttgtactcaccagtaatttctcaggatcactgtttgagtgaatgtgcaggtacctaggaggatacccaatagggccaaatcccttgggaaggatatgttgagaagagcagctttgagtacaagacaactttatgattttgcatggaagatgggccctgtccccacagagagaatttccctctgatgcaaagagcaaattataggcacccaacaaaccgtggtcatgtatgcataggtcactggtgggtggtaaatcttgtttctgggaagacttttgtaaccattacctctggaaaatctgaaatgatgataccaaacatgttgcttaccaaactgacctcttccacccttagaagcagtgagaaagttcagtgtcaaggactgagctctgcagcttctcttctgcctctgaaatttattaagtcagtaggccagaccctaaatgatttatgacacagaaagcactcacatggaatacaaatgtctcatagtgaagagcaagaccagttgtgattgtaagaaaataactattaaaatgtgagtattttaggagtatacatattgttgttaaggcatttctagtcagtaatgaattgaaggaggtaacatacccacactaaccaaacttagcatttgtaggccccatctataagatagcagagtcactgcctgggagtttctgaataattactgtctctaaatttttaaaacgttcacagaacaatctgtttaaatgccctttaacgtggttgattctggtgctgagtttagtctgaggactaccaaagcaaaataatttccctgcacatgcccaagtgagaaatttcatcntctgaatgaatggttataaaatgacttagcttcttctgtgtgggtgcttatatctagtttgattttgcctgtggtcagtgttctgatattattatatatacatgtatattattggaaaggagcataaaactttccttatataattccaagttaaaaagagacaaatgcttgccatgcattcagatgttcttacttcaagatttttcaaggtcttctaaccagagttaattgttaactttgtttcgtatcatgcattttttcaaaagctctaagtattgtagtgttctgtgcagctattactcaatatcatctctgtgtcccctttccctgtgctagccttggtgtctagaaggccttgagtatagtttgcttgtttaacagggtatacagaataggtgcattctagaaggttatctatcaaatctatttttctatagactttaacctctcatatcagaatgatgactggttctattgcctagttctggtaatagctctgagtagtccaaagatctttgacaggtatagttgggagatagtcaaggaccttgctgtttgacttttttaaagacctgattaatactctgtattctgattccttactccccgtcagaccataatctgagagaaacctcataacctggccaccaacatggaatggattgttttgtactgtaatgatggtcagatagggactaagaggaactagttttctttcatatgtaagtctttaccttctaactgtataaattgttagcaaaatgttgtataaaatattagaatttttcttttcgatctattttaatatgtgttatatatcataagggttttagcaatattaacatgacatnctacatttttcttcttaccatataattatataaagcaacaaatatttagtggacattaatatatgccaggtagcatttcaattaagaaagcgtaagaggtaaatctagaaccagaatatttcttacagaaaatatcaggatgacagctgattttatgtgtataaagtgatttatctctctgtgctataaattacacccagaggtagtggtagtcaagtataataaagaccaaaagaagaaaaatttggaaacataaaaaaaagacataataggaaagtatttttgaagaaaaaaggcaactccagatt

SEQ ID NO: 235899 - DNA, 350 bp, Homo sapiens
tgagacaaagcctaccagcccaaactcccttctccaggcaccaaaccctcgggtcccggttactcctctcgcccaacaactctctgggcgggtctcccctggccaaggctgcacgagcttctccttggcactcgcgccgctctcctgctctccacgcgccccttcggcaccccatcctcccatcctgtacgcagacccccgctctgccccgtccccgggcacccgacagcccctcgtctccagtcggccgccatccccgccccgtctggccgcagctcccaaatcttggcccccggtgctccccagtctacacccgctccccggcccctccagccccgcggctgcggccg

SEQ ID NO: 235900 - DNA, 381 bp, Homo sapiens
gctatgaatgggagcactaaataaaggcactgtggtgacgcagcagctgttggctgtgtgcactgcttgataacccttttctgcctggcctttctatagatgtttcccagaggtcagttcctggttcttcctggagtccattttgtgactaattggctctggcctgtagggatggtgtatgaaaggctctgatctgaagatgtgtaagctgggaagtagtaaccccttaccctcctgatctgggttgggctcattacagggccattgcttcattggcagccattcgtagcaatcactatcaaagtaggcctcagccttgtggcagggaggcacatgaatgagccacacagttgtacttttcttttttgagactccgtctca

SEQ ID NO: 235901 - DNA, 525 bp, Homo sapiens
cagctcaacaagtttcgttctgcaagtgatagttattattatcttaaaataaaaatattattttcaagatcggctttagcaccagggaggtaaaattcattcaccttcctgaccattatgaatttgaaatttctttttacaaaaaggtgattgttggttaaaaaaaaaaaaacaagcaatagcagatgtgagaagctgaaaatccatactacttatgtggttttggtttttgcatatcaattagaaaatattttaatgctacttttaaaaaataatcaaaggactgtacagaaaagataactcaattttatgtgctatattatactttaaattccctctcttgtgttttcctatctcttttcaaaggagctagttcattttcagccattctttcataaatgccattgctcaaaaatgtatgaaggtttcagttatgtgacatttttgtcctgagtttattcgtgttttcagtttaacatgtcaataaatttgtataaacttttggaaactacagtagcattaaaa

SEQ ID NO: 235902 - DNA, 382 bp, Homo sapiens
agtgacattccacttatcatatgataagtaaatttactggtggcactgacagtaggtacttctatcaaccaattttggattgtaggcattaagcatcctggtgcttttcccaggcaaataggaggataatgatacccaatggaaatgtttatcatcattccttcttcttcaggttgggcagggccacggtcatctgtggggcctggtacccattcactgttattaacatatactttaataggattatctatccaagtgactgcccgaattaagggtgggaaaatcacataggcccagtaagtatagttagctgtagcggctcctgaagacatagggagacttaaccaccgttgatacaatcattaaagctgcaagaagcata

SEQ ID NO: 235903 - DNA, 989 bp, Homo sapiens
acaacactaggttttgtaggtttttggaagctctttagtaacatggctgaacctgagtttttggataggtagggagcataaaataataactaatgttaattgagtgcccactgtatgttgggcatggatagttttaagtatttatcataactctctgtgatgaatactactgttatctccattttacagttgaggaaaccgagacataggttactttgctcaagatcacacagctgagaatgtgggaacacgctaggagcccttcttaactactagtctgtatgcctctaaattatgcctgattcctacttacagtcttgttaaacagttaagattagcacactcaacagagtcagaaaacagttgttcagcctataataaagcactaaattttgtgggcaaactttacataaactctttccttagctggtctagagagaaaaattaaatcatgttctatttatttcattttcacctttttatgacacaaaatataagtgataacacaaaaatcacctactgttttactgttattggaggaaatgtaatatttttcattcttaatttaaaatcaaagcatttggaatttattaatggaacacattttctttccttccacttctagcctctctgtgtgatgacctccatccccacggcttcttactagctctcattaggagactggagtcctcacccttgccccattgacacgagctttaagtgttccagctagataggccctggtcattcagaaaacaatttggtttgggaggtgttgaaagaaataacaggaaaagcaattctctgcagagagaatttggtttatttttctaaaaatacagcgaacccatccactcttaccctggcagatgcctcccctggtatagagaaatttcttctttcttcctccttcacatcattgcacacctgattaagtcaaccagggtaattaaaatacaaaagcaaaacaaaaaaactctgggcagttg

SEQ ID NO: 235904 - DNA, 318 bp, Homo sapiens
gaaaaatgtgtgtgtgtgtgtgtgtgtgtgtgtgtgtgtgtataatatatatgtatgtattatagaatcagaattaacaatgaacatttgtaatccattttgatgaaagggatcccccaactttgcaaattgttatcccctcaaaaagaaatctaaagtccgctgggcgtggtggctcacgcctgtaatcctagcactttgggagactgaggcgcttgaaccccaggggcagagattgcagtgagctgagatcacaccacttcactctatcctgggcaaaaaagcgagactccgtctcaaaaaaaaaaaaaaaaagaa

SEQ ID NO: 235905 - DNA, 1267 bp, Homo sapiens
gtctcactatgttgcccaggctggtctcaaactcctggcctcaaacaatcctctacctcaacccccctaagtgctggcattacaggcatcagctgccatgcctggctacaaatcttaatgttttccccatggcttctttttctggcgttcttttctcaggtaatggaagtgggcagagaatgatcctttccctaggctccagtgtgtaagaattaaagaaagaggaaagaaacacaatggcttgatggtcgaggacaggtttattttaaagaaaacaaacccaagagtggcttctggctgagttagatcagaggcatgctctcttacagactaagagtttttaaggattcagggtgggagagtttatcagaggcttggactgcttctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcaggccactgccaccgaatttcaagagcccaagcacagagcccagaactaaattgtgagggtttaccaaaaaaaacgctcacatggcaggtataatcggaacttccataacctgacatatttaccggggtcacacagacacagaaaaaaccgggaaaaaagaataccccccggagaacaatactaaagaagcactgcgagatacagcccacagcacgcgaaacgaacagcgactaagaagagatgacacacaacaagacatcagaagacgcacgagagaaacaagaacacgagaaggggagagaacgcaaaaacagcaagacactaaagaacagaatggagaaagagaaaaccagggggtgaaacacaggcacccaaagaacacgggggagctcacccggacacgcagacgaggccgaacatgcgccaacggacacacaagacatgagagaaagaagcaacgaggagaacacgaaacacacgacgag

SEQ ID NO: 235906 - DNA, 855 bp, Homo sapiens
gtctcactatgttgcccaggctggtctcaaactcctggcctcaaacaatcctctacctcaacccccctaagtgctggcattacaggcatcagctgccatgcctggctacaaatcttaatgttttccccatggcttctttttctggcgttcttttctcaggtaatggaagtgggcagagaatgatcctttccctaggctccagtgtgtaagaattaaagaaagaggaaagaaacacaatggcttgatggtcgaggacaggtttattttaaagaaaacaaacccaagagtggcttctggctgagttagatcagaggcatgctctcttacagactaagagtttttaaggattcagggtgggagagtttatcagaggcttggactgcttctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcaggccactgccaccgaatttcaagagcccaagcacagagcccagaactaaattgtgagggtttaccaaaaaaaa

SEQ ID NO: 235907 - DNA, 623 bp, Homo sapiens
ctgaaacaagaagatatgaagttcataaaatgctctccgtcttcaatgaagaaaggtacatgaacgctgaacgacaatgagaataactatttccatattttcatatagtgaagtttcattgcatagtaatccacattaaatgatatttgagacatatatactttgagaatcacaggctacgttggctgttggcagtttaaaatatgtatgttagaattatctctcttctggggttttagtctcctgttccagaataaaaaatacctgtaaggaaatattttttgctgaagatgacagatatcaagtctgtgtctcaattctacaagagaaacatatcagactccagagaatgtgtaataaagtcctagagaaaattgttaagtaagtgaaacgtttaatttcagtgtaaaactttctactttgggggaatatcctactatattgttctgagttccctctcaactcacgtgtgttggccccttgcttcctgtctaggccctaccactgtattatgaaagtaatggccctaccattgctatttatttatttgtttatttaaactttatgtaagttccagggtagctgtgcagaaagtgcaggtttgttacataggtatacgtgtg

SEQ ID NO: 235908 - DNA, 1005 bp, Homo sapiens
ctaatttttgaatttttagtagagatggactttcactatgttggccaggctggtctcgaactcctgacctcaggtgatccgcccacctcggcctcccaaagtgctgggattacaggcatgagccaccatacctggcctgggtgagactttctgagcagagctatggacttgtcctcatgccctcccctggcttatctctgagggaaggagggatggctctcgtcctctcactggacatgtcaccttgggcaagttattcaagctctgatctcagtttgctcatctataaaacgagttaacaaaagtgtctacccttcagggctgccacgaatgacgggcaggttcagaaagctgacagcacagagcctggtgcatggcaaacggggccactgctatactacaataccatcacttccacttccatcatcactgggctcctccatgtccacaaaaccatgtgtgccctgtgccagcctggctgccaagtgacaaagcagaggaggcacatacatgaggcacttggcaaagagggcattttcacccttgctgctctgcaatatttggcaaatgctctgcttcaaggaaagtacccggaggcctgcctacaacatctgatctcccaagcatgcctgctgagacttttttttttcccccgagatggagttttgctcttgttgcccaggctggagtgcaatggcgcgatctcagctcactgcaaactcctcctcctgggttcaagcgattctcccgcctcagcctcccgagtagctggaattataggcgtgtgccaccacgtctggctaatttttgtatttttagtagagacggggtttcaccatgttggtcagcctggtctcaaactcccagcctcaagtgatccacccaccttggcctcccaaagtgctgggattacaggtgtgagccaccacacccattgcttcctgagactcttaaatcctgctgcagtgatggggagcaggatgatatcctttctgaaccctgccc

SEQ ID NO: 235909 - DNA, 383 bp, Homo sapiens
ttcagggaagaaaacattttgcttctatcttggttctttaaagataattttatttctttctctgaatactttaaaaagaaaaattgtggttgagcgcgtcggctcacccctgtaatcccagcactttgggaggctgaggtgggtggattgcctgaggtcaggagttcgagaccagtctggccaacatggtgaaatcccgtctctactaaaaatacaaaaaagttagccaggtgtggtggcatgcgcctgtaatcccagctacttgggaggctgaggcaggggaattacttgaaccagggagatggaggttacagttagctgagactgcgccaccgtactctagcctgggcggcagagtgagactccgtcgcaccaaccccaca

SEQ ID NO: 235910 - DNA, 533 bp, Homo sapiens
aaattgggtgagcacttccttcacgtctaagctattgccaagtcttattgtttatcctgatgaattccagatattctttcttagggttgttgctctggtgccttgtttactgcctcattcaccaatcacctgattctatccctggtagccctacagcttcttagtgttcagtttcattctacaaatctgcatacatatcccacaatatgataagactatgatgtcccttttagtcaataaagatatgtatttaattctattttgttttgacttctaacatgtggcttctaatgtatccccagaccatccctttccaaaaagaggtagctagaagtagatgtgataatgactaaggtcaatattttggaattccattcagcattgctttcctcccaaccactcatcgttctatttgatttccaactttctctctcaatgttaatgtattctttccgagttttaagtgtttcatcatagtggcttggattttgtccaatcccatgattatctctctattaaaatcttaatacaaa

SEQ ID NO: 235911 - DNA, 445 bp, Homo sapiens
tcattaggtgactgacacaggctgtatcttgctggggatgatggcattcacctcctacatgcactagagttgtagaaatcatggacaggcacaagccacgtttttcaatgatggtctaaaccattgaattcatggtgtagtcgtagcccacattggtaagattctggtcataagcataatattcaatgactattctatcagttccagtttttggttgtagacaacgctcttaataatttaagtaattaattttaaaatttaaattaatgcaaatgtgctcatctcatggagggcccaagaaccaggcttgaagaatctgtaccactgactctggagggtcctactctgctagaacctttgttactgccacattgagagctggatatctatttatcatcacctaccaccctcagcagaataaatttttcatagacacctccttctt

SEQ ID NO: 235912 - DNA, 300 bp, Homo sapiens
tatatacagacacacagagacacacacacacagacacaaacacacacagacacagacacacaggcacaaacacaagcacactcgttcatacccaagagggtctcgtggctactgtggccactagttcatgagatgctggagtttgtcagctggctgaaggcaaattataccctgcatgagttatcaggttgataattgccattacttttaacgcaaaaacctcaaatacttttgcgccaacctaaaagctttagatttattttcaaataaagtattgttgtgattaacagattaataaaa

SEQ ID NO: 235913 - DNA, 447 bp, Homo sapiens
tttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctg

SEQ ID NO: 235914 - DNA, 444 bp, Homo sapiens
aatcatgcaaccagagcctctaatgatggccccttctgccaggaacctttaaatttcctctgagggagctctgactgttgtttctcaacaactgcaccccctgtcagcaggaagcagttaagatcatcttcctccttaccttgaatctaccagcggttacatgtacttctttagaggggtgaatgagagccaggtgggagggggtccctggagaaattccagtcagtctgcccattgaggtggagccttgggaagttcatgccctttgcagtggggaggggcctggccccacctcttcctatgtggaacccagtattcaaatagcagcaggaagctctctagcaggggactctgaaacaggaggatgcctgtcccccctcctccttttttttcccttttcacccaataaaaccttgctttactcaccctttaaaccatctttga

SEQ ID NO: 235915 - DNA, 890 bp, Homo sapiens
atggagtcttgctctgttgtccaggctagggtgcaatggtgcgatcttggcgcactgcaacctctgcctcccaggttcaagcaattctcctgcctcagtctcccgagtagctgggattacaggtgcccgccaccacaccgagcttattacattacttctgagaatatgtctgccatatattcaaacctgaataaccacagcttgtctgtattttcaagtaaaaaatgttccatgaaaaaaagtcattcaaattgcaactcaaacaactgtagaagtgcttttcttccagacaactatcatactatgacatgcagaagtgctttgttcatacattctacttcatatcatacagaatattaaaaagacagatactcggctgggcgtggctcatgcctcagcacttcgggtggccaaggtgggcagatcacctgaggtcaggagtttaaggccccagcctggccaacatggtgaaaccccatctctactaaaaatacaaaaattagccgggcatggtagcacatgtctgtaatcccagctacttggaaggctgaggcacgagaatcacttgaacctcggaggcggaggcttcagtgagccaagattgcgcctctgcactccagcctgggtgagagagcgagacaaaaaacaaaaaacaaacaaaaaaaacccacatagatactcaagggtccagagcttcttttaaagacaaggtctcactctgtcacccaggctggagctcagtggctccaccagggctcactgcagccttgacctcttgggctcaggtaatcctcccaagtagctgggactaaaggcatgtaccaccatgcctggctaattttttgtagagaagggctcccccaggctggtctcaaactcctgggctcaag

SEQ ID NO: 235916 - DNA, 1668 bp, Homo sapiens
gattctcatccctgtgctcagagctctcaagcacccacgatggccttctcaggccgagcgcgcccctgcattatcccagagaacggagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgttatagaaggtgatgtggtctctgctcttaataaggcctggtgcgtgaactgctttgcctgttctacctgcaacactaaattaacactcaatttctagaaaatttctccacaaactgagagctccagaattgatgactcagagtgaaccgaggagatcactactgtgcacaagtttgcctccaaacaactgggtgatgcctccaaacagacctggaatcatccatttctccaaggatctctgcttcttcttgtaaaataggctatttaaggactacaatctgagcattaagggtatcaaactcttgggcttggacaatcctcttgtgtctggagttggttccttccggtgggttcctggtcttcaagaatgaagccatggaccttgctggtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgagctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcatactttggcagactggtacattttgcaaaagtcactcctcaaatggttttctggaaggatacagaagacatctgcaccatggtaaccacagtggcgagtgttcattgtagtacctgtaagagtttatgaccgaaggcaggagccatgaagaaaaaagactcaatagatttgcttttgatggaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgac

SEQ ID NO: 235917 - DNA, 682 bp, Homo sapiens
  misc_feature (672)..(672): n is a, c, g, or t
  misc_feature (674)..(674): n is a, c, g, or t
  misc_feature (682)..(682): n is a, c, g, or t
gattctcatccctgtgctcagagctctcaagcacccacgatggccttctcaggccgagcgcgcccctgcattatcccagagaacggagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgttatagaaggtgatgtggtctctgctcttaataaggcctggtgcgtgaactgctttgcctgttctacctgcaacactaaattaacactcaatttctagaaaatttctccacaaactgagagctccagaattgatgactcagagtgaaccgaggagatcactactgtgcacaagtttgcctccaaacaactgggtgatgcctccaaacagacctggaatcatccatttctccaaggatctctgcttcttcttgtaaaataggctatttaaggactacaatctgagcattaagggtatcaaactcttgggctttgggaaccaaaaaaattttcccccngntttccccn

SEQ ID NO: 235918 - DNA, 512 bp, Homo sapiens
cctcggcctcccaaagtgctgagattacaggcatgagccaccgcgcctagcctgtgcactttcttaaaggaaaactggagaggaagagatctcatgttttctattcactccactgctgcttggtccagtgcaggaaatattgctgttatttgaagtccttcctaaaacaaaagctcagatcttttggaggttgcccttctaggcaggttttcaccagtcaattttgatttggggggcttaacagagtaggaatgatcttgcaggtttattacatctgaatttaagactactcacctaggctgggcgtggtggctcacacctgtaatctcagtgctttgggaggccaaggcgggaggataccttgagccgaggagttcaacactgcagtgagccatgatcacaccactgcatgagtgagactccatctcaaacaaaaaaaatagactactcactgtttacatagctttgtaccatataaaaacttgtttgaataaaatattgataacaatagt

SEQ ID NO: 235919 - DNA, 304 bp, Homo sapiens
gtttggcaacagccccaccagcacacacacgcaccccctgatattttctgattctcagtggggctcgaggagcctcctgctcccagctttatctgacctggggaggagtcgggtgaaaggaaaggtacagggcaccttgtagaagacctggcagaggaggctggaggagggaaacatttccgggcaggaaaacactaatagggccgttcagcggctctcaggcctagaggggtgtgatccctacaattcaaggcaggccccagacccgcctgggcttaagggctgcagggggatccttttctct

SEQ ID NO: 235920 - DNA, 1058 bp, Homo sapiens
agtcagtgaaacggcagaatcagaagaggttccacaaccagaaaatcttggctggaatttcaccatcaggaataaaacagaaaaactaaaagagtgccccagatagcctttcttaggggcctgtgacaggtcgcaggaatcttgttggtgatccatccagatgttgtgtgttctggaagtggacatcgcggctctgtgtttttgaagtcagatctcattgctgtggtttctatgcctgaccccccgaagttcttgctcctgttgccacagggagccgggagagcacagagcgctgctcccggtgccctgcagccacacaaacatgctcctgctcctggcggaggcagagctgctgggaaagacatttcggaagtttcctgtggctgcaacaaattgttcaaatctgcactggagcaccgctgtgacctgtctttctccatcttagggcaaacagctcctgaaactggaaactccccagcacctactcaccctacccctcaggctctccttgtgggggtggggcagggggagttgtctggaatgcctggcctctctgtccaagcatggcagccttgccccatgggtggtgcagactcagtttcccatgcaccttgccccagggaggaggtaggggttccttccatagagatggtgaagaataagggaggtagtgatcgtctctgggatccagttagatctgcgtttgcaggcagaaagaggctggggcacatggagagagtgatcaactggaagattctagggtcctcaattttgaaaggtgacatgataccctggaaagggcatgaacttagttgtcagttcgtccttgccttttccaatcaatgctgtgtggccacggcaaattaatgaacatctctgagtttcggtctcctgtctaaaatgaggtgataatagcttcttgaaggttgtaaggccccaaacatgctgcctggcacatagatggctaatcaatattttcctacccttcccttccttcccttctctggagttgctacctgtcttctcctggggccttgcaaataaacttctgaattaaa

SEQ ID NO: 235921 - DNA, 1513 bp, Homo sapiens
agtcagtgaaacggcagaatcagaagaggttccacaaccagaaaatcttggctggaatttcaccatcaggaataaaacagaaaaactaaaagagtgccccagatagcctttcttaggggcctgtgacaggtcgcaggaatcttgttggtgatccatccagatgttgtgtgttctggaagtggacatcgcggctctgtgtttttgaagtcagatctcattgctgtggtttctatgcctgaccccccgaagttcttgctcctgttgccacagggagccgggagagcacagagcgctgctcccggtgccctgcagccacacaaacatgctcctgctcctggcggaggcagagctgctgggaaagacatttcggaagtttcctgtggctgcaacaaattgttcaaatctgcactggagcaccgctgtgacctgtctttctccatcttagggcaaacagctcctgaaactggaaactccccagcacctactcaccctacccctcaggctctccttgtgggggtggggcagggggagttgtctggaatgcctggcctctctgtccaagcatggcagccttgccccatgggtggtgcagactcagtttcccatgcaccttgccccagggaggaggtaggggttccttccatagagatggtgaagaataagggaggtagtgatcgtctctgggatccagttagatctgcgtttgcaggcagaaagaggctggggcacatggagagagtgatcaactggaagattctagggtcctcaattttgaaaggtgacatgataccctggaaagggcatgaacttagttgtcagttcgtccttgccttttccaatcaatgctgtgtggccacggcaaattaatgaacatctctgagtttcggtctcctgtctaaaatgaggtgataatagcttcttgaaggttgtaaggccccaaacatgctgcctggcacatagatggctaatcaatattttcctacccttcccttccttcccttctctggagttgctacctgtcttctcctggggccttgcaaataaacttctgaattaaaaaaaaaaaaaaaaaaagaaaaaaacaaaaaaaaaaaaaaaaaaagaacaacaatacacataacaaagaagaaccaaaagaacaaaaacacaacaaagccaagaacaaagacgggggcagcaggcgaacaaacacgaggagggagggcgaggacactcgcacaggacacagcgtatgagcgacggagcacgaagagcgagcaaggaaaaagagaaacgacgggaggcaatcaaagaaggagagagggcacaccgccacgcgggcgggcgggacgaccacatagtgggaggcaagcgcgggcagcgcgcaggatgggagggaaaaacacaacgagggagggcaacagctcaccggcgacggtgacgagcataaaatccggcgagaaacaagcgagggcagcccgcgcagcgccccaccaggggagcacgtacaccaggaagcgagcaagcagagcag

SEQ ID NO: 235922 - DNA, 2179 bp, Homo sapiens
aacttagacgatttctcagaactggtgttctcttgtacacagtttgggaatgactgcttggtacacttgttgttatttctgaaaattgatattaaaataataatttatgtactaccacttgaattcttttatcagttaatccttcttccttcttgcagatagtggagggctaagaaaagcaggaagtcatgaatgattgagaaacaaataaatgccacttatctcattcctcccctgggaaaaaagaacagctttgaaatttactgtatctgtcaccaatggagaaattgatagtattgagtatatttaaaagaaaagctattagcaagatcagttaggactgcctgagtgaatttccaactgttttccccatactaatgctaagccattgctagaattccttctatgtggcagtgaaaacgtaaaatgatgtcttcccattacaaatcaaatgaggacaagtgagtagttattgtaggaagccagcttcgggattaatatgagggaaagtttgcaaacatagaagaacggacattgttaaaagatgtaacagagtagattaaatgctatgactgtatgatccaaaaccaggcaaccatatccatggctataaaatattccaattggaagggaacttaggataatagtggatggatttcagcttttataccaagtccaatcaattgtagaagctttctgagtgctatgttgagggaaatccatatctcagtgggaatgaatagcatgatcaattagcaaaagatcctatttttaggaattggagatttggcagcatagggatcacctacttgccattcttgatttagttcaattgtgcattttgcaagtcggctgttgtgatgcacagaagctgtgtaacttactcaaagttatagcactagctaaggttagagccaaaatttgagccaggtgtttgcatcccgagtctttttcaaaaataggctttgctcccaggcgcggcagctcacgcctgtaatcccagcacttcgggaggccgcggtgggcagatcacaaggtcaagagatcgagaccatcctggccaacatggtgaaaccccgtctctactaacaatacaaaacttacctgggcgtggtggcacttgcctgtagtcccagctacttgggaggctgaggcaggagaatcgcttgaacctgggaggtggaggttgcagtgagccaagatggtgccactgcactccggcctggtgacatagggagcctccgtctcaaaaaaaaaaaaaaaaaaaaaaggctttgctcaatatttttctcaaaacagctatcattgccctctttgccatttaaaattttaaagaagacattcaatgatacaacactaacattcactcatcacattagggctgttgagaatgtcttcttggaaccaaagcagtcagtcacacaacacatatggagctgtaggctgaataaaactgcaagagtcattctgacttgcagagcaagccagggtggaaattggacatgttattatatttgataaagaaggcaatgttgaaagacagagaaatgtccttgtgtagcaaaaaaaaatttgaaatatcatatttttgcttttgccttagtgctgtctttaaaattttagactcttgactaaacaattaaaaatgaacttgataccccttatagcagctgtgcatacacaacaggagctactcagaaatatgccttagaaagctttctttgaagtgtttctttaccactttctttttctttgggttcaaattaaatagaatatcagccgtccacttatcttaatgacaattattgtgaattagacactgagtagaatacagtgacaaagaattgtaggcttttgccaaatggagtggaaaacagtaggaaaatatgatattctggccgggcgcggtggctcacacctgtaatcccagcactttgggaggccaacgtgggcggatcacgaggtcaggagatagagaccatcctggctaacagggtgaaaccccgtctccactaaaaaatacaaaaaattagccaggcacggtggcgggggcctgtagtcctagctaatcgggaggctgaggcaggagaatgtcgtgaacccgggaggaggagcttgcagtgagccaagatctcgccactgcactccagcctgggtgacagagcgagactctgtctca

SEQ ID NO: 235923 - DNA, 343 bp, Homo sapiens
ttcaaatcatgatacatatatatgatcttatgtgtatatgtaattttattattttcttttagggcaagtggcacttaaacttgcctatcaactatgttaaaacttttttaaaaatcacagctgttctgagatctcagccagtttcatttctgacttaaactgggagcagacgtgtactttcatttttcactctagctacttcagtatttgaattctttaaactggaaaaaaaagcaagttggagaggggcaaaggagattcttagttgcctcatctgacacacgcacctcctaggaaccacagttcctcctagaaaccacagtgctagaggaagagttggcct

SEQ ID NO: 235924 - DNA, 358 bp, Homo sapiens
taaatggaaactggtggcctgcttcaatccagggccattttgaagaacatgcatgtgcctggttcacaggaaaccaagttgtctgagaaatgaaggcagaggctgagagaagaactacacctacatgtctgacccatggaggaaaagaatcattttcttctctgaaacctggggaaatgcaacactcacaaaacacagtcgtgtatgtgaccatacagggagacattgcgctcccatcaaccgaaacctgccttatgaaaccttttaactaaaattatttcatttgctttctagaaaaaggacatgcaatttattcaatgcatcagaccattcaaagacacatcaagctttcttttaa

SEQ ID NO: 235925 - DNA, 360 bp, Homo sapiens
agtgtgcttccttccttctgttgaggatgcaagatgcaagtttgtcttttactttggaggggacagccctgcatgcccctaaccactggacccataacacttcactgcagtggccactcttgaagctctgtaaggttaatcttcaccttctgtagtgcacacgttttgccaaagaattcagcgtactttcctcctcttactcatccatcccaatctatgtgatattgccaatgaaacgaagagatttagtattctgtgagatgtctgatttgtccagatctcttaaggtgatatttatagaaggttgaggagttaaagtagccctgaggcaagctatcaataaatgtattataaatccca

SEQ ID NO: 235926 - DNA, 560 bp, Homo sapiens
ggaagcatggaggtgtaggatgacatgtaatatttggaagacccattgcatttccaaggaaccttctagcaggatggccctggagtctctggcagcagtggacatggtcctgaattggagtgctgtgaatgttcactgctgacctcacggtttgaagacaattccttgagaagggcagaggggacccgaatacgggggctctggccggccctgctgccagatgccagcagccgtgggggcttgcccggccagccctggcttttcccaaccctcagagtgccccttgtgcatgcagcagacactggtgctggtcccattcccgggagcacgcggtgccactggctgtgtcttgcctggccaggtgttggtttgatagactcgaaaacctcatttggatttggcaggattttccctaacatcagtcattctggaaaaaacactttgaatttttaccatatctgggtatttttaccatatctgggtacttgccactagctctatttacttcacgtttcttaaaattgattcattttattacttaaataaatgtattttaaaag

SEQ ID NO: 235927 - DNA, 507 bp, Homo sapiens
tccctccccttcctctctctgcccgcgcgaagctcattcattctagaggcgggctgccagtcctccccggccgcccatcccggcactgcaaatccgctagacgctttgtctcgcgccggccggaaactggggcgcgcacgcgagcgcgcgctcgcgctccagctccccgcacctggggcctgaggggccgcctctccgcgccggctccccggattcgagtgcgaaagcgggagctccttctcggcagtcccaggcgcgcacttaccacgtcccagcgggtatccaaaatctagaaatgggcatcacggccccccagcgctacagctcgagccccctccgcgacccctgctccgctatgaactctagattctttctcctttccggagaccgagaccctgttccttcagaaggacgcgtgcatcctggcctctgctccctccccacggcagaacccggtgagctggtcgccgcggttgcgcccccgccctccttggcgctaacgcggcc

SEQ ID NO: 235928 - DNA, 192 bp, Homo sapiens
gtccttttttccttcgtgctttatttctctttcgttccctgtgtttccttcttttttctttcctctctgtttctttttcccttctttccttcgtttctttcctcattctttctctctttttcgtgtttctttcctttccgtctggtttcgcttccggtccacggccgccctctgtgtctctcgcagccgtat

SEQ ID NO: 235929 - DNA, 443 bp, Homo sapiens
cagataagaaaaggtaccccaaggcacaagtcatcacacaagagacaaggcacccaagagaaactttaactcaacaaaggggggtgcgctcacaaggaagttgtgtataagagccacgtgactttaagaggggaggaattatttccaactctaaatatttgattcaattcaacaaatgttccctgatgccaaaggtcaaggaaggcttgtagagagtgcttgtattttgaaagtgctttgaaaaatgtaatgaattctaaggacctcaagtctaagagaatgaagtggtgtctagcaaggtggtgcttttgtgattcacctcctccaaagcaacctctttttttgttttgagacaagatcttgctctgtcatcttgctttgaaaagtgtaatgaactgtaatgtaaggacctcaagtctaagagaatgaagtgctgtttagta

SEQ ID NO: 235930 - DNA, 455 bp, Homo sapiens
taccaagcccaaccccatgtgtcatcctacacagtagctaggacgacattagtaccccatttcattctcccgtgtctcagtctctgtatctgaacaacaggacaaataacagtgtctacttcattatgctgtcatcattattgaatgaaggttcaactctccatattccattttttaacaaaagcttcaactcacatttattggcaaatgttgatgtcatccaggtccagttccatgctgccaacagaagatccattccttatcttccagcgatgcgctgtacttctgaacagcttcgcctgcatttggtaagcaagagtcgtcagtagcctggaatcaatgagaagtttacaaagttgttgagaggtcaggcttttgtgaatgaattataagaggataatacaaaacaaaaataataataaaatgccctagggaaaaataatttatcccatgcc

SEQ ID NO: 235931 - DNA, 235 bp, Homo sapiens
tatttaaaatatatatgtgtatatttgtgtttgagatatatatgtatatttgaaatatatataagttctgaagcagtcttatttacaaaaaaagagtgttttttcctctatcagtttttgtcacaacctatacatgatcctgaacaactcagatgcagtcagctcatccttttctagatatctcatggtcctgcagagatcattaaacagttttggaaaactagcatatatgttt

SEQ ID NO: 235932 - DNA, 558 bp, Homo sapiens
acagttaggtttacttctcctgaggggggaaataacaggagtcattaagaaataatttttaggcagctagaaatggtgtaagttctcggtggaattttcctttaataaaaagcgacccccaaaccatttctttgctaacagaaagcagcttgaaaaaccagactggcaagcactgatatgcaaatgctggtggctagaagccaggtccacccaatatggtggctttcgccctcctctttttgtcaccacgtgtgccaggtgtcatggcagcctccagataaaagccacatgtgcaggacatcatggtgacctgcatttgcatattaaaaggctaaggtgggagggccagttttttttacaggctgcatgaatgtcacacctggtcaaaccaatcccctgggccctttgcaaatcagacactgcctcctccagcctcccaatataatcagctgttttccattgcatgtgggattttccattaggatccctcctccctctgtatgggggagctgttttcttctttcttgcctattaaactttctgttccttaaaaccact

SEQ ID NO: 235933 - DNA, 570 bp, Homo sapiens
agagtgagtagttagcatatcaacaataatgattagcactgttgttctgcatatcaagattatgttgtggaagaagcactgtacttattttgactacacaaaaacaaaagagtaactttttggcttaatttgtaagttggcatcaatttaattcatacttatggaatgagaagtgattacaaaatataaaatacctcctacatataataaatatataattaatgggccttggaatgtaagttgagtcccggttattaaaaaatcaatctgatttgaaacaaagtttataaatgtaagtaataaaaggttctgatgtcatttttcccctgtactctttgctgaatgctgatctaaaggagatcttacatatagctgatgtcttggttcattacaattctttagtattctcacaaggtgttaactttgaattttagaaaaaccttagaggctctttgtaaaagccaaatgttctccttacttctaagtttccaagttggtcttggagttaactgaaaatacaggctttttaatacaattggtaatacaacctgattcttaaagttcattgcc

SEQ ID NO: 235934 - DNA, 1383 bp, Homo sapiens
  misc_feature (696)..(696): n is a, c, g, or t
ttattagctctaatggactaagagactaatgggccttgtgtgcccggcgaaggtgctttgacctaccctgtgggtgatggggagcctctgaaggatttgaagcagggcagagacgtggacaaatctgccaaaagaaaacaaacaaacaaacaaaaacatcaacagcatgttatgttaatgtgcgattccatttaggcttttggaattttgaaaatagctcaaagacgccgttatgaccttgacagaggccaggttggaaatttctgaatccaatgattctttagctcccctctaagtctgacagtctaagattccataataaggaaggtacagctattgccaaaacgtataatgcatcacagtgtcagactttgggattatctgctgctgggggttttccacaccactgctccccttcattagtggggataattgagagttgactgcagtcgttactgctgttgtgatgggtatttgaagctaaattcgggcaagtaggagatgtgtgaatatttatctcagctgcagaaacttaatgcagtgtggcattaattaccctgtctgagcctgctgtcttcttctgtttttaggtgtcattttcagttggataaattagtttccaaaattagaatagagcaaattgtagggtgagatcaaggcagcctgacttcttggggcatccaaaaagaagaatgngctgagaacatctatccaggaaacattaatatgcgtgcttgaagcccagcacaggcaaaaggaaatatttttccccagtagttgtacttaactatttttgactccacctactgcacttgtagaacacaaacacacaataaagttacatgtttagccttacaacatgtatttgaaatagttcaagagactggaaaggaatagatttggtgtttaataaatcataatcttactatagattttgctacatttgattttgagagaataaagccaaattggagtgtatttaggacaaagggatcagaactgtgaggaaactagaaacagcattataatcattcagtaattcaacagactctcattgaggacctactgtgctaggttcatatttgtaaaatggcagaaggaggcctggcgcggtggctcacacctgtaatctcagcactttgggaggccgaggtgggcggatcacaaggtcaggaaattgagaccatcctggctgacacagtgaaaccctgtctgtactaaaaaatataaaaaattagccgggcgtggtggtgggcacctgtagtcccagctacacgggaggctgaggcaggagaatggtgtgaacctgggaggccaagcttgcagtgagccgacatcgcgccactgcactctagcctgggcgacagagtgagactccatctc

SEQ ID NO: 235935 - DNA, 2969 bp, Homo sapiens
  misc_feature (2541)..(2541): n is a, c, g, or t
ttagctgaattccggcagggggactgcaaaggccaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacagaaaagatgtataggangaattgctgctgcacagagttacagaaacaagttgaaaaacatgaacatattcttctcttcctcttaaacaattcaaccaatcaaaataaatttattgaaatgaaaaaactggtaaaaagttaagtaagttaaatcgtatgttttcgcctcttctgtgatcaccaataggacatcttcaggcatattggcaggatagagctaatggagtgaaacctattgtaaggctgtactttcgtgatttaatgacctgaggtttggtcataatgcttctgctgtttttgtaggtttatctgatcgttttcctttgctactgctaatggaactgaacccccaggggtattccagttgtaatagcctttccttactgttgtttggttctgtgaatgcctatgttattgatatgtggagggccggaattcttttgcta

SEQ ID NO: 235936 - DNA, 2652 bp, Homo sapiens
  misc_feature (2541)..(2541): n is a, c, g, or t
ttagctgaattccggcagggggactgcaaaggccaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacagaaaagatgtataggangaattgctgctgcacagagttacagaaacaagttgaaaaacatgaacatattcttctcttcctcttaaacaattcaaccaatcaaaataaatttattgaaatgaaaaaact

SEQ ID NO: 235937 - DNA, 789 bp, Homo sapiens
gttttgtctcccagcatgtgggaaagatgtcatccattgcttctgtttcctggaggcctgggagcaaggagcccaggaacagtatcacgaagcttgagataacaccagttacattatcctgactgcccaaaaggcagtttttttgttttttttttttatactttaagttctggggtacatgtgcagaacgtgcagttttgttacataggtatacgtgtgccatggtggtttgttgcacccatcaacccgtcacctatattaggtatttctcctaatgctgtccttccccaacccctccattccccatcaggccccagtgtgtgatgttcccctccctgtgtccatgtgttctcattgttcaactgtcacttatgagtgagaatatatggtgtttggttttttgttcttgtgttagtttgctgagaatgatggtttccagctttatccatgtccctgcaaaggacatgaactcatccttttttatggctgcatagtattctatggtgtatatgtgccacattttctttatccagtctatcattgatgggcatttgggttggttccaagtctttgctattgtgattttttttttttttttttttttttttaagacagagcctcactctgttgcccaggctggagtgcgatggcatgatctcagctcactgcaacctccgcctctcaggagaattgcttgaacccaggaggtggaagttgaacaatcacttgaacctgggatcacgccactgcactccaacctgcctgggtgatagaatgagactctgtctc

SEQ ID NO: 235938 - DNA, 455 bp, Homo sapiens
ctgagacacgcaaagtgactccagtttctgtgatttcttgccaaaattctatcttatcagccttctcaaaatacatgcagatgagatcgtcaaagaacaatgcacatacatttgcttcatcaacagtaagactcagtcccctccctgtctatggacctctgtgaaattcgacaggaaagtgacaaagtggaccaaatggagcacacggagaatgaaaataaagtggtaccagtagcttctggccaaagctcaacaaatttaagcaaatacatttagataagaaattctggtgtctttaatattagaataactttaaaatgaacctaataataagtcatttaataataattaaattggggtcaggagctgtggaaatcattgtgaactcgaggccacaaaaggtttatttccaattctctcaccaaaagtggtctcctcaaatactcacggtcagc

SEQ ID NO: 235939 - DNA, 350 bp, Homo sapiens
aagagagattcaagtttagaccaaaaaccaccttcaaacatatttaagtcttgttatcttttaaaaatacacaaataactaacccactcaatcttctagcctctatgaagtcttctatttgcaaagctgacaatctctgatctcctgctttcacactctatgcgacctcttccctgctgcttttataaaaaatggcaagtgcatttactgttctaataaatgtgctcattagtaataatcagagacctcactctctaaatccaggagccctttttcagttttcattttcctcaacctgtcatcacaagacccttttgatgatctattttttaaaaagatattctggcttc

SEQ ID NO: 235940 - DNA, 327 bp, Homo sapiens
agtttttttgataaacaggtgttgataaacaggagtcaaattctttttttgtatctacttataggatcatgtgatttttcttcattagcttgtggatatgatagattatactaattgatttacaaatgttgaaccagctttgcatacctgagattaatcccacttggttgtaatgtatagtcctttttatacattgtcagtcaaatttgatttgttaatattttttgaaaaattttgcatctgtatctgtgagagttgttggcctgtagtttcttttttgtaatgtcattgtctggtaggcaattaaaaagatcagaattttccctt

SEQ ID NO: 235941 - DNA, 351 bp, Homo sapiens
ggaaggatgatcagtttgattctggctcccctgattacaccttggctccaaggacataaacatccaagcctggtaaagcctatgcaagagcgtctggggctggagatagctttcctagccctggacgtggaagaaagtctactttttatccgccccagcctccttcccctcactcctcccgtctttcgctcgctccacctcttttgttcagtatgtgtaacttgaagctactttgtactggtgggtatctgactggccccccagatacagaatatgtattgttcttcctggggcacagcatggaatcccctttaaacttaaataaaacaaacctaaattaaaaatgccaaa

SEQ ID NO: 235942 - DNA, 314 bp, Homo sapiens
ggaaggatgatcagtttgattctggctcccctgattacaccttggctccaaggacataaacatccaagcctggtaaagcctatgcaagagcgtctggggctggagatagctttcctagccctggacgtggaagaaagtctacatctcatccctggcagcagcctggagcagctaagaaaatgggtttaggaagtctcagtccattttcagaagaatagaaactagtgcaagcatgttctggggtgggaactgagggacctccaatatataaaatagaaaatcaggcctgagggtaaggcaacaagaccagtaac

SEQ ID NO: 235943 - DNA, 258 bp, Homo sapiens
ccacccccaaaacacaccctcctcaccttcagccccaatgccccattcccactccttatccttatccctcttcttcagccccacgtatcccaagggcctcaactccctcagcccctgaaacccaccgtaacaactctcttcccacacaccctcctcaaatccaccatctcataaagcccctgcacttagaggtgtcagtctcctacctggctctcttccctccttaagttcccaaataaatatatcctgacacataga

SEQ ID NO: 235944 - DNA, 196 bp, Homo sapiens
gtgtggtggaagcagtatgcactgctgcagtgcaggacattgtacgtctgcactgttcagactctccttgggtaagagacttattgtcctggcttctgagaatggtggtagccccttgaggaattgcctaagttgcagagagctgtctcgcccaaggtcagcctttcctggggtgtccaatatccatcgactcatc

SEQ ID NO: 235945 - DNA, 401 bp, Homo sapiens
ggattcttaaattttttgatggtttaaaaaagataatagatatttatcaatttatttttctgtcttaaagcacatgtaacataattttttgtactgtgctataatatgttgatgtctctggaggtcgtgggatgtagctttttgctggacagagagttcagtactcatggcagctgtttatagttttttgatctccttgtcatttgttttgctcctgtttcccttgtaatgtgctggttctgccctaccctgaggaaccaagtttcttagaatagcataggtgtcattctgtgcctatggcattagttttcctacttggatttggattttcgtttttgattttttgtattcttctgattgtgttacaaatatttgtgaatatttaataaatgacttctaac

SEQ ID NO: 235946 - DNA, 383 bp, Homo sapiens
tctcttatttctctgctccgtccaagtgctataaactctttcctggatttcttagctcttttgaagataattttgtgcatggatggtttttctttttttaatttttaatttttgtgagtacatagtaggtgtatatatttttaatggtttttcttttctttttctttttcttttttttttttgagatggagtcttgctctgtcacctaggttggagtacagtggcacgatcttggctcactgcaatttccacctcccaggagaatggcgtgaacccgggaggcggagcttgcagtgagccgagatcgcgccactgcagtctggcctgggcaaaaaagcgagactccctctcaaaaaaacaaacaaacaaacaaacaaacaaac

SEQ ID NO: 235947 - DNA, 592 bp, Homo sapiens
aaggtatacagattgaaaaggaagaaataaaaactacttgcaaatgatgtatacaaataaacctgaggattctgcaaagactatttaagctaatagctaaatgtaggatgtttgcaagatggatcaatgtagaaaagtaaattgcagctgggcatggtggctcatgcctgtaatccaaacactttaggaggccagggtgggcagatcacctgaggtcaggagttcaacaccagcctggccaacatggtgaaaccccgtctctactaaaaatacaaaaattagctgggtgtggtggtacacacctgtagtcacagctactcgggaggctaaggcagaagaatggcttgaacctgggaggcagagattgcagtgagccgagattgcactccagcctgggcaacagagtgagacttgggggaaaaaaaaaaaagaagaaagaaagaaaagaaaagtaaatgcatttctacataccaacaaaaacaattagaaaatgaaatttgaaagacaatgctgtttaagacagaataaaagtctgttttagtctgttgaggctgctgtaataaaataccatagaccgggtagcttatgaaca

SEQ ID NO: 235948 - DNA, 711 bp, Homo sapiens
gcaagtaacttaaacactgtactctgatgacatgtactcaattgtagggggaaaactacaaatattcttcttaataactttgtttttcatagtgatgtggaattatttcatgtgtatgtggattgagaaaatgactaagtgtgttgatgtttgggagaaccccctgtgaagaagagggacacttacatggagtaggcatcaaggaagaagttggtgcagttgacttggaatcagcatcatctatatggactcattatttctcaaacatgcacatatgtacacacttcttccagctctagctagaactaaaaaggcctagaggcagtaataccccagtcacaaagaacacacctagttcccagtcttattttcaaaataccatgcaccactgaaaaggatcttgtgcagcttggagaaatggctgattccaggatgggggcagcaaagacacaaaaggagcctagaacaagaagaatgataagcaggatgagaaggaagaatacaaaatgagcccagaattagcagggggaagagaagccaatttttaaaatgggcaaaacattggaacaggcacttcaccaaagaatgcatataaatggaagataagcatatgaaaatatgctcaacatcttcacccttagcaaatgaaaactaaaaccacaaggagattccactacatgcttattagaatggctaaagtgaactgacagt

SEQ ID NO: 235949 - DNA, 1658 bp, Homo sapiens
taaacagggaaatgtctattgttttttccaatcgagaaaccaaataaaacgtacaaatatctcatgagctttcctcagactttcccagaaagagtttatatttgtgctgagacaaagcacagagaagttgcaacctcaaatggcttggagacagttcacattgaaatagctgaagagttaggtaaatctgtagaaataagacttccactggattaagtgtgaagaagaaaatatgactttgttttctctgtgttatagcattctacagtatcataaactccaatggagaaccacatttggggcgtggctgaggtggggctaatatggtagcatgtgctaaactctttctaggatattctattgcctctgagcttatacccagctccattatctatatcagctttttgagcttaagtcttcatggcaactgccagctaaatgctcggaaaaaaaccgtttggagtctacccccttctcctaatttatttctcctctaaatcgtggttcactggtgccagtcatggcagagggtgatcttcttaggatgcaaattagataatcttcataacataaagccctaactttttaccttagcccggaagagccccacatgatctgaactccagcctggaaggattaaaaaatctttttgatatatttgtacatatttatggagtacatgtgaagttttgttatatgcataaaatgtgtaatgatcaagccagagtattcagggtattcgtcacctgaacatttatcatttctacgtgttgggtgcattgcaagttctctcttgtagctattttgaaaaatgcaatatattgttattagctatagttaccctactctgctatcaggcattagaacttattttttctacctaacaggagaaggattttaatgtcagctgagttgagggggcgcgtcacagagggagtagaggtgtggccattagttggtagaagagcaacattcaaaatacagtcccaccatttaactgtttcctgtttttatcaccctggcagcttccatgctgctacttctgaagtcttttcattatagtataaacagctctcattcaatatatgactagtacctgtttaaaaaatatggcactttgatagtatatgcttaggggaaggaactgcttctccttctctgccaccttatgctgcttctctctagtgcctttctgtctctctacctgatctctttttcagttcctttattttgcaaaactacttttctgacctcagaaccttcacacaagctactccttcctcctggaagctttccctccctctctttgcctggccactttctactcatcctttaaaactcagtgtaactcagtcctcatcaaagagggctttctggccaggcacagtggctcacgcctgtaagcccagcactttgggaggctgaagtgggcagatcacttgaggtcatgggttcaagaccagtctggccaacttggtgaaaccctgtctctattaaaaacacaaaaattatcttggagtggtggcaggcacctgtaaccccagctactcaggaggctgaggcaggagaatcgcttaagcccaggaggtggaggttgcagtgagcccagattcgcgccactgcactccagcctgggtgatagagtgaggctccatctc

SEQ ID NO: 235950 - DNA, 457 bp, Homo sapiens
cactagtaacaaggaggctgtcttggaattaactacataattcagctgttgctattcccagtagctccagttactgtaccactcatagcttgatttcccagtcttagtcaaaacacgatctttaacccacgtgttgtaggcaaaaccatatccatcacaatgagaagtttcacaaaaaaagacaaattaagtaagcatttacttttttattattgtttattctcatcttggatgattggtaataaattggggtaactcacattatttatctggaccttcatttccatataaatgaaatgaggaaggaggactagatggcttctaagatatcttctagctcttttaaataccattcttctacaattctaatttattctccaaaattatggagttgaatttctggcacattaatgtgaactatggaacattttattgcttaaaaaaaattttatttcag

SEQ ID NO: 235951 - DNA, 516 bp, Homo sapiens
gcttgggctgaagatgttgctagtgctatggagaaggctaatggcactgagaaatgtcattctgaaagaggaggtgggtcaaagagtctgccagatgaagggtcagagtttggtaaggagtacagtgaaatggaaaccagtcttgttgaaggcactttgtagctctgtgcccttgggtaagtcactgtctctggaggttcatttcttcatctattaaatagggaagttggagtggatgacctataagggctgttctcatcctaatctcttacattttacgattctagcagaatgaaatttaatgaatcaattttagctacacttggaaattcaacaatgtttcatagtaatgttacacccactgggagagcctgaagattttaatttatattccttccaaaagagcagagaacagcatttaaaacccttaaggggtacagcaatacacaaagcattttattatggtgatctaagagaaatttacatcagaaagagactggcattttaccaggttac

SEQ ID NO: 235952 - DNA, 359 bp, Homo sapiens
aaggtctcactctgttgcctaggctggagtgcagtgttgcattcacagctcactgcagccttgacctcccaggctcaagtgatcctcctgccttagcctcccaagtagctagaactacaggcgtgtgccatgatgcccagccaattttttttttttaatttatttttagcagagatgaggtcttactatgttgcccaagctggtctcgaactcctgagctcaaacgatcttcccatcttggcctcccaaagtgctaggattataggcatgagccaccatgcccagccccaaccacttaaaaattgaagctgcttcccgtttgccattggtactttgtacacctcatcatattcttcttc

SEQ ID NO: 235953 - DNA, 130 bp, Homo sapiens
accagatagcctcaggtttcccaaatcgcctctcctgctgccctggcttctcaacaccgtcacctgtctaaaagcttttcttggtgtgggctggaagaatttggataaagtctaccatccccgctcttcc

SEQ ID NO: 235954 - DNA, 399 bp, Homo sapiens
agatgggggtttcaccatgttagccaggatggtctcgatctcctgaccttgtgatccacctgccttggcctcccaaagtgctgggattgcaggcgtgagccaccgtgcccggcctgagttgacacctaatattaaccatcacacttacctagtaccatatacagagattcaccgaaaatcaaccatagaccataaacattagacctaaagctataaaacctctaaaagacaacataggaataaatcttcatgaccttaggttaagcattggtttcttagatttgacaccagtaaagcacaagccacaaaagagaaaataggtgaattatcaaaatcaaaaagatctgtgcttcaaacaacaccatcaagacaatgaaagacagagaatagggacaaaaa

SEQ ID NO: 235955 - DNA, 296 bp, Homo sapiens
cctccataggaaaaaaataatttcccaataacagattccaacaaaagaaaatccccaaaaccccagaaaaagaattcaaagttatggactacagttcagtgaaatgcaagagaattctgaaacaaaaatgcagaaaataaaaacaattcaagatattaacaagaaaatttccaaatagattgatatcgtaaaaaatcaaacagatattctataataaagaattccttgaatgaaatacaaagtacacttcaaagcttcgacaacagactacacaaaacggaagaatttcagaacct

SEQ ID NO: 235956 - DNA, 905 bp, Homo sapiens
gcctctcccctagtggatccgggctgagccttgcggcttcggagcacagcggctggttttggtcgcaacgatccctggatccctgacctcggagcccggtggggtagggctgaatgcatctagggaggaaaggtacctcgcaggccccagaccattttgccttaccaaaagatgacccaggccagttggaaaggtggggagtcaggacggaaaggcacacctaggggagaagtggagggaaagtgccagcctgtgtggggcgtcgcctcttgagggatttggaggcatgatagaggataccctatttcggggctcctgcaggcttgtccttaggtgcatgcatctctctaattcgttttcttttctgttttctgaatcccaagggatcccaaggagggagaaaggaaatccttcccagggagaggtgggggtctgggaggcgatatttgggcggaagggaaaccgaaagcgcacgggttgtccgcaccgccgctgctctggaccagaggcagaggctgtaacatcccggagctgccagtagagtccgccttagaccaagttcacagccaggctggggcctctgaggcgtcagcgagcggccgcgcaaggtggccccgggcccccccgcatcgttgggacactgaactctccctctagccctgtgagcacagcggccccttctgctcccgaggagcccctgctccaagctctctccacccttcaccccagaaatgcccttctccaggtcagcccattctactgctcgccataggtctcctcatccggcaacctcggccccactcgggtgtcaaaaatgaagaagggtgggtggtcaaaagcccttccaggcatcccaatagaagagaccgctgaaaatgcgggaggtgggttccgcgtctttttcc

SEQ ID NO: 235957 - DNA, 421 bp, Homo sapiens
tgggtggcttttttttttttttttttttgagacagagtttcgctcttgttgcccagactagagtacagtggcgcgatctcggctcaccacaacctccacctcccgggttcaaacagttctgcctcagcctcccaagtagctgggattacaggcgtgcaccaccacgccctgctaattttgtatttttagtagagacagggtttctccatgttggtcaggctagtctcgaactcccgacctcaggtgatcctcccaccttggcctcccaaagtgctgggattacaggcgggagccaccatgcccagtcatgagtagcttttttaaaatggtgtgttgcttttatttttcttttctcttcctttctgtccctccccctccttctttccctccccttcttcccttcatcccttcatctcgtcct

SEQ ID NO: 235958 - DNA, 407 bp, Homo sapiens
ggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaa

SEQ ID NO: 235959 - DNA, 412 bp, Homo sapiens
atgtggggacagactggaggactggagcaagtcaaatatggtttagtgacattgctgaagtcagaaccgaagcagaaaaactgtatataattttaaagagtcctcaaagcccagcactcttgactttcaatctttttatggattctttgaagaaatgccgtataatcagtgctcgtggatgaatgcacagaggatgatagagcatggaaaaaccccaaacattgatgagtctgaattgaacagtgattcagaagaattggactcagtgtaaagtagtttgaggaataacaaccaagttatttcacttgtattttcatttttatgtatgcacaatagtaatatgtgataaaaatctgtctaattaagtctcaaagaactcttacaataagtaaaattaaaaattctaagtgat

SEQ ID NO: 235960 - DNA, 464 bp, Homo sapiens
aggtgaagcagtgaatgctgataacttcagcaagttatccagaagatctagctaaaataattgatgaaggtggctacaataaatcacagattttcaatgtagatgaaacagctttaaattgaaagaagacaccatctaaaactttcacagctagagacaagtcaatgcctggtttcaaagcttcaaaagacaggttgaccctacttttaggtgctaattttaagttgaaaccaatgaatgacctcattttaatttgattacctctggaaagttccagtttccaaagaaggtcacattcttctgggaatgaggacgtcaaaatatcttttttggtgggacacaatggaacccgtagcatcatccttctgtatattttccattttcattaattgtgttcagaattacagatgtccactaattaataaaaaattgagcttttagcttttatttcttggttatccagt

SEQ ID NO: 235961 - DNA, 453 bp, Homo sapiens
cctcacccctttgccttttccaagcctgactccatcccaaggcagggctccctggaaacagcagctctcagtgtcactggctctcagagaagcgggaaggaaccgccttcctaagggaaatgtttcctaggagaaacttctgcattagaagttgcagagtggtcacccctggggcacatctaatctgcaggcttgttttgtttgttaatatttgaaaatcaagacttctggcattctttggaaaagtcaggagacctggtaatattaagcttgcattcccacagggcagcagagggccggagcctagaggcggtggccctttgagatggagcatagcgtgtgttctccaggtctccaagacccctccagaactcccctttccctctcctttcctggagactgaagctgcccagcagttgcaatagtgaaaattaaaacggctgtaccagaata

SEQ ID NO: 235962 - DNA, 479 bp, Homo sapiens
cagacttcatatgccgaggcttctgctccaaaagtgagtgtgaacatggtcaagactgcacgatctcctgaaccgtctccacagccactctgggtcagcgccacaagattctgctgattataggcaagtttctaagccagcccagaatcaaggaggcaaattagaccccacttttgaagggaggtgtgtgaaagaatttatgaaccatgtattcaatctgccatgcagacaggtaggtcagacagagagctctgaaacagatgccagccccaagagcctaatgaatgtgtgggagctggcggggagagctgaattagtcaacatggagcactttggaagtaggtagttggactgtaaagtcaatttatatctccctatttcataaaaagttctgaatgtatataaaaagcattgataaataaatattctagaagcatgaataaattcagcctgaacatcttaccgtaatcccaagtgaa

SEQ ID NO: 235963 - DNA, 823 bp, Homo sapiens
tcagggagatgtgaggacccacttattgtaataaccaaggccaggttcggaggtggggggcaacgcaccttcatctatcagccctttctgactactgagctactgatctactgaactggaaacaccatactccctcctacatggagaagcctcaagctcttatagatctgacgcaatccgtctttctgacacacagtccaacctggccagattgcaggcagcttttcctaacgttatttaacactaaaaagcgcaggagagtaacataggcagctctcccctggctaaaaccccatgcaccagcagatgcagtgaatgctcaggcatacactcaaggtcagttctcataccaagatcccaactggaacccagaggatgcaactcagcttcagcatttgcaaaggtaccaagagacacttctgcaagggataaaagctggtggaaagaaagcaattaatatacgaaaaatttcaaaagtgcttcagagagctgacgagagcccaagtcagttttataaaaaactttgtgaagcattccggccttacaccctatttgaccctgaggctgctgaaaatcagcgcatggtaaacacagcatttgtagggcaagcccagggtgacgtcaagcggcagctgcaggcatgaatgccacccagcttataaaagtgaccaccaagatgtacatgaaccatgaccagagaacaaaacgggaaagagcgaaagcaacaagcgaggcaccaagcagctaggcacaccaagggtttagtccctctcctcagcctggctctatctggaaaaagagcggggcggggactggccccaga

SEQ ID NO: 235964 - DNA, 902 bp, Homo sapiens
taaccatcattctactctctgttggttaagttcttttgagctaaacttttaagaatgcatttagtctgtttcttgagtaatttggtgctgctcagttcaaaactttaaagagactggaaatttagtcatgttttatactccctgaggaggtttgcaggtatgtgttttgtaatctactattttgaaagccaaaaataaggatcccaataaacagaaatgtgtggtaatgaacaattttcaaggaagggtgtaggctcaatgcatttcttttatattatatctgtagtggaatggtagttaatgttttcgtttttgtttttaatcatgtgcatatatgactatatcattggttggtacaaacattggtatatctgaatcatctgaaaaaactgccccttttttcccttaaggtattctagtccaactatggtgattctcattctgcaaatctggtgatagagcccagggaatgttttttaaaaagctcctcagctgatcctgatagactccagtgtttgagaactagtttcgggcttttctatatatttacacctttcttatgttacacatctattgactaggtgtgttatttaagactggtttcttgttaactatctaatctcaatacttacactttgcagcccagaaaattgaaatcggctatgtattgcagcttcattttgttctcagtaaaatgtgtcttttatttttacccaggcgtttactgcttttctttgtgggttgtaaaagtaacctgcttgagcgtgttgtatgaatagaggcagtacctgctgtctttcgtactcttgaccgactcttatttatttggattactgactggtcctgttctgttattttgacttcctttgtgtctatttttaacctaacctctttatatttta

SEQ ID NO: 235965 - DNA, 332 bp, Homo sapiens
gcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcgg

SEQ ID NO: 235966 - DNA, 458 bp, Homo sapiens
cagacccagaagactccaaagcaggggcaatattgcctgtttctagcaaacccataaaaatgaaacaattgggcaccaattgttttagaaaagcccactctcttcaaatgtgagatgaaaaatgagaagaaaaaggtgttaagaaggacctaattaagaattttcatgttacgtatttgaacaacttgactctgatgcaacatcatgatgtagggaatggttcagaagtcatactcgtgaagtagaaagaaaagaaaaacaaacagaaagttgcaccagaattagtgtggcactggtttatttcctacctgattgtaaaggaaaaattgagatatgctaatttatcatgcagccgcataacttcataatgcaaaatttatgagaagagatgagaggaaattggagaggaacattatgggagcaataaatacttatatatacttatatataatacttat

SEQ ID NO: 235967 - DNA, 557 bp, Homo sapiens
cagactaggaaattctcctaaatatatctccaacagagtaaacaagagattaggaaacttgtccttcattcaattacacctggcaggtgaatgggagtggagcagtaagagatgctgcttccagtagttttctacctctcaatccttgctattcaaagtatggtccacagtccagcagctttggcatcacctgggaacttgatggaaatgcagataagttcaaattcccactactgatatactgaattagaaacatctgcccttcaagaagatccactggtgataatatgcatattaaagtttgagtagcaccgccattctatatcagcttgcaaaatgaaagcaagaagaaacaaaacaaagcattagccagtttggattttctgaagtgcactaaatgtcaaactcaagaaaaggtagtagaaaataaatttctcttcaaccaagtcattagtatggaatcatctactctgttttgaggcgacaccagccaataccagccacattttcggaatcatcattttctggtgaaataaactgacttgcataatttaaaa

SEQ ID NO: 235968 - DNA, 348 bp, Homo sapiens
tgcagctggccctacgctgggtgtgatggagacactgaactgaattagacctacctctgagatcaaggagcccatcataggaagacagagacccactatcagacaactacagtagcatgtattgattgtggatgatacaagatgggtaagcactgtgcttcagcagaacaagagtagaataattaactcttcctaaggggctcaagacaggtgatattgcctgactgcagactctatgcccagagccgattcctcttcagcactttacaaagcaacagtaccctgttctgagctcctagaaatatcatccttattctctatactccctgctcaagctttggaaaattc

SEQ ID NO: 235969 - DNA, 408 bp, Homo sapiens
aaaggcacagttgatgggctcctgtgaaacgagagtgaccctgaacatcaacaaaacaatactgactggacacctactatgtgccaggcaatgttacataaatattttcatttgaacatcacatcaactttgcaaggcgggcatcatcatctttattgtacacatgaggaaacaggctcgatggataagtaacaatggaacttacacaggacagagccagaaatgtaactaaagcctgtccaatacttcctacttctacttttttttttgagatgaggtcttgttatattgcccaggctgggctcctgggctcaatcaatcctcctgcctcagcctcccaagtatctggttctacaggcacacaccactgtgctccgattcttcctgcattttttttttttgagacag

SEQ ID NO: 235970 - DNA, 479 bp, Homo sapiens
aaaggcacagttgatgggctcctgtgaaacgagagtgaccctgaacatcaacaaaacaatactgactggacacctactatgtgccaggcaatgttacataaatattttcatttgaacatcacatcaactttgcaaggcgggcatcatcatctttattgtacacatgaggaaacaggctcgatggataagtaacaatggaacttacacaggacagagccagaaatgtaactaaagcctgtccaatacttcctacttctacttttttttttgagatgaggtcttgttatattgcccagggggcaaggggaacacattctgactaaaatccgtgtgactgagaagtcaggatgaagagctgctgggatggaataaacccctccaggcagccccgagcaatgagatgggacaggcacagctgtaatctagaggccctcgggctctgctggtttaggtgtgaccacagcaggggtaccgagctc

SEQ ID NO: 235971 - DNA, 823 bp, Homo sapiens
ttcgcatcgtgcttaggcacaaccgcctctcccagtggtctcagaactccctaagggcagagcggcgtcttctcctaggctgtctcctcttggcctcccatccggcagactgtgtgctcccaagagccgcgggagtgggggtctcccaactctgcctgttccaggtctttgcatactagaggaacgggcaatctgtggcattgttgatccagtatttaccgagggcctgctatgtgaagggattcctcacccttcaggtgctcccagggctgggaatgtgtaacaccagagggtagagagtgggtgtttgaatacaggtccaggctgggtgcactcggctgggcagagccggggaagctgcccgaggggcgggtttcgggtgggaacttgaagaagccaggggtgcccaaagagggggtggagctgccccagcagagaaatgaaggtgcgaacgctggggcgtatctcgagcagagtggcctcgggagcagggggcggggtgggctgagtaagcgtaggggccggccgagctctagctgggaaacgcagccactctcctgcggccgccctccccgaccctcccagggtcagccgggcccagaagccggagcctgcgcttcccgtcgtcccgaagtgcgagaagcgcggctgcagctctgcgccgaggagccccgggagtccactcccgggcctcggtcttcccatctgtgtgacgccacaggaagtcctgagacgccacctctgcgcggccgacccctctcccgcgcgtgcaacacgtgggcctggcggggcagagctgcttgtgcgcggcgggcggggtgcg

SEQ ID NO: 235972 - DNA, 2285 bp, Homo sapiens
  misc_feature (1741)..(1741): n is a, c, g, or t
agagtagataatgtatcttggggaacaattagactccttcaaatacctttctttcaatttgatcttctcctctttgacatgctaggattacccctctgtaataagagccaaaggaggcccagaaccactgggacctttaaacaggaaaacaagttagcattcagagagagcaagcacctccagaaaaggaagccacacagatctactgtcggcctcttgctccttccccaggtgctcctcaaactctcaccttccgttgagctgccactcagtgaacaagtagaagtgataaaggctgtgaaacctgggaaagcacctcccatttttccctgcacagaggaaggcaaaatcaaggtccagaaatatggaactcgggagtgtgggttgtgtatggccagcctggacatgaactcagtgatcatctgggtcaaacagctcactgtgcaacaggaaagttgaggaccagggtcacacaaaattaaactgtattcacagatgatcccctctaaatggtctgagagatcatttggtccagcacttcccattcctggctgcacctggaataaccagcttttaaaacatccttctgcccaggctgcaccccaaggattctgatgttgtgggtctggggttggcctgggaacgggtgtttcccaaagccttctcaggtaatgttgaaggaccactagtgaaaataattactgatgtagtctgacatcctcttgttctgcagaggcccaaagggtaaacgatgttccctgcttactgagctgggtagtagctaagcatttggggaagttccggtgccccagctctgaaggacccctcttccatgctgacttcctctgttcactccaaacccctgggtgccacaggtcctgacatttcattttttccagtgccattcctgtgtggaaccatggtggtccccatctttacaggaggcacctgatgtcaaatgaatctctcggagttttggagagagaagcctctttgaacaggaaggattataagaaagggaagctcagctctaaggcattcaccattcactttgccctgggctagtcctttagaaagatgtgtgttcctattacttcaaaacccctcaccttgagatccctctgaaaccagcactggctgcaggtgtctccaatgaggagaagagaaaatctccaggtactagaggactccctctatgggcaacttgtatcttatctacctgtggctgagggctcgggaatccagtaggtatctatttctctccgcaccagctgccccttctctagaacttagttccctttccctaaggttctcctaactttcttcttactgcagtaagagctctgcttcttgccttggtgcagttactggaaatgctcaactgtgattctgacatcagcagctgagaaccgacttgtaagttccttggcttgtttgaagatctgtaagtgggaattaggaggtcagcgttcaggtcctggtttggcttcctctaagctgtgtgacctgtggtctctgacttaaccactggggcctcaggggagagggtttgggggatggttactctcaatgtccccatctcatgggctgtcatgggaccaggtgagacaatgccgggagaagccgttggctgaggtcagaccacagtgcacgggtcagcatggttaggaggagctagaaagtgagagatgtgagggattagtgcaatcaaggtcattcctggaaaggtgcttttattatnatcattcacactgtagatgataaacagtgatggagttagcaaaccttttcatgcctgtgacctcactggagttctttgatgttgggacttcataagtctgccaaatcctgccacttactgctttatgaccttgaccatttaccgcttctctctggacctcagtgttctcaggatgcaaaaggagggtcaggggtaaaatagcgactttcgaactgtcaggggtaaaatagcgactttcaaacttttcaaacttctgggacaagggtgaagggcaggactctgcctctctccttcccttcaccttattccacttaaattgtgtgattctacaagcttatgtttaaaggaatatgttcctccattacaaagagtttaaatggatatggactgacattgaggagttattgttaatcttgataggtgtgatatgatattgttgttatgtttttttaaagatcctaatttgttagaaatgcatactgaagtacttgtgggtaaaattatgttttgtctattttgtttgtttatttgtttaaaaagctcc

SEQ ID NO: 235973 - DNA, 879 bp, Homo sapiens
acctcttgcagaaaagtaaaagatcatttattcattctgtttctagatagcaaaactaagtgtcaaaagcaccttctgcacacagtctgcacacactggccggtggtcctgttcccgcaaggttgagctgtgttccagagacatgggtcctccgggtgatgaggagccgctggagggccctgagctgcacgtgctaatgattaacgccccgtccgtgctggccggtttctcaaatgcctcctgacgattgcgcacagccggacatcatttgtactgagagacaaaaggaaatcactgaggctttctgaggtgagctgggcggccgcggggggactggactcacacctgctaacggccagtccacaggacctgcccagaggctgggacacaccgctgaagtcacatcccacggggagcatcctcaccaactgacaatcagcacgggtttgtaattaagggtttctgcccagccaatgaacggcctccagaaacaacctttgtggaaccccctataaaagccttcccagcgcttgccttcaggacactgctcagggctgactcagtgtacccaaactgcagtctttgtttcccaaataagcagtcattcattctacctccgtgtcaatcttttcttcgtgaacacagctggtgtcaggagcagggctcagcaagatctctcctttgagcggctttctctggaatcgggtgaagtccccacaacacagaggcccctgtgcgcgccccttctttggggccagcacctcccttcaactgaggctgatacctttatttgggaatctgggggcagttgctgcctctgtgccggcaaaggctttcagcttggaggacgttttccctgcttactggagattttcccaa

SEQ ID NO: 235974 - DNA, 1023 bp, Homo sapiens
agagcttttcctaaactggagacggatcctgccctgggggtctcagtcaccgcgaggactcgagggtaactgccagaggtcccaggtggcccgagggctattttaaaatattttctgtttccttgatttctcctcctttggatgtattgggcttcctgactctttgaagaatctatccagtgtctttaagatagcaaaactaagtgtcaaaagcaccttctgcacacagtctgcacacactggccggtggtcctgttcccgcaaggttgagctgtgttccagagacatgggtcctccgggtgatgaggagccgctggagggccctgagctgcacgtgctaatgattaacgccccgtccgtgctggccggtttctcaaatgcctcctgacgattgcgcacagccggacatcatttgtactgagagacaaaaggaaatcactgaggctttctgaggtgagctgggcggccgcggggggactggactcacacctgctaacggccagtccacaggacctgcccagaggctgggacacaccgctgaagtcacatcccacggggagcatcctcaccaactgacaatcagcacgggtttgtaattaagggtttctgcccagccaatgaacggcctccagaaacaacctttgtggaaccccctataaaagccttcccagcgcttgccttcaggacactgctcagggctgactcagtgtacccaaactgcagtctttgtttcccaaataagcagtcattcattctacctccgtgtcaatcttttcttcgtgaacacagctggtgtcaggagcagggctcagcaagatctctcctttgagcggctttctctggaatcgggtgaagtccccacaacacagaggcccctgtgcgcgccccttctttggggccagcacctcccttcaactgaggctgatacctttatttgggaatctgggggcagttgctgcctctgtgccggcaaaggctttcagcttggaggacgttttccctgcttactggagattttcccaa

SEQ ID NO: 235975 - DNA, 466 bp, Homo sapiens
taactgccagaggtcccaggtggcccgaggtgatgccgggcgcagggaggggctggggcggagagagggctggggtttggggccgtgtcggggatgagtggtgaggggtgcccagaagggggaggcagaggttggtgtggccacggtggaaggagccacaaacgtggacatgtaaaggaggaccaaaaggtttttttttgtaaagatcaatatttaggacagaaatcacaacctttctataaaacaaaacaactgtataatttaaaaattgaattgtgagctaaacgcatatgaggggttacgggttttcaaaattcagagattaggagcaaaaccaaaaacttgtagcccgcttccctgtgagcctcttctccagcccagcccggctgcaggactctggggctgccttgaggacggggtgctatttctcaggtttcgtctgcaaaggggtaagtcaccccaaacc

SEQ ID NO: 235976 - DNA, 1807 bp, Homo sapiens
  misc_feature (29)..(29): n is a, c, g, or t
  misc_feature (656)..(656): n is a, c, g, or t
  misc_feature (670)..(670): n is a, c, g, or t
  misc_feature (917)..(917): n is a, c, g, or t
ttcaagatgcttgtaaatgatatcaaccntttatttagtccacccctgaagaactgagggtcctgggaactgaaccatatcaatgcaatcttttctacattattaactgaagaaaaatgggtactttttaaactttttttttttaagattaggaaacaaaaagaagtcagaaggagccaaatctggactgtaaggtgcatacctaatggtttcccatcaaaactcttacaaaatttctcttttttgatgagaggaatgagtagaggcattgtggtgcagaagtctctagtgaagctttcccaggcatttttctgccgaagctttggctaactttctcaaaacactcataataagcacgttatcattctttgttccttcagaaagtcaacaagcaaaatgtcttgagcatcccagaaaactgtttccatgatctttgctcttcatctgtctgcttttgctttgactgaatcacttctgcctcttggtggccattgccttaattgtgctttactatcttcaggattatactggaaagaatgctttagtatcttggtcctacttgttgaaaatttctattgaaagctctgcttttgcagctgatcgggatgcagtggttttggtacccatcgagtggaaagtttactcaactttaattnttcagtcaaaattnttcaggctgaaccagttgagaggcctatagtgttggcaattgtttctgctgttaatcattggtcctcttcagttaggttacaaacaaaatgaatttttttcctcgtaaattgatgtggaagatctgctgctgcaggcttcgtcttcaacatagtcttgtcccttcttaaaacaagttacccatttgtaaactgctgctttctttgaggcattcttctcataaacttttcaaaaagcatcagtgattncacaattcttccactcaagcttcaccatcaatttgatgtttgttcttgcttcagttttagcagaattcctgttgctctggtaaaggctgttttcaaactgatgtcttatccttcttagtgtttcaaactaggttctgttcagacatgttataacagcttagtacatgtttattttggtgcaaaaagttttgaaacctatgtatagttttttcttaatactcatttttcataaactttttaaagaccccttgtatatgagatgtccactcacaaaagtgttcagttgcctgactatagtgaggaataattactaagtcaaaagaaaatatcagtaatggtagttatcctttctgtgacatgtgattataaactaagcttcagttcatcagtaactaccaagtattgtgttttggtttgggctataatgttgtcatctacaaaaagattaaaagctattaaaagaatattggaaaacagaaaaactcattggttaccatcagagtttgctagggcatcagattcttactctgaagattgataaaggagagaatataatatttatcctgcccttcttgttatgaactgtattttaggcagccaagtaactgagggaaaattcttaggaaaatttccagctaataggtgcaaaagaaatgatagacttttaaaaaataaaagtttgaaagtcttaatgaagtagtgaatctagacagcagtatttcttggatgtgaaaaccattagatgataggttaatgggaaattttataatgtagaaatctgatcaaacccactgattgaagatgagacagtcaattattgtgtacctcctggtttgatgcaagagacagtacacaacagtagtaatagcaccaataaagaactcttgtcc

SEQ ID NO: 235977 - DNA, 381 bp, Homo sapiens
ttttacgattaaatgacataacacatgcaaggtccttggttccacatagtgggcactcaacgaatattagttctcgctaaacagtcacttaaatatttgtaggccttggctttcccgttccttccccgacctttttactggggctagggaaggtatccggtggctggaggcgcttcacactgggtcgggtgagagcgtgaagcgagccttttccctaacgtcacgggagcagctgggaagagaccgaagaacgagggtcactctcccctgtatacgtggcatgtccttcctctgagacatttattcctcccaccaacaaacattaatggaacgcctcacaagtgctagaccccagcgacacaaacaagggcgaggcacact

SEQ ID NO: 235978 - DNA, 297 bp, Homo sapiens
gctgtgccaactttatttcaaaatcaccagaggttgaaatgttggccaagggactaatctgaattatgtacctgaagcagcaccttagctgggagatgtgaaaactcaataataaacaaatggcaaacaaaaccaactctctgggggaggctgcttagattaactgaattctgaactgaatgtttatttatttctacaacagtactatgtgttcatagtacaaatatttatgagccatggcacatgtttagaccaagaattggggtaataaaaactgaatttcaagttgaatgtaaa

SEQ ID NO: 235979 - DNA, 342 bp, Homo sapiens
aaaaaagctgggaagtagtaacaggactaaagtcaatgggatggggcctggacaattagaggaaagttcatactgctactgcttcgatgtatatcgtatgatctgagcaccacaacaacattatgcaaattccaaatgtagatgcagatgagacttcagatgcacaaactgagacacacctgatgttgtttgcccaagctttcacagctatttagtgagagaagcagtgctacaggtttctgattccccactcagtgtattttcctcaagactgagatacctgtttaaatagagaggtataatatcatgtatacatgacacgtccattctttatcacagaca

SEQ ID NO: 235980 - DNA, 1193 bp, Homo sapiens
tttccttcccctttcgaggtgccatttctgcacgtcgtctccagactccacacccggtggaatgaaacttttaacattatattgataaatgaaaatatatgaggtcttcatttcatagttgcatttttttcagaagctaaaatggtgcgaatatccagaataacttcaaatataaaattcttttatttttagattttttttttttttgcattgtttagtttttggtttctgtgacctgatgaatgacaaagttttttcatttaacatagaaaggttaacttcaggctgtatgtacagtaatgtacttttcagagcatcttggtaattaatgtatttctgaaacattcattagtcattctaaatttatatgtaaaatttgataagtgtaattttcccagagttacaggagtgtctcagtttgaatttttttctgttccttagccgtatatttaagatgagatttgtatcaagcaaaagaaatgtatcttataaatttaaatacatgcctaacttatatgagagggtttattattgcttactttctctagaaaccacttttataagcttacagtttatatctctcttctaaatactccttgatagaaaatcttgtagagcagtttattatactgttaattctgcaaataaatggtaatttctccacagcatttcgtgacagcagtgtatttttttatggttttaaagtaagcattttgggccgggtgcggtgtctcatgcctgtaatcccagcactttgggaggccaaggtgggcagatcacttgaggtcaggagttcaagaccagcctggccaacatggcaaaaccctgtctctactaaaaatacaaaaattagctgggtgtggtggcgggtgcctgtaatcccagctacttaggaggctgaggcaggagaatcgcgtgaacccaggaggcagaggttgtagtaagccaagatcacgccactgcactctagcctgggccacagtgagactctgtctcaaaaaaaaaagaagaaaagcatcttacgaagaagaaaaattgtactttaagttttaattttaagtggacttgagatctttaccgctgtattccttggagtctctaaatatgactaacatttcctacctactgatgtctctgtttacattaattggcttgctcaagctccacaagtagcaactatgatgaaaaggtcc

SEQ ID NO: 235981 - DNA, 424 bp, Homo sapiens
ctagaagggactgatctacgcgattgggtctcttcttccaaacttgtgaatcaggtaggtcccttctccagccatgagatgagggaggtatcaggtggaggaatagtattaccctatggtgtcttctccatggaaacgaagaagtgagggataagtggtcctcctaaactcgttgcaaggtgtccctgaacccattctttagagagctcaatgcacaactatcttaacgttgtcctggcacaaagtccctgatacttctttgttctagagtgataatctttatatttccttattttttgaactccaacatccactaacctggattgtaagtgaggccttgaggggagtgattagaaaggaaaggggcagaatgtgttgttgtatgatgggcgatcagctagtaagatgcacatattggcattaa

SEQ ID NO: 235982 - DNA, 234 bp, Homo sapiens
gtaagttctaatctatctctggtttacttttactcctatgatgtaatctttcagggaccccagctgaaagcttgggttatcggggtccctcttcttagtcaataaaactccaacatttaggtttatagcctgtaagactgccaaaaattccaattatctgcttaactacttaattacccccctttaacttgacttcttcatatgtaagtccatgttgcttatggttggcaaatg

SEQ ID NO: 235983 - DNA, 369 bp, Homo sapiens
tagtatttcctgggttataattgagccttaactaaaaaccaaaataaaattaaaccacaatgtcattaacaaataacaattaacaataccgtctatataaaaacatttcagccagatctttccattaatgcaaaagtggttgttaataatgtataataatcagtaagtttgcaagcttgagaaatatttagttcaacaaaccatttgatttttttttaagccaaagaaaaagtattcagacctggagtgaatcacaatgcaatagagccttggttgtatttaaaagtgtaaattctgttttaagcatttccactccacttgagaaagagcaaccacaaaattcccaaatgtcaacacagatggaagtcg

SEQ ID NO: 235984 - DNA, 404 bp, Homo sapiens
ggccctcggacattcaggttccaggccattcaccccattgctgccccaacctggacaaacttccaggccgaaggggaacagcagccgcagctccctgctaggggatttccccgggtgaccgcagggctggggagcattacacggccactcaatggcagaacagatgactcctttaggagagctgcctccagaaccttccaggccaggatctgcctgccagctgtccccctccgggaggctggaggagccgggccaggccacatttgtggagcccgaaggcccgtgtggcgcttctcctattctgtagagtggtagtttgttttgttttcatttttttttagtttattttcttacttttaaggcaaaagttaaaactgcctacattaaattctggttaaaattca

SEQ ID NO: 235985 - DNA, 848 bp, Homo sapiens
tccccggaatccccgcccctagcgggctctcccggacccccggcccgcgctagtctttgccaggatcccgcgcaaaggatcaagtcccagcttccctttccccaccgagagtctccagcgccaaccgcgggccgtcgggcgggtccctgacccgcagttactcagtacctctctggtggaggaggtgtcagcgacttgagaatgagtgcgccaaagaagacagagccacgcctgagcctccttcaacaaagcctgcacttcctgttctcttctcaagcgtgctgtcagcagatcttgactgaaacctctgtgccctaccctgtccttggcaccagacgcaggggaaaggatcaggcccagtccctcctctgactgacagtgctaaaccagctacctgttctgagcaaggcccctgaagactgggaacacgaatttgcccaacagctgcctggcttaagggttaggccgttgatataaaaatacatggctaatgtaacctactaccactctcccggctctgttaagctcctgtcacactagccttcgttaagttcctaaccacgtcaaactcagccacctcacagcctttgtatctgctgttgcttctgcatgaaacactctcgcctgctcccagttcctcatgtagctggtctcttactcttccagatacagctcaatgtgtctccttagaaacttttactctgcccaccccttcaaaatcagtctgtggccaaaattggaccattacatctgtctgcccctcccccaacagatagtgattgccacttttcaggtcagagactgtgccttattcatctctgtgacactaggacccagccatagaccct

SEQ ID NO: 235986 - DNA, 1289 bp, Homo sapiens
tccccggaatccccgcccctagcgggctctcccggacccccggcccgcgctagtctttgccaggatcccgcgcaaaggatcaagtcccagcttccctttccccaccgagagtctccagcgccaaccgcgggccgtcgggcgggtccctgacccgcagttactcaggtaactcaggcctgcggcggcggcgacagcagctgccctgccccgatctccgggccttggtgctgctccactcgcctcagttctagagctgtctaaacagaggcccaggacacgacgttagcctcccaggagctgcctgaggcgacaacagcccgacccggctcggcccgggggcgagctcccagcccccaactcccggccagttcccaggctccgccctcgcgcctcgcctgacaaccaatcggcttccgcctctctgcggcttgggaacccgcgcgcttcgtcgcccatgcgcagcggcccctggtgggaaaatcagcaaactgcagacaggactcggcgctcctgggagggcctgctcttttgcagagggttgccgagtgaagctaagacccgccccgggggaggcccacgagggccactggggcctgcgagtgtttttacctctctggtggaggaggtgtcagcgacttgagaatgagtgcgccaaagaagacagagccacgcctgagcctccttcaacaaagcctgcacttcctgttctcttctcaagcgtgctgtcagcagatcttgactgaaacctctgtgccctaccctgtccttggcaccagacgcaggggaaaggatcaggcccagtccctcctctgactgacagtgctaaaccagctacctgttctgagcaaggcccctgaagactgggaacacgaatttgcccaacagctgcctggcttaagggttaggccgttgatataaaaatacatggctaatgtaacctactaccactctcccggctctgttaagctcctgtcacactagccttcgttaagttcctaaccacgtcaaactcagccacctcacagcctttgtatctgctgttgcttctgcatgaaacactctcgcctgctcccagttcctcatgtagctggtctcttactcttccagatacagctcaatgtgtctccttagaaacttttactctgcccaccccttcaaaatcagtctgtggccaaaattggaccattacatctgtctgcccctcccccaacagatagtgattgccacttttcaggtcagagactgtgccttattcatctctgtgacactaggacccagccatagaccct

SEQ ID NO: 235987 - DNA, 499 bp, Homo sapiens
cctgacacagacctggcaccctgcaggtatccagggaattgtagcaatcagctcaatgctattctccagctggctgtccagctgttagggctggaaggtccttagagtgtctcggtctcactttgcccttggggaaactgaggctcagagtggagagaactttgttagggcccagagaattcatgacattgctgggccccatcgggggatgttgaagaagatgctaactggagtttacacaatactgtttgcactgcattctgtgcttggctctgccatgtgagatttcatttaattctgacaacatcctgcgaggtgtttgctatcattttcgccattttatagggaaggaaaatgagacttggagacctcaagtggttggacatgcaattcctgcagaaggccacccgcaaatctctggctttctcttcactggacaaaacccatcagaaggtgactgagtgaggatgatgtcattagaatccacactaaatgaaat

SEQ ID NO: 235988 - DNA, 1943 bp, Homo sapiens
  misc_feature (543)..(543): n is a, c, g, or t
  misc_feature (1662)..(1662): n is a, c, g, or t
  misc_feature (1777)..(1777): n is a, c, g, or t
  misc_feature (1803)..(1803): n is a, c, g, or t
aagaatagtgttccacagacatctcagagtctacacataatcaacaaactgaccctggtcttctacatcccatgcttgataatgccacatcaactcagttgtccaggccagggacctggtaatatttgaagagttctccttgttcttcagccagttgtctcaagtgccaattctacctctcaagtgtgtatctaattgtttccttccttgctactgctactactttagccattgccactccccatgagattactgcattgatatgatggggctctcctggttactaatcttaaactccttcagtcaacttccccactactctctgagtagaaagtctaaaatacagataatcatgacctcccaccatccaccaccctgaaagtcattttatgtctccttatattattgaacacaatgtctcaattcaacgtcgtacacaaagccatccataatttgaacagcatcctttctctccattctcccacatttaggttatgtcctggcccacgctaccctttcataagtctaccaacactccacatnctttcacatccccatagtttggatgtgctatttaatttgtcttctccaagcatttgtacttcctgccaaacacacatactttcttctccagaataactcatattcattcttgaagacttgattcaagttttttctcctctgggtgccttctataaaccttctttcctctgctccaatttgggaagtgctgttccctctatactctcatcaaccatagcagcctagcctacgtctattatagatttgtcgtaccttgttgtaattaactgtatgtttattaataatgatagtaatgataattttggtatctgtaggtaattgaatataaacttctgtgttaaagttgtaccggaaagccatgcttggagtccaaagcttcaaggtggctcttcttattagagacttgggggagacttggacaggaaggatgttttttggcagagctaactggcagtccccataggctgtctctggtttggacagcacccttgcgtgggcgcttggtgcttgattagatcacaccttttggtgttggccctgtcatcagactgtgggaggatcacagatagcacctcccatactgccattcaacattgccccattgtgctcaaatacaagctcatcgcctgtacttggatatgttctttcttcaaagaccccttggtccattacgtgcgctgactgccagtgggcctaccttccttctgggcaccgtaaacaatatcatttaattcttagagcaaacccattaagtgggcagcattatcatctctattttaaatgtgaaaactggccagagttgacacaatttgcctacagttatatgcctaagaagagaggttcaaacttgactttcaactctgtgtcattagtgcctcaaacagggtctggctaataggaggcactcattaaatatttacaaagttttggttaaataggaggaataagtttttaaaatcgattgcacagcatggtgacaatagttaatgtaatgtatatttcaaaattgctatgagagtggattttaaatgttcatagcacatgtaaacaacataagtaagtgaggttatggatatgttaagtagcttgatttaatcattctataatacacacatacancgcctgggtgcagtggctcatgcctgtaatcccagcactttgggaggctgaggcaggtggatcacgagatcaggagatcaagaccatcctggctaacacggtgaaaccctgtctntactaaaaatacaaaaatttagctgngcgtggtggcgggtgcctttagtcccagctactcgggaggctgaggcaggagaatggtgtgaacccgggaggcggagcttgcagtgagctgagatagtgccactgcactccagcatgggcgacagagaagtctccgtctc

SEQ ID NO: 235989 - DNA, 725 bp, Homo sapiens
taaactaggaactagtttaaaacgtctaataaataagccttcccaaactctatttggtacagaaataaagcagggaataaaacttttatggtaggttttgttactgatattttagtaatttccttaactggcatcacctatcaccttagtggcctattcaattaatttttggaagtgggtggaatataaattatgcatgaatatataaacggatcaagtttttaactggaataaatgcttttggtgacaggttaaaagatctactttaaatcagcttataatatctatttttaaaagacttcaaaacttgaaattaaatgttctcttttcacttcaatgacgatggtgtaattattcttgggattaagaagatattgtcattattaatttctatataagtgattatcaattcagagagtctacaattagatacctgctatgtgcttatcatagcaggagacacaggatgattaagaaaggctcctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgctattcacaatagcaaagacttggaaccaacccaagtgtccaacaatgatagac

SEQ ID NO: 235990 - DNA, 198 bp, Homo sapiens
taattttaaccagtgcagatttcccttacttccttaagaactcattgaggaagaagatggcattttatatagtatttttagatatttttaggttggtacgtttttcagattattaacctataagattgcctcaaatggctcttgtttgttctcatggcacagcctcatgatctgaaataattacaaatcttggcttca

SEQ ID NO: 235991 - DNA, 404 bp, Homo sapiens
atacacagcttgttgagttattattaaggtattatctttgtaataccaacaaggcaagaactagaactttgccagctactactaagccttttatgtttcccattctaattatattctcctcctgccgggcgccggtggctcacgcctgtaatcccagcactttgggaggccgaggcgggcagatcacgaggtcaagagatgaagaccatcctggccaacattgtgaaaccccgtctctatcaaaaatacaaaaattagctggccatagtggcgtgcacctgtagtcccagctactcgggaggctgaggccggagaatggcttgaacccaggagacggaggttgcagtgagccgagatcgcgcaactgcactccagcctgggcaacagggcgagactctgtctca

SEQ ID NO: 235992 - DNA, 437 bp, Homo sapiens
attgtgagcattaagtgagatgatgcattgcaaagcactttaacctagttctttaataaatgtgagatggaaagaaaaggagaagtagagaaagataaaaagttagattactctgacattgaaaaatgcaattatttgagaacagataaagtgggagaccctatttggagattttagcaaagagagcaaagatagtcatacatgttgggttgaataataatgtatctatcacactatctttcactacgtgtcatagtctatatcattctaaaattatcttgcccatttgttacttccttattgcctgtctttctccactagaatgtaaaatcctagagggatgggccgtatctgtgtcattcattactatacccccagtacctagaagaatctttggcacatagtaagtattcaataaataattgttcaatggaaga

SEQ ID NO: 235993 - DNA, 466 bp, Homo sapiens
aattttccttcttaaatattttttctttaggaatttacttgctgcaaatgtctttccagtatctcatcgttttatgttattacttttgtgcattagtctaaactgtgtacaagtatttatgtgttttccttaaaggcaattaataaagtgacaatctcttttttggttttttttttttttttctgagatcgtgccactgcactccagcctaggtgacagagcgagactcttgtctcaaaaaccaaaacaaacaaacaaacaaacaaaaaaaacagagcctgcaaacgtaaagtatgctgagatttaaataatcaataattgatacttggttatcataatccacaccaacatctctaaaccttaacctttggctctttatgcttatcatatagatataagcagaccagagcatacccattctgctaagtctagtcaaatccaataaacaaacagaacccagttaaaa

SEQ ID NO: 235994 - DNA, 426 bp, Homo sapiens
cctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaaggtaagcagtgacatccatttccgttggcacagagtagaaaagggaattaactctttcagagcttggagcacaagtctccaacttaagga

SEQ ID NO: 235995 - DNA, 493 bp, Homo sapiens
gcccagggactagctcacagtaagcactcagtaaaccatagctattgttagtctctgtctccctaaagggagtgtgagtgagcatcctggaggtgagcaccattctgtaatcacctccatttcccccaagtacctagcacagtgcttaataaataaggatgctgaataaaaatgtatgacactgaagaaaaaggaagatagaggcctggtgaatgcaatctccactgtgagggcataactgacctttaattgaatatctctggggttaagcccccaaagccacagtgcctggggcccccactgcctctgcatcctggttcccatgaggaggcagggcctcatgagaagagcacagccaggagacctaggctgcagcctcagttctgccactcagagccacatgagcctatgcaagtccctatgcctgctgtcaagtggtgacgatagtgatggtgaacactgttctaggcccacccaggtctgtcaggaagat

SEQ ID NO: 235996 - DNA, 502 bp, Homo sapiens
cagtactctctatttgatactgtcttgttctcaagaatttagaaatacaatatgaaaaatcagaacatgtaaaacttcagtcaaaatgactttgttccaggatttaggatcttgtagagatgatattagggaaaaaagtgcccagagatatttggagtatcagtgactgtgaaggtacaaatgaacactagagtgagggaggaaattgctgtgagtgcagggggaagaaagaaagaattgatctctgtccttctagacgggtagacatccatttcttgagtttagttattaaggaaggacaactataatcaatattagaggagaattaccaaggttaagtatttttatgattgtcaagtttcattacaaatcactaagcatctaaaacccaaatcatcactgtgtacagacatagtcctgtaaatactgtgacaatttctgcttaagaatattagaaaaatgatactttgacctaccagagcagactttcaattttttgaaa

SEQ ID NO: 235997 - DNA, 144 bp, Homo sapiens
gaggtaggttacgttattaccatttatctgatgaagaaatggttagagaaattaagaacactgcacaaatactagttgtatgacacaagtaatcctttctttctttctctttctttcttcttttctctcttctcttctcttctc

SEQ ID NO: 235998 - DNA, 489 bp, Homo sapiens
aatagcaaaagtaggattagatgaacacctgggatgaagcaaatccttaaaggaaaataatatgatctcaggatcttgaaaacatgtttgcaagatacatttttccttgagattaaaatcttagacttttgttatctcttccaaatgaaccatttaatcaatgagacagtttattggacaaatagatgttttccttgcactgtgccaaaaaacagatttgattgattttacaattaaattgagggaagtggctgatagtttttgcaaactcattccttgccctttattgatttttgtttaaagtttagccattgaacattacaataaagtaactaagcaagccaccttgaactgacaaaacaagggcactcactaagtgaaaacaccacacataatgataagacctgtcagagcacttatggattctgcatctgatcactggaatatgacgtctagagtactaggattaagaatctcagccttgaagtt

SEQ ID NO: 235999 - DNA, 548 bp, Homo sapiens
atggatggtgaatggatagatgaatttataagtggatacatggtaggtggtggtagaggatgtatgataggtaatggatagatggatggatggatggatggatggatgatgcacgatagatgaatggatagatggatagatgtggatgacggatggatgaatgaacgaaaggaaggaaagatagataattgatactttggatgaattcagtaaataactgctaaatgagaccacaacaagtttctgggaaagatggttttcccaggtggaagatacttcccttacagaacaattttgttatgcagtttcctttcttcttcctttctccaacaactgattgctgtgttagaataaaagtcttgggcctgaatggggcaggccttaggtggctcaaaaagttcagccaggctccttcccaggtgacttggccaaattggcagcatttgtgtctaagcaccctgcctcccagtagcctgtgtcccattccagtgggaactccgacagtccactctaatgaaggcattttcctgctgactgggatgatttcc

SEQ ID NO: 236000 - DNA, 1033 bp, Homo sapiens
tctcgttgcccaggctggagtgcagtggcacgatcttggctcattgcaacctccacctcctgggttcaagcgattctcctgcctcagcctcccaagtagctgggattacaggtgcccgccaccacatccagctaatttttgtatatttagtagagacagggtttcaccatgttggccaggctggtttcgaactcctgacctcaggtgattcgcccacctcaggctcagaaagtgctgggattacaggcgtgagccaccacatctggccccaagtccattacttttagagggattagcctaacagaagtttccagttgtctgctattgttccagctactttgaactaacttgaggggggtgtgcaggaagctgtgtgatgtgatggggcagtgtttaactggcctctgcgagggccttaagacccctttagaattaacaattgtagacagtatctcctaaatgccaggcatatgtgaagcatggtgcctggtagaaagaagaaaacagctcccccatacggcggagggggccaggggagtctgaaccaagagaaatccggtgtgcagcggaaaagtggttggttatattggggggctggaggaggtggggtctgatttgcatagggcccaggggattggtttgaccaggtgtgacattcaagtagcccgcaaaaaatctagccctcccaccttagccctttaatatgcaaacgtgagctgccatgatgtcctgaacatgtatgagttatctggaggcggtcatgacacttggcacaggtggtgacaaggagaagagggcaggaattgccatgttgggtggacctagtttctaacggttagaaaagaaatggttcaggagttgcttcttattacaggaaaatttccactgagaacctttactcctttattccttttactcctttctagttgcctaaaaagtatttctttataactcctatcttcgtaataggcagatcgtctccaacatccctaagctggtgtcaccccctttatttcacagagaaggaagagaa

SEQ ID NO: 236001 - DNA, 124 bp, Homo sapiens
tgggacttaataacgctgtgaacttttttcctccagtgaaaaccaaagcactggattaaaatcaactaattccctgatacaagatgtaaccagagtgagggtttaataaatgttcttgagatga

SEQ ID NO: 236002 - DNA, 429 bp, Homo sapiens
gagcatccgtgtaccattccggcatttggcaacaatgcaccagcattccagagtccaacagggcatgcgtgcaccattccagcatccggcaacaatgcaccagcattccagcgtccaacagagcgtgcgtgcaccattccagcatccggcaacaatgcaccagcattccagcgtccaaaagagcatccggcaacatcccggtgtccagtggcacatgtgcacctggacgttccagtgtggtgagctttcaggcacggagcaaggccaaagggataaaaagatgaaggtgacgcagtactcccccttatagtgcctacaggccttataggccagacagatctggaaataaataattcataataaaaaataattacagaataagaggcataataaccagatagaaagtattgaataaatctgtaagaaatg

SEQ ID NO: 236003 - DNA, 495 bp, Homo sapiens
  misc_feature (60)..(60): n is a, c, g, or t
  misc_feature (72)..(72): n is a, c, g, or t
agatatttaatgtaaagttttttggaatacgaaggaaattcagaaaataaatattatcancagttactattngcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaaga

SEQ ID NO: 236004 - DNA, 465 bp, Homo sapiens
gaagcaattccggcattatcaccactgttccctgtcagaaagaagcaggcatttgttccttccttcccccagaggagtatggagatggaagctcccttggggatatggtgacaaattgcgtgtagagtatagcacgcaagttgtggctgccctacttgattttcagggagtgaaagctggttgacaaacaaatgcactacaaggcctattaggtcccacgagacccccttccttcctccccagcttggatgtcgcttctatctcagcctctgttccagggagtcctgtgttgtcacctcacagtggaagcttcctagggacagggccccacctgactctaggccggacattctcaatcctgtgtacacaagaattgcctgcggagcttttaaacaaatgcagaggcttaggctcacccctggaaattctgataaaattgaactggagtggtgtccaggaaacttt

SEQ ID NO: 236005 - DNA, 413 bp, Homo sapiens
aaaaaaaaaaaaaaaaaaaaaaaaaaaaacttctaatatatttgtgcagtgtttattcatctcgaataaagcaatgacaaataatttaggaaaattttcttaatttaacagagtcagtgctgggcgctgtggctcatgcctctaatcctagcacattgggaggctgaaatgagaggattgcttaaggccagatgagaggattgttcaagaccagcctaggcaacaaagcaagaccccatctgtacagaagatgaacaacttggctgggcaccgtggcaaatgcctgtgcttgtagctactctggaggctgaggcaggaggattgcttgagcccaggagtttgaggttgcagtaagccatgatcgctataatacactccaacctgagtgacggagcaaggtcttgtcttaggga

SEQ ID NO: 236006 - DNA, 113 bp, Homo sapiens
aaggctttaggttatatccaactcccagccttaagtgtcagccacagttgctagtcaggaaaggatattttacatattttcagaccctactttccctgcttcaccttcccatt

SEQ ID NO: 236007 - DNA, 385 bp, Homo sapiens
tcaatgtcttgaaaaatcatacagaatctctacaagtcttggctttgccttaataatagtcagtacactggccaacgatggcaccaagattaaaggaggaggtgagtctggaaacacatgaacttgaccttctacaatcgatttcctgtgagggagactctggacatgggcaaagctttaagccaaagatctgtgatgctcaaggctcatccaggcattggcagtgtattcaatgtataaaaaaaattcttttatttccaatgacctgttttatgttaattttattgtgatgtagaaaaataactagtgtgtccttcaacttacttgccaaaacctactcttttaaatattttctcaggagaaaagtcattttaattttaactta

SEQ ID NO: 236008 - DNA, 635 bp, Homo sapiens
atttacatcaattttagtgagaaaaaatataattcctttccacccaacctaacctttcgaccctatttttctctattttcatggagaaaaatagaatgacaataaaaccaagctcatataaacaataaaaaacaatttgaaggaaaataaagtcagtttttcctaaatgaaataaatgtaataatgcagtgaagccttagtggactcactaggaaggaagagagtgtgagttgtgtggtgaaggaaaggcacagggagtcatttatagaaagtggagggagtacagcagttaactttcagccaagggagcagtatctcataccaagtggagtgggctgccatgaaggatggcagaacctttcattccttttccttcttcagtcctcttttatcacaacccatcttttatttcatgcttaaagtttttcccgcttttctttctataacatttactttttcactttttgagacaattgggggcttgggattatctttaattcaattcataaagttgcaacacagaatgtttaaggcacagaacacaagaacacttggaaacagtgcatgcacgtaaaatgccagtcatagaaattgctgtctttatccctcttggtcttggaaaatgtcttgggttc

SEQ ID NO: 236009 - DNA, 607 bp, Homo sapiens
gcctcacatgaggctcaacagctgaagcgatcgtgccacctcaaaactcccaagtagagtcagtagctggtactacaggcgtgcatcaccaccatacccagataatttttgtatttttagtacagataggagtttgccatattgtccaggctggtctcaaactcctaggctcaggtgatccaaccacatcagactcccaaagtgcagggattacaggaatgagccactgtgcccagcctgttaaccatcctctgtaagcagttaactttcagccaagggagcagtatctcataccaagtggagtgggctgccatgaaggatggcagaacctttcattccttttccttcttcagtcctcttttatcacaacccatcttttatttcatgcttaaagtttttcccgcttttctttctataacatttactttttcactttttgagacaattgggggcttgggattatctttaattcaattcataaagttgcaacacagaatgtttaaggcacagaacacaagaacacttggaaacagtgcatgcacgtaaaatgccagtcatagaaattgctgtctttatccctcttggtcttggaaaatgtcttgggttc

SEQ ID NO: 236010 - DNA, 1830 bp, Homo sapiens
ctagagagaggacatttcctgagtaaaatgaaaatcaaagctaggagctaatcatatttttaaagtcagatatgttgggggtataactggaagctaatttttaaaagaatcctgccatatctttgataaggaagttctatggcttaaagagtgtaaccactagttttagcagagatgtttcctttagttttgaaacattcttcaacatttcaggttcatgatgaaaaatggctgactggatttaagtcctttattttctatactcctgagcaaaattctgaaaaactggctggtctagtttagagaagaacgctgatgtgggagtattttcaccatgcattcctgctctaaatcctttgcttctactgatagactattctactttcgaaataagttcacattgctctaacacttcataagttcaatctttttctcattctgtttaaaataaccaccatgaccaccaaacgcctgaaattcactgtagttaaaattatgactgaaatagacagggaaaacctgagagtgaacgttacccagcaaatctgggttaaacaggttcgagtttttccagagcacactgtttaggatttcagcttcctgttcaaccatctcggaaacagggtgtttctctgctcctttgtgaggactaaccatgtgtccccgccactttgcaccaaagctgaatatcatcccaaactctggatccttctgacgggcatttgtgtggtacacaggaaggggtgcattatgaatatgcaattactggcatgtaatgctgtcttctgctaaaaatacaaaaagggtactctgatctcagagttgggagctgatttctgatttcagcctagacaggtctgcttaaaactataatcaagctgattgtattgccctggaattctaatttccaatttagggttttgctatataatctctagtagagtgtgtctaatctttatgaaacccagagtctttgtataaactctatggattttcttccatgcgtctaggctgagctgagctgtgtctttaggctgagctgtagagacattaaattactgagtaaatgaaggtaacgttgttatgtcactctgtttctgaaagaccaactcaaattctgtctgctgtagctttgatccttttcatttaattctaagtacacttgttattatagtaactgttgtttgtatgttattttagctttttacttaagtagctatttagcaatttaaatgaaaatgtaattaggttacatctgttttacatgcatgtaataccacgcagatgtaaacttctattaaagccatattttctttttggcaagaaaaggcagaaacaaaatcgtgccagtcgctggaatacgtcttgctctaaaaaaattaaaaaaaaggatatacagagcactgtgccattatttatatggtggttagagtacatcacttctattttttgaaaattaaaaaaaatattaacaagtgaaaaacaagcattctattccatgttccctcttacagtttatctggatacggtgtttaaaatgacaatacagccaggcgcggtggctcacgcctgtaatcccagcactttgggaggccgagacaggtggatcacctgaggtcagaagttcaagatcagcctagccaatgtggaaaaaccccatctctactaaaactacaaaaaattagctgggcatggtggcatgcgcctgtaatcccagctactcgggaggctgaggcaggaaaattgcttgaacccaggaggcggatgttacagtgaaccgagattgcgccactgcactcaagcctgggccacagagaaagactctgtctc

SEQ ID NO: 236011 - DNA, 449 bp, Homo sapiens
cactagtttcccttcaaaatacttaaaggcttcctataactttcagagtagactatctagctaaaagcctttagcaagtaaatccatgtctgatcttggcagaggtgaatgctatccaatcagacttttcaatgtataagtctcaggaaaatgataaacaatgatttgagtgtgggtcagaaacaactgcaggaaacaacctattttattggaagctataattaaatctaaatttcaaaccctggttaatcactatatcaccacattagatgggtcctgataaagaagtgatcattttcatttttcagatgactgcttgttctctgggagagaaatttctaagaataatgcacatctacctgaatgtttccattgatttatttgtgcattactgatacgtcaggaaacaatgatttttctttcgaaatgttttctcagtaaggtgtggt

SEQ ID NO: 236012 - DNA, 5041 bp, Homo sapiens
  misc_feature (936)..(936): n is a, c, g, or t
  misc_feature (1011)..(1011): n is a, c, g, or t
  misc_feature (1076)..(1076): n is a, c, g, or t
  misc_feature (1114)..(1114): n is a, c, g, or t
  misc_feature (1222)..(1222): n is a, c, g, or t
  misc_feature (1319)..(1319): n is a, c, g, or t
  misc_feature (1816)..(1816): n is a, c, g, or t
  misc_feature (2629)..(2629): n is a, c, g, or t
  misc_feature (3506)..(3506): n is a, c, g, or t
  misc_feature (3585)..(3585): n is a, c, g, or t
  misc_feature (3879)..(3879): n is a, c, g, or t
  misc_feature (4129)..(4129): n is a, c, g, or t
  misc_feature (4146)..(4146): n is a, c, g, or t
  misc_feature (4385)..(4385): n is a, c, g, or t
  misc_feature (4446)..(4446): n is a, c, g, or t
  misc_feature (4661)..(4661): n is a, c, g, or t
agataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattnattcaacagatacttattaagtgggccaggtactacttgttaatacaaatggtgaataaagtggcttacactctnatgagagagacagacagctccgagttaacaaatggataaaaatatacttacatatgtgatatgcntagtgtaagataacgagggtggtcacggtggtggtaanctactccaaatactgtactcagagcatatgtgtgataaatgaagttgttgcagtatgtttaaaacactggagccaaaattttgagtgctcatttgaaaacactttatngtaaaacagtggtgcttagaatgatgcattaaaaaatatatatgactatcttgctgaaggtaaactttttttacaacttacctgacatgatctttcnaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacncaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctncttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctanccaagggaagccaagagggaccctgccatgagggacagtgctatcaggaccagatactacgcttttcccacagtcttcncaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgaccngggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagancacctgcaggaaggggnggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagnggaaggaatacacagcaatctttgctgttctgcagcctctgctggtgatacccaggcaaanagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattncaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaacacagcccaagaatttcatgaagcatacacaagtatcaatagctgaattgatcaagtgaaagaaaggatatcagagattgaagatcaacttaatgaaataaagcatgaagacaagattagag

SEQ ID NO: 236013 - DNA, 324 bp, Homo sapiens
cagactgaagagtgttactctgaaggccacgggcagctcctgaaagattgtactaagatatgtgtccaccctatatttgtccctttagtcttggcttggggcatgatctctagccaaagggtagttaccacaccaccttttcagggtaattggtagagctaatgttggttgaggatctatttgaatagcacatacttgaagacccaaaagaaatagtcttgtgagccaccacgtccagtcagcctccattcatttctttgtccagccagcagatctgtacagaaagtctgctcaatgccaggtggtgttctatagactcggaat

SEQ ID NO: 236014 - DNA, 378 bp, Homo sapiens
acttcggcctcccaaagtactgggattacaggctgagccaccacacccggctgcatttatattcattgaggtagttttcttgtgatgacagtattagcctgcttttggtattggggtaatactgacctcatacagtgaatcaggaggtgttccttagaagtggtcttctattttttggaagagttagtgaagttttggtattacttctatctgggcctgggcttttctttgtaggaaaatttaaaattactaattaagtctctttacttgttataggtgtattcagattttctgtttcttcttgagttcatttcagtagcttttattattaatccccatcacatccctttctgtttctgtaaggctggtcaacagtgt

SEQ ID NO: 236015 - DNA, 1784 bp, Homo sapiens
  misc_feature (894)..(894): n is a, c, g, or t
  misc_feature (1020)..(1020): n is a, c, g, or t
  misc_feature (1022)..(1022): n is a, c, g, or t
  misc_feature (1299)..(1299): n is a, c, g, or t
taagtagcatgaaatctaaggaagacaggtaaaccagcagcactggcctaccaagaggagggtatgggagctgtggggtgtggggagacggggtagccacacaaatgggtagaaagaactcggctaacactttaagcaaattgctaaggccaaggatgggatcctgcaacccttggaagccactgactttataaagagatttacacccacttgcaggctgttctgcacaagcctccatcagcccctcacaacgaagtctgggggcaagtgggagacttgaggaaaccaccgtcagtggtgcaggccctgagggaaaactgttaggggaagctccaagctccacccagaccttctcccctataggaaagaaacaaaacatcttaagctcctctggaaaagggcaacaagccatgttatcccagggcacaggggaagtggaagaaaacaggaaaaatcctctatgcctagaggagtagcaagaaatgatcctgagtccagatcatccgcactttcctgctactggaaaaggggcaggatatttgagaaagccccaccccaaagcagtgcctgcccaaaactgaggctagactaggacaagaatcaaacccacccaacctccactgccaggctagcaatcacccagttacgaaaactgatctacgtgtgggtgaaggcatgagcctagaaagagaccctttcagagacacaaaagcacagcagcttgaagttgaaggtagattaggaacataaacaaaaaccccagtccacttagcccacagcagattatgccaggggaatttgaacctggtagtacactgaaggttaaccacagcagcagcaaaaccagctcaactcctggctgggttaactcaaacccccacactgatggtctancagaataagagctatgcccatttctaggcataaacatttacctgtctgtactattgttttgtattcttttataatatggcccgtcaagtgtagccacaagaggagacacacagaaaggatgggggngngtgggacaagaccaaagtgaattatattcacaggacctagagacaggaggcacatcattccatgcagggtcacagtaaagacaccaggtggtcaggaggcaaaagacaggagcaagaggaacacactaggccagagcctttattggggtttccatgggaaaggcaaggcagggcagggtgaacagcttagaactggcttgtttgaataatttcagagagacttaaactataggagcggcgcctagttgcctggtacctggccctgggatgactaagncagaggaatattgtctcctgtggtgtacaggcctgctagaggcggcatggagtctctggattggtcagtttgcagatcaagggcatactcctggctgagcccttgctatgcataagacttggctaaccccaggaggggcagtcattccccagctagaaaggttctttttcatttagttttgtttttaagatgtcaaaacatcataatataccgaacattaaaaagaacactcacagctagctgggtgtggtggctcacatctataattccagcactttgggaagccaaggcaggctgatgccttgagcccaggagttcaactccatctctgcaaaaattagccagccatggtggtgtgtgcctatggtcccagctacttggaaggctgaggtgggaggattgcttgagcctgggaggtggaggttgtggtggccgagatcacggcattgcactccatcctgggcaacagactgagaccctgtctc

SEQ ID NO: 236016 - DNA, 598 bp, Homo sapiens
attttggagcattaagatttaatgactgccccgctgggtttcagacttccatgggacctgtaactcctttcttttggccaaattctcccttttggaataagaatgtttacccaatttctgtaccctcattttatcttggaagtaagtaacttgttttgattttatgggctcataggttgaaagaactgatctccagatgagactttggacttggacttcagacattttagttaatgctgaaatgagttaagactttgggtgactattgagaaggcatgattgtattttgcagtgtgagaaggacatgagatttgaggagccaggggcagagtaatatagtttggatgttgtttcctccaaatcttgtgctgaattgtagtttccagtgttggaggtaggacacggtgggagatgtttggatcatggagatgggtccttcttggcttgtggctgtccttgagatagtgagtgggtacttgcaagatctggttggttggcagtgtgtggcacatcttcaaagcttgctcctgctctcaccatgtgagacacctgctcaccctttgccttccaccatgattggaagcttcctaaggcctcc

SEQ ID NO: 236017 - DNA, 372 bp, Homo sapiens
ctcccggccttgagtaaagtttaaaaagtatacttagggtgggtatttatccctccatgaaagcgccttttactcagccagcacagagccatccctttgcccttccagatgcctgactgggaccttgcttatggatgtgtgagcttttaatctctggctgtaatcttacccacttcaacctaaacttggaatgattactcttgaccctttttttgagtgataaggcaaatctccccacacctgggcattttaaagttatatactgtatgtttaaatatcccccttaaaaagcctgagctatataacaatctagatgtgtctatcttactcttttcccacaaactaagaatccaaataatgttaaaaatcttt

SEQ ID NO: 236018 - DNA, 506 bp, Homo sapiens
ttttcatgaggatctctaaactagataaacagttgtaagaattaaagcagaataatgggaagagtctggattttggagtgagccagacctggattccaaccccaccttggccactcgctacccatgtgttctgggcctcagttccctcatctgtcaaagtggagtaatggcaatggtggtggtggtgctggtgaacaattactgcatgcttaccacatactgcaggcgccattctaaaggcttccacgtcgtaactcatctaatcctctcaataactctaaggaaggttgggtatcacctgcatttcactgctgaggaactaaggcacagagcagaagtaatttcacaaggccatagaactggtggggctgggatggggctgggatgtggcaaccacatgcaatgtttttgcttggaccccaagttctgtctaaatctttcatcacaatagtttggactaaatcactcattccaatgataaatattctcaaatgtccttatctcct

SEQ ID NO: 236019 - DNA, 696 bp, Homo sapiens
gccgagatcacatcattgcactccagcctgggcaacaagagtgacattcggtctcaaaaaaagtaaaataaaataaaaataataaaaccacaacttccttttaaaaaggtggattctgtgaaaggacgtttctcagaggatccttttctttagctgaggacctttatgagtttgaaatctgaaaagccaagcctggagtgagttgggaggagagttagagaaaatttaataggtttgcttaagagaggtgagaatctggaattcttggggtagtccaggaatgggaggctgaggaggagagatgggagagaacaaagggaaagaggagaaagcaaaatatggagaggtcaaggttctaggtgaagtaatatgcccatgatgcagtggctaaaatgattcaagaaagagaggtacattattttagttggaaccctaggttctttgcaaaatctctattccagtgttaacgtattcacttgtttttaattttcagggtcttttctttacaattgtaattagcttcaccatcatagtaactataattatttaaatctaagtataaattagatttcagtattcagcactgttctatattacatgactttgattttcttcaattctgtatgttaatttggcttagctggagtatttcctcaaatgattattatcttttcagaaaagctaaattagggtact

SEQ ID NO: 236020 - DNA, 347 bp, Homo sapiens
tcatgtgtagggtgttaaagaaagtgaatagttaaggatactgtcaaagttcttggtctgagcgtctaggaggctgtagctgcctcatgtattgaaatgagtaagactgtgagaggagcaggtttaagagtaagactgtgagaggagcaggtttaaaatggagtagatctcagagtacagttttgttctcaagtttcagatgctaatgagacatccaagtagagatatcaagtaggtatcttgaaatgagtctggagttcagatttgggagttacaggcttatagatgatgtttgaagccataagaatggctgagaagaccagggagggagtacagtacgctgggtc

SEQ ID NO: 236021 - DNA, 387 bp, Homo sapiens
agcctgtgcaacctttacgtgcccaagtgtgtgaccccagtcctgtgcctttactgggtatggctccagggcccctcttgggtgatccagggcctctgggtctctgccagatgggctccacatccttgcctgtgtctttgtgtgagcccccctcgcctttctgtggtccacgtggctctgtatcattgtctaactatattccccagcctctgtttggagttccctccctgggtccaccctgaggttaagccttgagtaatggaaacagcacttgagttagagctctgggctggtacatcttgactgcatgatcttgccacagtttattcaatctctgaggctcattttttcacctgaacaatgggtgtaataaagcatacctcccta

SEQ ID NO: 236022 - DNA, 412 bp, Homo sapiens
gaggtgcttccgcctctgcatctgaaaaccttgacacccagcaagtcctgctgtctgagctcacccacttgtgccgctgctgtggtagaaagcaggggctctggttccttcctaatgggggactggggccctgagagaggagcaaacttagatctataatgggcaaggatagggcacagtctgaatgccttgataacaggcattgtgaggcaaggaagaatgttctaatcgagctgtctgcagacaaggggcttgctccatgttgctggagttccttcaagcagaaggtgggccagacacagtggctcatgcctgtaatcccagcactttgggaggcctcggtgggtggatcacttgaggccaggagtttgccagcctggccaacatggtgaaaccccgtttctaccaaaac

SEQ ID NO: 236023 - DNA, 449 bp, Homo sapiens
ggaggcgcatctgaaaaaggagagacgcatactctattcctttcaaatttgcaaattagattaagtccccctcctttctaatagtgcagtgaaggaaggtatagagagaagctggaagagtccattttgtagatttccctcctagaaatggactgcaaatttcttttccgttgtggaaacacaagtcaagtgaaatcagtgcctcttcactctaatccacaatagccactattatgaactccattttacagataaggaagcaaggactttgacatcaaacctccacagtcagatgcataaaaagtgaaggatagagactttgaatgtaggtcatactgactccagagtctatgcttttaaggctccctagagtgcctctttgcatatttgataaaaggtgcaggtgaatgagggattttggctgacatctagacttacaagaactactt

SEQ ID NO: 236024 - DNA, 424 bp, Homo sapiens
agtagagacgaggttttgccatgttggccaggctggtcttgaactcctgaccttagatgatccacccccccctaagcctcctaaagtgctgggattagaggtgtgagccactgcgctcagccttaatttttatattatttgtagagatggggttttgccatgttggtcaggctggtcttgaactcctggactcaagggatctacctgccttggcctcccaaagtgctgagattacaggtgtgagccactgtatcctaccactcagtgcattttagctatcattatcacccctcagtaggatcgaaattgttatgtgtgtttcaggatgcgctcctggagggtacccttggccccatcttaatccttggactaggcttgaaaatatggggtgagaatcgtaataaaatgatattgaagacttatc

SEQ ID NO: 236025 - DNA, 479 bp, Homo sapiens
ccaagttaagcactcctgctttggagcaatattactaacatctgcagtagttggctattgttacaggttgaattatgccacccaaaaaggttatactgatgtcctaacccctgctatctgagaatgtgattttattttgaaatagggtttgtacagaggtaatcaaattaaaatcaagtcagtagggtgggctctaatccactactagtggtgtccccataaaaaggggaaattatggacacagagacagacatgcacagagggaagacaatctgaagacacacagggagaagactgccatgtatctacaagccaaggagtgccaacaattgctggtaaacaccaaacactagaagaggcaaggaaggactctcctttacagttgtcagaaagaacatagcccagccgacacctgattccagacttctatagtttccagaactatgtgatattaaatatctgttgttttaagccacaca

SEQ ID NO: 236026 - DNA, 366 bp, Homo sapiens
ccaaggtctctgaaaatgagttttagttactctattatctaagtatctttcttactgatatgtaacttacctggctgaacaattacattttagagctccaaataaattttcagcctattatgtcattgtccaattacaagcctcattgtaatagccatgttaaaaacaataaagccggtgaaattgatttcagtgtatttcaaattaacctaatatattcgaaatattatgtattgtgtatgtgtggatttgtactagccactggttgagagctctgtagccacacatggcaagtgggtaccatattgcttagcccaggcctagtagaagattaagactcagtcagaggaagtaaggcagatccgt

SEQ ID NO: 236027 - DNA, 478 bp, Homo sapiens
gctgggattgtcctgcagctgcattcttctgggggtcagctggggctggaagcttcctgtggtctagtcacacagctggggtctcagctagggtgatagaacactgggggcaggccggccttgctgtctctctctggcttctcatcattcagtggtctagcctgagttttttacatggcagctcaggagggtcaatgtggacgctatacagcctgtaaggcccgggtttggaagtccaagaatatgacttctaccatgttctactggtgaatataaattccaaggccagcctagattcaagggataagaacgtagatttcactccttgatgggaggatcccatgtacagacagggatccttatgagggattatgagaactcctaatccttatgagggattatcatacagagaatttatgggggattatctttggaaataatctaccatagactgaataaatgataatgtaatgtgatg

SEQ ID NO: 236028 - DNA, 1182 bp, Homo sapiens
agggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatgcacctagagctgcattccatgtattccttggcttttcgtcctttcctccatcatcaagtaactggatctgtgagcatgatgaactttgttttcctgagcttgtcctgtgtctcctcttctggccacacctgactgagcagaacataaaagcgacagaacaccaggagggctgctgcttggggaaattgtgtgagaagagtcctgggggactaggggcagggcaagcactgctctccctctcctggaggctggggagagcatcaaggagactaccaggtaggaggaaccatgggcagggcctccctcatcaggatgctttccccacaacagagggatttaagcccctggtgggtgagtcctggattaaccaagacctgagccttttggggggtgcagaggacagaggacactgtgaggtgagtttctcctgggtggattccccaggggcctctgaggctggtttcaggccctgccctttggctgccccactggaagctctgagcatctacccttcagggacgctttccctggtctgaccttggcaagggcaaataagaggtactccatggagggtcaccaaggtctggggcgtaaacggtgcccatctgcacagtagcatgagggccacagagtgtggtaaatgtcagtgaccatcacatgcggtccccagtgtggctgcaggggccacttaggattcttctgttcggggtcccaggccacacttggggaaccctattggaagcaacaaggtctaggccctgagggcccagggctctgccctctccagggctctagctgagccacgtgcaagcatcctcccggccctcccagctggtgtgaggaggaaaccacagccaaagggcaaggtgctccacacagatatgtccctagtcagcctgccccattcggcctctggagtgggagccttgggtctgtctggaaccagtgtggatgaaatgcagggagaaactggaatcatagccatggacagccactcacatagctgggaaga

SEQ ID NO: 236029 - DNA, 577 bp, Homo sapiens
agggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatgcacctagagctgcattccatgtattccttggcttttcgtcctttcctccatcatcaagtaactgaaagtcttgctctctcacctaggctggagtgcagcggcgcgatctcagctcattgcaacctctgcctcccaggttcaagggattcttgtgcctcagcctcccaagtagctgggattacagggaccatatgagatttatggatgtggccatagaattctctgaggagagagtggcaatgacctggacactggacagcacgaactacctcataggaactgtgaatgtgaagagaacctaacacgcaaagcctgggcacgccatggagtgcacggcatagctgaactcctacgcacagaccacactcaccctgactggacgcacggccacacgcgccccggacacc

SEQ ID NO: 236030 - DNA, 448 bp, Homo sapiens
agccattttaaagccaattaactctgttcctgttcacacccttattaaaaatataattacagcagtagtctccagggactgtcattgggtaggctttaccaaggtaaattagccaagaaataactaggctgtgtaacaccctctcagaccctggaaatcattttggttgcagaagctacttagtatcagagtaggctggggtactcataaatttggatttggaaaaagccaattccaagtcatcctaaatgtggaagaatctgtgattttgagaatgattctggaatcagttatccagggtccagccaagtctgatacaccgatcctcagaaggttgtattaataacaaaaagaaaccaggtttttgtattagatttgatggaagaggctgggggacagaaggtgatgtagcattttgttttctggggtgctgagattgtgggattag

SEQ ID NO: 236031 - DNA, 515 bp, Homo sapiens
aagctcagaagtgggaggaatacaggccttgattagtgaatttcaagctcagttctcggggtgaaggacaaggttaattctactgtaaataatcctaccattcagaaaagctggtgtgtccaaggaagaaaaaacaggctgtgactacaaacctaaaagtaaaggcaaacaactgccagacagaggcaggaaaacggggaagagcccttggtaaatattgcatgcctcctggggaccccatgggctttgactcaagggggagatgaagggaatttgttaaagaaagaagtcactgagacagacaaaagcttccggcacaggaagttagttcgactaaggataccgaaatgtaggaatttgaatgggttcctgggtgtgaggttgaagtgaaacttgattgaaaagaagctgctggtggtgagtctctccttaagctattcctggcttctgggtagttggtgtaaactctgtggtccttgaataaagtgtccttgagaaatttagaaggttaaaca

SEQ ID NO: 236032 - DNA, 245 bp, Homo sapiens
aaagagctggagataaagtgtgcatagtattgtagggagcaacacctgagtgctgctcaaaggactggaggagcctagcaggaatgctggcagtggtgacttggattggaggttggggcttagggttgaattatagtggctgaaagtgagacagtctaatgggtagatacaaattgtgttcaaagaaggaaacaggagaagtatcatattaagcagtaggtctgatagggtgagcccaaggttgt

SEQ ID NO: 236033 - DNA, 351 bp, Homo sapiens
gagacagagtttcgctcttgtcacccaggctggagtgcagtggcgtgatcccagctcactgcaacctctgccttccaggttcaagcgattttcctgcttcagcctcccaagtagctgggattacaatgcatgccaccatgcctggctaatttttgtatttttagtcgagacggggtttcgccattttggccaggctagtcttgaactcctgacctcaggagatccatccgcctcggcctcccaaagtgctgggattacaggcatgagccaccgcacctggccctaattctgtcatttcttctatattcgttagctaacatcctgtaaagaagacattttcttttttactct

SEQ ID NO: 236034 - DNA, 417 bp, Homo sapiens
gactagctatattttagagagtttgttaaatgcagtaaggtttttcatttattcaagaaaactttagaaattgaggacaatattttttatgtcttttagtatttctgtgtacagtagaattatttgaaaaaataggccaggcatggtggcttctgcctgtaatcccagcactttgggaggcccagctgggcagatcatgaggtctgagcattgagaccagcctgaccaacgtagcgaaacaccatctctagtaaagatacaaaaattagctgggcgtggtggcgtgtgcctgtaatcccagttactcaggaggctgaggcaggagaattgcttgaacccaggaggtgaggttgcagtgggctgagatcgccccattgcactccagcctgggtgacagagcgagagtctgtctccaaa

SEQ ID NO: 236035 - DNA, 236 bp, Homo sapiens
aattcagggagatgaggtctcagtcacacattgagtctcctttccagtggcccttatggctgagggagacagtgtcccctgggctgcaccagttggaagagaaggcggagttttcacagccctggttagaagtgggagggaagaggtcaggtcctcaagaggaagaggaagcaaaaaaagaaagaaggaactgacagaactgagatagggctgggcaagagggagaaaggagatga

SEQ ID NO: 236036 - DNA, 248 bp, Homo sapiens
tgccccagagaattctgggaaagtaaagtctgatatcctagctaggctgtgccgtatttgacggcagcccaactggggcagtggccaggctctgtaaccactctcaccacgcctgtgcaccagcttccaagctgggagagaagcacagacaccaccaaatgtacttgcaatgttgttgttgttgttgtttttaagcaggtgagaattatgcaatatatcacgataaagcagatgaatgaggcattctt

SEQ ID NO: 236037 - DNA, 709 bp, Homo sapiens
aaaatacatatgccgaattttgtctgttccaatttattgcacttcaaagaattcactaaccattgtttctctgagatgttcctctgggagtgatccacatctaataacgtcttggagtcagcttggaaagtttgcaaacatgaatcaaactgaagtgcttttggatagcgtttgaggaaagccagggcgactgtatgctggaaaggaatctcaggagtgagctgtccagttgttgatcttccagcgaggcttagcttgcccgtgggtctcctcttttcactttccttccttcttgggaactgacaagagttttgcaaaaagcctggttgtcatggtgctatagaattacagcattgttaaggtaaaccagattttgctgtataaaatcagcagataccataacttgcccaagtgtaattttttttcctggtcctttatctttcttccttacgttttggtataccagcaaagagaagtctgaaaccatctagacaaaataaagcatgaaatacgtagccatatgcaactgtgcatgttctgagaattattgtataaatttcaggttttcacattcagttcactttactggttacaagttaagaattgagttgttccatattgggtttgtatgattgcttttgctcacaaaaataaagctaatgtgtaagtcttaacagcttttttaaaaatgagactacccattaaatca

SEQ ID NO: 236038 - DNA, 1054 bp, Homo sapiens
gtactaactaaagaatctgtgagaccgggcacggtggctcacgcctgtaatcccagctacttgttagactaaagcaggagaactgcttgaacccgggaggcagaggttgcagtgagccaagatcgcaccattgcactctagcctgggcgacagagcaagactctgtcaaaaacaaaaaaaaaaatctgtgaggctcaaacatgggggtgaggggtgagaatagggcaccaaaaggactgacatctaaataatctgtcagtgacaaaatggcttccaactaattaaacatagaaaaacctcttttagggaagataatcctattggatctgcttgcaagatttttccagccagcttctgcctcttggagcttcaattaaaagctgtttagcagatggcaaattctgagttacaaagttagactctttggcaacgatatgtgcttttgctttcccaggggatcctggccacatatggccctggaagaggcgcgagagctctttcttggcacacagtagagagctcctctcccagcttaacacacagatgacaggcatttcaacataaccatcaagggtggtgagcaagaggggagttttcagttaattcagaaatatgggggccctggaaatcataatatatcagggctggaagggaactcaaacagcgtctactacaaccccttcttcatacagaacgagggcactgagccttggaagaggttatgcaatttatctaaagttgcccagcaagggagaagcagagtcgggatcaggcttgtgcttatttaccatagaagcacttctctattcacttggaggactgtgttcattgcctgaccctttccttataatcacgaggctcctgaagagatattttaccaatgacctgacaaatttgccagaaggccttgaaagggtcattcatcctcatgtccacctcctgctttattgcaggacaaaaccaggaccctctgaaatggaacttcatcactcttctcttcaaagctttctactacagttgaagtcacagtttctcttgggtgctgtcaaagaga

SEQ ID NO: 236039 - DNA, 125 bp, Homo sapiens
gcttcttaaatcccctaaagtcttcaacccaatttctttcttaaatggcttttatgctcttttcaaatactcctcttttgttctctctttactgtattttattatgctccacatcttgtttctgt

SEQ ID NO: 236040 - DNA, 447 bp, Homo sapiens
caattatcaaatgaactttaaaaaagtatgttaacataaaatatattaattacctaggaattaatttattgagagatacacaaaataactatacaaaaaaaataaaaaaacaaattaaagaccaaaatagatgaaaggatataccatattcatggaatataagattcaatatttttaaaatatcagtttcccctaatttgctctatagattcggtgcaattctattcaaaatttcaccagaaatttttgtgaagattgacaaactgattttaaatttttggggggaatttagaggaccaagtatagagaagacaatcttgatgaaaaataaaattaaatgacttctactactaaatatgaagacattacactactaaacattaagacattataaagcttcagtaattaaacaatgtgatattatttaaacaaataaaccattggaat

SEQ ID NO: 236041 - DNA, 320 bp, Homo sapiens
ggactaatgaacaggttccatactatccttcaaatgtgaccaaagttttctgcaaaacgtcttataaatctttttttaaacgttttattcttagatatctcatatttgggttgctagtataaatgtgtatacataagcttttccattgtttagttaggaaaattttactttgaaacttttatcaatgacaacaatatcaaggaagacttattagaaatgagaaaattttaagtcagtgcttctcaaactatattaaagggtctgtttttgtgtaaataggagtgagtttttagaaaaaagtaaaaaagggccgggcacag

SEQ ID NO: 236042 - DNA, 371 bp, Homo sapiens
aggagacatgagactcacagcagatctctctggcttaacatgggagatggcgactttataaagtgctccagttcttatggtgttttctgaccaggatctgtaccaagcagatgaacatgccaagatgtcttcgttctccctggctgcacatcctcctgtagtcttcatgccggccttcgtttgacctgtttttgggaagttctgccttttccttctattttaatctacactctgttgccaccattacatatccatgcatgtagagttgatggtagtatactaaaactttttagaagagaagatatgaaaacccaaatggagtgaatagctaaccagaagacatatattaaataagcaaaattcccaactat

SEQ ID NO: 236043 - DNA, 391 bp, Homo sapiens
gacaagagtgaaactctgtctcaaaaaaataaattaaaaaaaagactcaagtgtcatgtctgaaaataagagtttctcaccatgttttttcagtcattcaagtaacgccttctaaataagtttttggtccggtcatggtagctcacgcctgtaatcccagcactttgagaggttgaggctggcggatcacatgagttcgagaccagcctgaccaacatggtgaaaccccatctttactaaaaatacaacaaaaattaggcgggtctggtggtatacacctgtagtcccaagtactctggaagcaggagaatcatttgaacccaggaggtggaggttgcagtgagctgagatcacaccactgcactccagcctgggtaacagagcaagactt

SEQ ID NO: 236044 - DNA, 363 bp, Homo sapiens
ttagacaatgagacagcagaatgaaagtggctatttaaaggtctgtatatcagaatttgagagaattgttttgagactaacgggtgtatatattagtcctcacgctgctatgaagaaatacccgagactgggtaatttataaaggaaagaggtttaattgactcacagtttcacatggttaggaaggcctcaggaaacttaacagtcatggcagaaggggaagaaaatatgtcttccttcacaaggcagcaggcgagagaagaatgagaactgagtgaagggagaagccccttataaaaccatcagatctcagtgataacgtactatcacaaaaataggatgggggaaaccacctcccaattc

SEQ ID NO: 236045 - DNA, 449 bp, Homo sapiens
aaggtaacacctgtagagagttttttgtgagtctgagcaggcccccagggaagtcctggaggaccgtagcatcccagtttggccctcagcccactgtttgttttgcccagttctcagtctctcagctttggaaatgttaggaagagaaaggagaagcaaggcggccagagtgctgcggagctgggaggggcgtttgacagacagcgcagggtggggcgtcagggatgccgtggacagaggagcttggggaaaagagaaggggcacttaagcgaagttttcagaagccttgatgggccttgtgtggtgcaacaccctcctccatctctaaaggaaaacagcagtaaaatctatgtgattgagacactgggttctggcaatatggtggacctgaacatatatactccttatatgtatatttcataataaagaaaatactttttaaaatcca

SEQ ID NO: 236046 - DNA, 286 bp, Homo sapiens
ttcaattcaagcagtatctatggatctgcctgcactgaaggtaagcaacatggcaccatctttctaacctacccctacaacaccatatttctgttaagtgtattattattttttcattatcaagattcataaatttactctgtcctgtagccataattctcagctttgctttttctttaagccattgaatgtgtttaatgaccaaccttccacttccgggtttttaatttttcacttaacaattggcttgctgggttttgttgttggatggctttttcaaaaataa

SEQ ID NO: 236047 - DNA, 327 bp, Homo sapiens
tgactcctaacccctaactctgaccccaacccctatctccaacccctaaccctaaacttaacccctaacaccaaccttaagcctaggttcgttactacgtttgtattgactatgtcaatgttgattattatgatcgctgtcttaggactgcacggcagcgaggggattgtgcatcttatattaatgtttttgtgtcgaggcagtgcattagcactacaggtgcttgttacatgagcaaggggggtgtcatcttttgagtgccatgtctgcattaggaatgctgcatttgtcttccgaggctgcggtgtggatctcgcactgcggccg

SEQ ID NO: 236048 - DNA, 1508 bp, Homo sapiens
ggagaaggtggtgagggagggaggggtggagggaagaagggaggaaaggaggggagagagagtcatttgtatatctttagagaaatatctattcagatcctttgcccatttataaaattatttgtagagatgggatctcatcatgttgcccaggctggtatcaatcctcccctgccacagactcccaaagtgctgggattacaggtgtgagccactgtgcccagtcaacaggattaatgacaagttaatctttaaagccgtttgtactaaaggtacaggaggacagatatgatgtttgtgatgatgctgagcatctcgatgatgatgttgagtcagaaagcttgtatagggagcataaacattctatgtaattaaaagtttgaaataagttagtacagttcttccctctcctcctctgattctactttgaatgatcaaaccctagtcatttttgttttttcttataatactctttccttttccattttgtccatagttatataatacacacagtgttggagtttggagagacagactataaagttaaaatgtaattagttttaattgattagttttaatcagactttcactattttaaatctgtctatgccatcccctatactgtagtacgtgaatagtcctctccaagcagtctagcagctccaagtcatcttctctttgaaatgtctacgttgtgactgaaatgcctgctattccaggttcaactgttatctttatactttttttgttttgtcattggaaactaaaattctttcctgttttttgccttttatcttgggtccatggtataaacctttctataggtgatcctttttcttgtttttgaattaaaacttaacacaactgcttttttgtctttctgtcctattactatctgtcttaccttcagacttttacacatcctgttttacctctgcttataatttccttctgccacactccttttcctttccctagttaacccttagattctcttcatgtacctctttaaacatcgagacctccagggcctacccatgtatgtgctcccagaaaactctctattttttcattgtactttccacactagatgaaaatgatcagttttcacttctcatctctaaacataattgtcttgttcacagtcatatgtgtagtttttagtacaatgtcaggcatataatacgtttttactaaatgtttccagaatatgatgtggcttttaaaatttttatttattgtctgggtgcagtagctcatgcctgtaatcccagcactttggaaggctgtggtaggaggctcacttgagtccaggagttcaaggccagcctgggaaacagcaaggcccgtctctacaaaaaatttgaaaattagctggatgtggtagcacatgcgtatattcccagctactgtggaggccgaggtgggaggatcacttgagcccaggaggttgaggccacattgagctatgatcactcctgggtgacagagtgagaccctgtctcttc

SEQ ID NO: 236049 - DNA, 2581 bp, Homo sapiens
aaagccctcctcccgggccaaggtagaggaagttgggctcccgcctggctgggaggcgggagggatcccgctcctgttgttttccgccggcaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtaggattggaggctgttgtcatttggagaagttatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagcggcccctatcagattgaggtccacatcgtggccaccggcacactccccaacggcaccctctatgcagccaggggctcccaggtggacttcagctgcaacagcagctccaggccaccacccgtggttgaatggtggttccaggccctgaattccagcagcgagtcctttggccacaacctgacagtcaactttttctcactgttactgatatcgccaaacctccaagggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagctgcatggtgcagatcaggggtccctcccttctctctgagcccatgaagacttgcttcactgggggcaatgtgacgcttacatgccaggtgtctggggcctacccccctgccaagatcctgtggctgaggaaccttacccagcccgaggtgatcatccagcctagcagccgccatctcattacccaggatggccagaactccaccctcactatccacaactgctcccaggacctggatgagggctactacatctgccgagctgacagccctgtaggggtgagggagatggaaatctggctgagtgtgaaagaacctttaaatatcggggggattgtgggaaccattgtgagcctccttctgctgggactggccattatctcagggcttctgttgtattatagccctgtgttctgctggaaagtaggaaacacttccaggggacaaaacatggatgatgtcatggttttggtggattcagaagaggaagaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtgaggagcaaagtgacattgttcaagaagaagacaggccagtctgaagaagaggatggtccatggttgtcttgctctgaaagcttggagagctacattgaagacgagctcttcattcagctttgactccacctgcacccctggcgggggcttgcactaacaatgtttgggtctcagcaaaaaacaaaaccaagcacacacatctttccttccatgtattgaaaaacattggtttgatttgctctaagttttcccaatgatgtttaaaagctttgagaaggaaagctgctttggtgtctgaggtgccacttctgctgtgaatcctggctttatccaggttgatctactgtgatagatgctgatttagagggaacagaggtcaggaaaacacaagatggaaaattgcaataacccatgcactgagacttagaaaatcatccttactaggtaaaatgtattatgatgcaataagtgccaactgatatttctcacgttgggactggccaggaactgctgcaaagaaaaataagcagctccttctccattatttacattttaagatgtggtggggggaggttgggagaaattagttctgaggttatcatatgccttttttaaaagataatggaataaagctatttttaagt

SEQ ID NO: 236050 - DNA, 2013 bp, Homo sapiens
aaagccctcctcccgggccaaggtagaggaagttgggctcccgcctggctgggaggcgggagggatcccgctcctgttgttttccgccggcaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtagcccaaggttgaactcgccttacacctgtaaccggtggacttccctacacacctttgcaagtcttcctgtgccgaccagcgccttcaaagcggggtcttccgcctttacttttggaaaagctttttattttgaaatacttggctgacttacaaaagacttcccctcacacttgacatgattgacaaaaggtctgaaatgcttcatctatggtctgctttgctacgaaaaaagaattggaggggtgcttacaaaaatatgtagaatgtaaaaagattgaactatttatatatatttgaatttaattcaccagcatgcctactgtgcatgcctactgtgtgctgggagtgtgacaagctgggaggaggctggggtgcagggagaggagatggagccaggaggtggtgaagtttgccaggatgcaggcagagcgctactttttgtgttcccgggtctgctccacccaacgggtctcctcttgcacgtttctggagatgggttgtaaagtatgctggagcttcttagcagcaagtgccaagagttcctaattattaggctcatacaattttattttgcttttttttttttaaccaaccatttaaaaacaataacatctctagatttccagtttatctggaaaaatctgaaggtctggcaacacggggcctgctttcccagttggaattgggcagtggtcatcctcttatctagggcatatgagcccaaatttgttccacctctccctgttgtaatatttgccccgccaccttcagtcatgggtgttacctgctggccctgcaggcatttggctgagtaatcactgtgctggggtgtgggtgatgggggaggacagttcctagttggtcatctctggacgtgaaaggtggttgtcaagtattcccatctccccagctgtttgcagtgtttcctgcacgatgaacaccaggaacctgggaagtgagaagaaccctgggatgaagtcatcctgctggaatgacctggctttcaggctgactgccacccgccccatggggaacctatctccactgctatggccagctatttttttcgagccaggctctcgctctgttgcccaggctggagtgcagtggtgcaatcactgcactgatcctcccacctcagcctacaagtagctgggactacaggcgtgcaccaccacgcctagctaatttctaaaatttttttgtagagacggtctctacaatcgcttgagcccaggctggtcttaaactcctggacccaagcgatcctcctgtctcggcctcccaaagtgttgggattatgggtgtgagccaccgtgttgggcctttgcccagctattttgatgcccagacctgcttcacctttgtgtatgatgccagggggcttcctgagcttggtgtatttttgttgtgtgtttgttttttaagttgggagtttttggggaaaaaaatttttctcctgacattcaatgccagacaacttatatgcatccactagctaccccggattgtaaatcctaggttattcttgggaaaagttgctttaaaaaaataaataaatgtttgggtat

SEQ ID NO: 236051 - DNA, 2770 bp, Homo sapiens
aaagccctcctcccgggccaaggtagaggaagttgggctcccgcctggctgggaggcgggagggatcccgctcctgttgttttccgccggcaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtagcccaaggttgaactcgccttacacctgtaaccggtggacttccctacacacctttgcaagtcttcctgtgccgaccagcgccttcaaagcggggtcttccgcctttacttttggaaaagctttttattttgaaatacttggctgacttacaaaagacttcccctcacacttgacatgattgacaaaagggattggaggctgttgtcatttggagaagttatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagcggcccctatcagattgaggtccacatcgtggccaccggcacactccccaacggcaccctctatgcagccaggggctcccaggtggacttcagctgcaacagcagctccaggccaccacccgtggttgaatggtggttccaggccctgaattccagcagcgagtcctttggccacaacctgacagtcaactttttctcactgttactgatatcgccaaacctccaagggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagctgcatggtgcagatcaggggtccctcccttctctctgagcccatgaagacttgcttcactgggggcaatgtgacgcttacatgccaggtgtctggggcctacccccctgccaagatcctgtggctgaggaaccttacccagcccgaggtgatcatccagcctagcagccgccatctcattacccaggatggccagaactccaccctcactatccacaactgctcccaggacctggatgagggctactacatctgccgagctgacagccctgtaggggtgagggagatggaaatctggctgagtgtgaaagaacctttaaatatcggggggattgtgggaaccattgtgagcctccttctgctgggactggccattatctcagggcttctgttgtattatagccctgtgttctgctggaaagtaggaaacacttccaggggacaaaacatggatgatgtcatggttttggtggattcagaagaggaagaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtgaggagcaaagtgacattgttcaagaagaagacaggccagtctgaagaagaggatggtccatggttgtcttgctctgaaagcttggagagctacattgaagacgagctcttcattcagctttgactccacctgcacccctggcgggggcttgcactaacaatgtttgggtctcagcaaaaaacaaaaccaagcacacacatctttccttccatgtattgaaaaacattggtttgatttgctctaagttttcccaatgatgtttaaaagctttgagaaggaaagctgctttggtgtctgaggtgccacttctgctgtgaatcctggctttatccaggttgatctactgtgatagatgctgatttagagggaacagaggtcaggaaaacacaagatggaaaattgcaataacccatgcactgagacttagaaaatcatccttactaggtaaaatgtattatgatgcaataagtgccaactgatatttctcacgttgggactggccaggaactgctgcaaagaaaaataagcagctccttctccattatttacattttaagatgtggtggggggaggttgggagaaattagttctgaggttatcatatgccttttttaaaagataatggaataaagctatttttaagt

SEQ ID NO: 236052 - DNA, 410 bp, Homo sapiens
caaaaaaaaaaaaaaaaaaaaaaagatttgttttttactttgaatgtaaccagtatcagcaaataacacattttctgaagaactgctaatgttttccatgctcattagaaatatagacctagtttctcccaaagccagatggtcatgtgactgataatttaagcatgtttctatgtgccaggtttttcaaatggtttgactggaatgatacagtcactttggcaagttattttaattgcactattttaaatatgtaaaacaattttcaaagcatacatttaacatgttgtttcaaaatgaatggggtttatgaaattatattgtgaaattttattacttgtattgatatgacatttgtacttgatattggtaattatcagttaagcaaataaatcctagtttaaactgac

SEQ ID NO: 236053 - DNA, 1595 bp, Homo sapiens
  misc_feature (974)..(974): n is a, c, g, or t
ccccgtcataggacttgtgacttactaccatcatacatatttgattcaattattatttattgcttaaattgttatgatcatttattataaatcatgtattacggctaattaacatacatatgctcagtcatttacttgattagttattagcctcaattatattattttttaatatatatttttatttgacaaatagaaagtatatagattggtacaatatgatgtttggaaataagcatatattgtggaatgactaaatcaagctaagtaacttatgcagtaccttacatgcttatcttttgttgtgataagaacacttgaaatctattctactgtcttagaaatttaaaaatgggcaaaggacttgaatagacatttcttcaaaaaaaaatgcaaatgaccaacaggtatatgaaaaggtgctcaacatcactaattatcagagaaatgcaaatcaaaaccacaatgatatatcacctaacacctgttaagatgtctattagaaaaacaaaatgtaacaagtgttgataaggatatggagaaatagaaatctttgtgtgccttgtacactgttgcaagagcattagtagaactactttggaaaactctttgtaattatctactaaagatgaatatatgcctactatatgacccagtgtttctactttgaagtgatacagccaacagaagtacatgcatacatgcaccaaaagacatatacagaaatgttattaggacttctggtttccagttccacatgtagggagcttagaagttgccactccaaccctaacaagtaaaaagctaagcaaactgagaaatcaattcttatcggacccaggataggggaggacacagggaaaaccactgtccccaaaagactagagagacagactggcaaataccgagagccacaagttactagagcatgcagtcacaaacagaaacccccacaggaagcagtgccatggtanaaaaacctgagctgtaattgatgattataggaggttcagtatgaacaactctgaaagttttaaactccaggaggacccactcatggggaaacaccacaattttgttagacttacctacatgagctcaattagattctccaagtaaatattgcagaaaaatccctatgtgcttctggcagggggaaggtgaaatgaaccattttgaaatatgccagagcactgtgctcttcttaacaaggtctgcccccaggagaaattagttagctaaatcctaacctgctggggtattattagagcctgacccaagggaagggaaatacctaactcttgtcagctctaaccttctgcatcagagaagggaaatactaaactccagacaactctagccatcctgtcctaccaaagaggggagaagaatactgaggaaacacttagaagtttgtacaccagaggcatatgcttactaaaagactgagacttaatcataggatgatagaatgtctcccctcccctttcccccacctaactgctacattgctaaaagctgatttataaaagttccttttacctggtacatcatgtccagctaccaagaaaaaattaccaggcataccaaaaggc

SEQ ID NO: 236054 - DNA, 400 bp, Homo sapiens
aatcctctttcaaggccgggctttggatcgctggcgtcgactggctccccactgctcctggctcaggagggaccattcaagggggcagcttcccgcctctattcccacactccaaaaaacaacaccgcagacagacaccctccaactaaattagattaaactccttctcttccacagcgtattagcctttttgctgcccaagcctccttacgcagcccctcctcatttaaagacacagatttctttttcatctctgcaactgcaacaacaacaaacacaatcatatatatatatatagtgtgtgtatatatgtgtgtgtgtgtgtatatatatgtgtgtgtatatatgtgtgtgtatatatgtgtgtgtatatatgtgtgtgtatgtgtgtgtatatgtg

SEQ ID NO: 236055 - DNA, 310 bp, Homo sapiens
cagccaatctgatgagccactcactcagccctgcagctgtgtatccattcattcaccagttcattcagccattgcccactgagcacctcttgttaattctgatgatcagagaatgttaagaaaaatacaacttctattgccagggagtttgaagtcagccacaagagacagatgtgtaaataaataattatagcacaatgagatgtgggtgcaggctgttgggagtaagagggttaagtagctggagaatctagcaccagagacgagatggcatatctatttattgcaaggtgaataagagttcaccacc

SEQ ID NO: 236056 - DNA, 475 bp, Homo sapiens
atcttcgggtagcctaagatagcagccttggaaaattcaaattaacacaaaagacattttttgtttttcatcttaattaataaaactgtgggtattatatagaagatgagatttaagaagtgattggatagaaatttcttagtaaattaaaggattgtttttaccaaataccagaagatatgtgtcatcttgcagtctagctgtgtaaaccaaggcacagttgtattagtcactatttctgtgtaataagttactctaaaactcacagacttaataactatgtgctgttcctcatgagttctgtgagtcaaaaatttggacagggtatactggggatagcttatctctgcttcataatgtctggggtctcagaaagactttgtaggccatgggtgactcaatagttagggactgtaatcacctgaaggcttatcacttacatatctgatacctggtctagggtgaccgaaggact

SEQ ID NO: 236057 - DNA, 429 bp, Homo sapiens
cgtgaaggtgccagaaactaaggtgcactgacagcttggtctatggggaacctggctgcattggttcaggtccccacttgtcccacttgcctggcctaaacacacccctggcacggagaaagaggatgagactcactgctggatccctagcacctggcccataacaggttttttgtgaaagttgtactgaatgaattgaaataattctagtccctggtctaccttctatagtttaagcagcaaaggggttgtagggacgtttaaagggagaatataagaacaaaagactagaacacactgcctctcttgccacctaaaaaatcatgcctgtaatcccagcattttgggaggctgacgtgggaggatcacttgagtccaggagtttgagaccaggctgggcaatatagatagaccttatctctactaaga

SEQ ID NO: 236058 - DNA, 349 bp, Homo sapiens
caaatgagtttagagaatactaggcactacatcccattcctggagttcccagtgctcttcaggacattgaagctatgagaatctcgcaaagcattcttagctttgtttacacacatttgaccaggtaatattttctctaaggaacgctcattgatattctatggaacttatttctcatggaacctactctgggaaatgctgctctaccaacatattaatttttataatattctctttcaaggacaatgactaacagtatcattgccagttttaattagttcataaatatgtttcagttaccagtggtagccatggcaagtaaaaataaataaatgcatatacaaaatta

SEQ ID NO: 236059 - DNA, 586 bp, Homo sapiens
  misc_feature (516)..(516): n is a, c, g, or t
  misc_feature (552)..(552): n is a, c, g, or t
  misc_feature (586)..(586): n is a, c, g, or t
gccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcggctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaaggattcattttgagagaaggaaagttcgattacaacatgaagatacctttaacaatttaatgaaggaaagtagcaaatttgatgatctcatatttgatgaagaggaaggagcgggtttcacaaggggcacctncgttcagagcattgctggtcctcccaccccatgcanaccatcacggtacatatggtggccagatttggcn

SEQ ID NO: 236060 - DNA, 196 bp, Homo sapiens
ataaagaacatgacatagtcctgtcctcaaagatgacagtttagatcagagtttctcaatacaggttactggcattttgtcataaattacaggaaagaagtataaatgagcaaagtgctcttcccctagtaaatatgttgtgttaatagagcaggctcaggttggggaataaaaggagaaaacctgctgtagtttg

SEQ ID NO: 236061 - DNA, 344 bp, Homo sapiens
acccccaccagcagcagcagcgcccgctttgccccggctccggagcgctgtttacctaatctcagcggctgaccgagcccagcagaatgcgaaagggaggcagcggtggtacagcagcgtccccggcgaagaagtaaaagacgtttgctttggagcttcgggataagttaactgcgaagctggggtcctgctgtcttacctctgcggcgatgagcctcaccgtgcacgttggcaggcatagcagattctgtttctgatgccattaccgtgtcggagaagaacattatatgaaaaaatactatctaatatcctagagaccattaaagtgtcaaagtttaatgcca

SEQ ID NO: 236062 - DNA, 659 bp, Homo sapiens
caccaaaaagcctcacttccaactccatccctgataccatggatgatgtaaagaatggtcagtcatttcactgcctgatgtcactaccaatacacaagaagctagaaaggagataaacagagagcagggaactctaaaatattttccctgagaatcactggaacaaggggtctgattacttctctgttggctgttgaggatccatagtcaaccgactgtccatgctcctcctattccctgggacccttgctcgaatgacctcaccacctggctggcacatgctaccctggggtggaagcacattctcttatgacttgcaatgggaaaaagggctgaggatcgattttttttttcctgagatagctgaggaggtgagtcctgccaacatctgagctaccccctagggcaggcagaatatttctggagaccactgggccatttggtatctcctggagcgtaaagtccatggaatgagagattctccccctggttctggcgtggccccattttctaataatacccatctgcagtcttaagcctttaagctgtcccaagggtagggggtctcagggaaccagttggctccagtcaccttgaaggattcactctgagttctgactggttgagaccagaagttctcgtaagtagcagcttcgctt

SEQ ID NO: 236063 - DNA, 501 bp, Homo sapiens
ataacccattggttataaaagaaatcacaatggaagttaaaaatactctgtactgataatgatgaaaatgctataccagaatgtattgaatgtggtggttggcaaaaagttacagatttacatacatgaagaaaggctgaacattaattactaaatctttactaagaatccaatttaagttagaaaatgaaccacagaatacactttaagaaatgagaatggtgtgggcatggtggctcatgcctctaatcccagcactgtgggagggtgagatgggaggatcccttgagcccaggagtttgagaccagcctgggaaacatggcaaaaccgtgtctctacaaaaaatagaaaaatgagccaggtgtacctgtactcccagctacttgggaggccgaggtaggaggatcagttgagcctgggaggttgaggctgcagtgaaccgagatagtgccactgcactccagcctgggtgatagtgagatcctgtcttaaaatgaaga

SEQ ID NO: 236064 - DNA, 511 bp, Homo sapiens
ctatacattactgaaaagtcatcttttttcggagagtcacaaaatcctccctccctctctcccttctatttttttttggcggggggtggggagagcgagggaagaaatgaaaactagggaaaaaattattttaaaaaaaggggcacttaattaagactctaatttttaaaaaagtaccaacagttttcatctattcccctatgctactgatagcaacaaatatgaataccggccggcaatgaaaatgtttattcaggttggcttaaacattacaccaaattagatatcaaggtagtctctaagattacaatagtttgcctgtatacgactccagtagtatagaaagtgtaaaatgtgttattgtatatattgggaagtatttgcatcctgctaaacaaagactgaaaacagtttgagaaccaaaaagaccttgcaatgtgtggctgctgtaagccttcatacggaactgtaaggctccatcttaacgacttttggttattattattatttt

SEQ ID NO: 236065 - DNA, 372 bp, Homo sapiens
agtttttatttcctgggaaaaaaatatcattttaaaaatatcattttgtgttgttattttgttttataatgagtcaggtttctttccagaggtataaagccttcaaagtaactgcccctaatgtcttaatatttattttctccctttactaaccactgacaagttttgtggcattctctctatacctttgtctttgataggttttattcctttaaaaagtatttgtgaaggctgggtctatcatataatctatgtgttatctcagtaaagtattttctccatcaaatgggacctgtggtatttacattaatagtggctttactttcactcatgaagcatttgaaataaaaacatttctaagttgatccttca

SEQ ID NO: 236066 - DNA, 468 bp, Homo sapiens
cagccacaattaagttaaaatggaagcaaacaacaacaacaaacatgggattctagaagttgtcaacgcctccaaagatgctctttgccagagtattcagaggtggacattgtgccacatcaaatattctagcaatgcccgagcccttgctctcatacacaacctcctcaggaaggaaaagtagaaacaggtgatttcctctctttccaaccagcccctgctctccttactctagctcatgctgagttattctgattcccatactcacatttggaatagctgcttttcctgtatctttatagatagctgcatcatcttctctgtgattcctgcaaaaggaatgttgcactaaaatgcaacattgtcctaacattagtctgtgcatttcaaaatattttaatgtggcttttttgggtggattattgatattgtatatgaagaataaaatatttgtgcaagaacagattt

SEQ ID NO: 236067 - DNA, 328 bp, Homo sapiens
aactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataaccaaca

SEQ ID NO: 236068 - DNA, 462 bp, Homo sapiens
  misc_feature (276)..(276): n is a, c, g, or t
  misc_feature (281)..(281): n is a, c, g, or t
aaaatgaacctggattttaaatgtgcattctaattgtccctttagcacatcagaacagcactgcctaatagaaatataatgtgagctacatatataattttgaattttctaaaatgcacattttaaaaaagtaaaatgaaacagttaaaactaatttagtagggcttggtgcggtggcttacacctgtgatcccagcattttgggaggccaaatgggaggattaccttggagccaggagttccagaccagcctgggcaacaaagcaagacccccgnctctnccaaaaaaaaaaaaaaaaaaaaaaaaaaaaatcgaaaaatgagccaggtgtggtggcacgcacctgtatttccagctactcaggaggctgaggccagaggatcgcttgtgattgaggctgcaggtgagctgtaattgggccactgcactacagcctgggtgacagagaccccatctccaga

SEQ ID NO: 236069 - DNA, 397 bp, Homo sapiens
caaagtgctgggattataggcatgaaccaccatgactggcctagatgacttttaatgtttattcaggactttctgcagcatctggcactgttgttcacaccttagtttttgcagtccatcactgccttggtacccatgtcgttacctagatctcctccttcctcttttctacatatttgtcatctctgcattcattgtgtacccctcatctcctgcctgctgaaaactatatatatatatatatattttttttttttaaaaggcaggcacagtggttcatgcttataatcctaactactcatgaggccgaggagggaggattgcttgagcccgggaagtcaaggctgcagtgagctatgattgtgccatggcactccctcagaaaaaagaaaacaaa

SEQ ID NO: 236070 - DNA, 1622 bp, Homo sapiens
  misc_feature (829)..(829): n is a, c, g, or t
  misc_feature (864)..(864): n is a, c, g, or t
  misc_feature (888)..(888): n is a, c, g, or t
  misc_feature (901)..(901): n is a, c, g, or t
aacaataaatgatgacagtgatgatgatatgatccatgtgatttcttggtcatggctttatgtcaagatttcctttagaaagtgaaataagtttaggtaacacacagaacaaacacagcaagaattgatgacttagacaataccgatttctttttttattgttattatactttaagttctggggtacatgtgcagaccttgcagatttgttacacaggtatacacgtgccatggtggtttgctgcccccatgaacctgttatctacattaggtatttctcctaatgctatccctcctctagccgtgcaacctccaacaggccccagtatgtgatgttcccctccctgtgtccatgtgttctcattgttcaactcccacttacaagtgagaacatgcagtgtttggtttaggtttcctgtgttagtttgctgagaatgatggcttcaaaaaaaaaggttaggtttcttttgttttgttttgtttgagacggaattttgctcttgttgcccaggctggagtgcaacagtgtgatcttggctcactgcaacctccacctcccaggttcaagcgattctcctgcctcagcctcctgagtagctgggattacagtcatgtgccaccacgcccagctaattttgtatttttagtagagtcggggtttctccatgttggacaggctggtcctgaactcccaacctcaggtgatctgcccgcctcggcctcccaaagtgcaaaaggttagttctatacataaaatacattttcttacttagtaatgttcctaatttaaagaatacttgtagaggattaccatagacttgtgtattanttttctagggttgccataataaattatcacaaacnaaatagtattcaatactggaaaantgttctctcacanttctggaggttacatgtccaaaatcaaggtgttggcagggccatgttccccctgaaggttctagggtaggatcctcccttgcatcttcccagactcctgcagttgtcaacactccgtggtgttccttgacttgctgcctcactctaatttctgcctccatctccccatggctgtgttccttctgtgtgtgacggtctctatggtttttctttaaggatactagtgattggatttagggccaccctaatctgtataacttacatcttaattacatctgcaaagactctttttcttaagagggccacattcacaggttactggaggtaggacttcgacacaccgttttggggaacacaattcaatccgttataacgtgtatctatttttaattgaatttttgcatgattacagaataaccgtttataaagttttgaaaacccagaagcaaaaagaagaaaataaagcatccctgttaatcttaccaaatggatacttattctagtttttacattttccctatgcatatacgtagaggaacacacatacatagttgagtttctttttcttttaattagtcttttgtgggggacatgttgttgtactatggatatataggggtgactgaaaacatggcccccaccatcagagaataagaatgaaagagagagagagaatcctaatcacacaaataaacacataattccactggacaactgctatt

SEQ ID NO: 236071 - DNA, 370 bp, Homo sapiens
ccaacctgttgaatcattgtcttctgacaaaatgtatggcctagccaactagaactacttaaaactgcgtgagcaactatgttgctatgaagaatccaaaccattgcaaaaacctacatgttttggatttggcttttaaaactaccttaatttataggttttgcttcctgggattacatttcttatattgctctgcacctaatgtctatgattgttgtttaatccatttatggagatgaaatgattctaaatccctcttgaatttttttcttgttggcagtaagctcaatatctgttctgccgctcttttctatttgcccctgtacactgcagcaaggataggttaattctggtttcctatagaccccac

SEQ ID NO: 236072 - DNA, 2023 bp, Homo sapiens
aaacaaggcggtgtgattgaaggtgggtaacgtggtcaagtgacaggggtgggtctgcttagataagatggcctgggaaaccttttctgaggacatggcttttgaatggaggctagaaagatgagagagacccagccatagaatgatttcagttaagagtattctatgaagaaagagcagcaaatgctaattccctaaggtagatataaggttggcatgttggaaagacagaatgggtttgcttctaagattctttccagtggaatttcagaaattttgtgattctatttcattaactcctgaggtttggctacaagaccagaccctactcttgttttatatgtgtagctggcagaatataggtttaatagtgagacaagaccaagaactacatgccagctccattgttcaatttctgtgtggtcttaagcaatttagctaacctctccaagtcttaaaacagcatggcttcaaatacataagagtttgaatttgttgtgtttgatgctgtcatgaacttttgattaagagagtgatatgatcaaaattaagcttaggaaatattgcagctggatgtaggatggattatagcaccaggagggaaagaatctaagaagctattgcactggtccattcaaacattggttagagttgcatgtcctgctgtgaaaagagagatggcagagacctgtgcaggaagcctttgtaagacagatcagcaggaagctcctgctgccatggaggtcaaggctcaatgtgtaaagcagttaaataaacgctgactcacttggaacttccagtttcttctttgtttgatgaaagaatggtattcccagtttcacgtgttagtcagaaaccttaaaaccaatagctaagcatagactactacataggtactgtaaacttattttcaaagtcctggtttttaacaccatttttaactactaaaagatgtatttttaaatgttgaaatttttttttgacaatctggtccagcatcaatgtcaggaaaatgatcactgtaaagataactgttacagaactccatgatgccagcagaacaggcagcaggtgaggattatagtacccgacgctctgtattttctaagcaggagactgtttacttcccaagacttacgagctgtttgtatgcagccgcaggaactccactagtccctgcctaagcacgctgtcatgcatgaggctaaaataggcctggagcatacaagtcttctctcgccatttatctcagctctttctcttgtcaccacccaaagtggttttaactagagtggtgcctaataaatgtggggagcaggcagggggaggtgacagaccaaaataaatcacctgtgtggagcaactcaattcagaggcgttcacagaagaactggaggcggttaggatagggaaagacgtggttcattggcagactgcatctgttttcggtaatcctccgttacaaacagttcggttaatccaaattcctgaaatcaacatgccagcaataaatggtataacagtggcagagatgtactttaacaaagtctaaaaaaaaaaatttattttcaaaaaaattttgcttttttctttcatattgctttataaagattgtttacaaattagcagtatccaaaattctagttaagatctatttatacaaacacttcacatttacagataagtttcagcagaaatgtatcttgacaaagtatggaaaagttaatttgaggcttcaatttcattttcttcatttctttttaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctat

SEQ ID NO: 236073 - DNA, 472 bp, Homo sapiens
tgatccccagagaaactgcaaagaacatgaatacacgagcacccccattttatagatgtgccattaaggcctaggaggcaaagggaatttcctggtgagcagcaacgtttagatttgaactctatgggtctggttcccagtctgctacctgggcaaggatcctgggagcaagcagggatggaggagggcatcggtgtccccctgaagaagggagcccttgggctgcagggacgccaagcaaccttgttctgtcccatgcactgtctgtggagcgcctgatgtgctgcctgctgaagcctccaccttctctccagctcatcctgagcctccacgctgggcacaggagctgagctgaccattttacagacagagaaattggggcccatggaaagccaaaggcttagaactccattttctaatgcctctggactcacctcatagaccacctggcctctccatccacccacacaac

SEQ ID NO: 236074 - DNA, 705 bp, Homo sapiens
catgtgcttatttgctgtccttgtatcttctttgatgaagtgtctgtttaaatcttctgcttattttttttcaaactgtgtttttttgtcactgagtttttagtgttctttttatgtcctggattttatattctggatacaaatccttttaatacaagttcatttgggtctttttaaaaaaattatttatttttattcatcttatataaaaggggggccaaatctaagaaaataatgttatgtcaaagtttgttttttaaagcataaactttcagagtttgttttaaggttaatacatagagtgctagctttttagtcacctgagaatcaggaaattcacttggacgtaattccctgtggtaacaaagaactatggcttcctatgggtttgtcaagctcctaggcttcattcagcctgaaattatacttttcttgttatgtataaattaaataaaatctatacaactgtctgttcttctgttgcctcacatcatgtctataaaaacagcatttaaagtttgcaggaaatagaattttggcctgttacaaagcaaacactttgtttctttaactcagaattctggaaatgcaatcaagttctagtattgtgactgccaaaatattttgtcatcagatattaatttttttcaagtgtctgactccatacaagaaaataataaaagtatcagaagttaactgtgatta

SEQ ID NO: 236075 - DNA, 1017 bp, Homo sapiens
actgaaaagctttgtagtatagacctgggcctcctacctcagatggaaagaatcagaagtactggattaggcctagggatctgcattttcagaagttttccaggtgactatgatgtgtatcagtagacctacgcagatatatacacccctgcagatatacattatatatccagtttttcacatatgatgtatgcaggtattggttaagtcacctaaatcttcttcaagccaaatattcttcattcctttcatttttacctcttatagtttccagactccttaacatcatggttggcctcctcttagaatatcattaaaacttggtatctcaactatggtctgacccatacatcccctttttctagatgtaaatttaaatcatacttatcttttgacttacactgagttttctaaagaaaggaagagcactgaaaagctagaatgttaaggaaaggcaccataggacttcagctgggctttgaaagatgggtaggcagtggatagaaagatttgagagtggttgaacaatagactggacaaacctgactgaagggggtcaaagagacagtcagtgacagtggtatggaaaaacaagaaatagattgctacatttcctgaatgcaaagcacatttcatcttgtaggtggtatgtaagcattaaagatttttgagctaagatgtgatatcaagaagtgacttttagaagttaatctggtaattaaagatggaagactgttggaatcactgagttgtgaagtattagccatggaagtaaaaagaaacagtagaggagatgcttcaaagaataaggtcacaggacttgtgattggtttgaaatagaagtagaaggagctattaaattcactgttagaaagagaggaaaatagtagaaccactggcaaaaagaggggggagttaaaatggagagttatttctaaagttagggcgtgaacagaagcttgagatgttggctttatctagcaaataatagtaatgtgggactgaccctcaggaaaa

SEQ ID NO: 236076 - DNA, 569 bp, Homo sapiens
agtcttcaaattcctgtgctgtcttacgaaataagtagtttggttgagcatgtatctgaagaggaagagtgagaagtaaagtttaaaggtagataggggcttggatcacattgaggatggccttgactaccaggagattttaacttattccacaggcaaggagaaaccatttaaggtttttacaaaggagtaacataattggagttgcatttcagggcttgtctctttcaggaatgtgctcttttctcacagatatttatttgcatggcacactctctctcctatttcaggcctttacacaaataccaccttctttgtgaggctttcccagacctccagtgtaaaattataaccccatcccagcactccctgtcctccttcattattttatttaatagcacttacctcaatctaatatacatgttttgccaatttatttttattgttctcttcctacttgaacaatagaagagaattttgtctgttttacgaactgctgtatccacagcacttagaacagtgctgggcatgttgttagttctcaataaatatttcttgaataaaggact

SEQ ID NO: 236077 - DNA, 588 bp, Homo sapiens
cctgtgttagaagcttctggttgctagttgctaccttcaaggactctgatgtctgttttctctcccattctctctgtctgcctttgtttttccatcccccctctccacccaccaacagagggacctctacctgtctaccagatgggaggcgttttcccatctgggaagaaaactttgaaggacagttgccatcttggagagagaatactgatctgggaatcagggagtcctctctatcctgagctatttggctctactctcttggcttcagtttctgtataaaatgaaggtgattttgtttgtattaaaatatgaataaaaacgaatgttggccaggtgtagtggctcgcacctataatcccagcattttgggaggctgaggtagaaggatcacttgagcccaggaggtcatgaccagcctaggcaacgtagtgagatttcatctgtacaaaaaataagaaaattaggggggcttgatggtacacacctgtggtcccagctactcaagagtctgagggaggaggatcacttgaccctgggaggttgagaccagcctgggcaacataacatactctgtctctaccaaaa

SEQ ID NO: 236078 - DNA, 446 bp, Homo sapiens
aataatgactggaatataatagtatgcaattagcagcttacttcctatatttttttcttcttagtggaagagaggccatgatcaatttagtatcttgtcctagatcagagattctggggagccatcttccaatcagtttaaagcttgaggaaaaaaaaaaaaagattgactctccctctagtaggagaaaactcttcctgcctgactgctttgaagtggaacatttatcttttcttgcctttggactcaagtagaaacacaagctcttcttgggtctagaacttgctggctttcagactggaacttacacccttggctaaacagactttttctggaactaaagccacagtatgttcctggttccaaggatttcagactcaactgaagacaccagcatctcctctgggtcttttgaatacagatcttgtgattttcagcctacatta

SEQ ID NO: 236079 - DNA, 1683 bp, Homo sapiens
  misc_feature (928)..(928): n is a, c, g, or t
aataataaaattatgtctaatgaaattccaaattaaggcaaaataaacaacagaagaatgacagcaaaccaaactagtgtactggttatcactatcaataattaacagaggtctggaagtttgaaatgctacaagttttaactgtatacagttgataatattgctttctttaggaatcaactgaaaacatactaaaattaattggtatgactaagagagcagaaataagactaaaaataaaaacacaatggatttcttctatgtaaagagcactcagagactatgatgaaaatattacataccaatgacagtagaagtagaaaaaaacaccaaaataatagtgtgaaaagtttaattggaattcttaacaagaacatgtaagattttcatgactaaattttatataaataaaaacttgtataaataagttgtgacacaattttctgaatgagaaaagagagatgaaatattgtctttctatttgcatatagatttactatcaatctgaaagtcttaactgaatctttcttggatcgtcacaaaaatatacaaaaaaaactcatcttaaaataaaaatcagctaagaactagtggaacagcaagtttagtaattttcctaccaaattttaatgtacattttaaagccctactaaatattttaatattttatatattgctataatagaacaaattgtatatagcatgcttcctgaattggatagattttaatatcatgagagtagatagatatactaacagaaataaattcattttactaataagtgcttggcatataaaaacaatactttggggggatagaataggaggcatgaaaatttgggctaatacaatttccttctaaatttactgaaaaatgagaaggatcttcaactttcttgcagagtcattcactcaagatacctttgcnataaaataaacttcccaacatctgacatggcccatacttaaaaggatgcttttcataccttttaaggaatcttttctgtgatttactagagggaatgtagattttttttattatcaggtgctttctatgacatctaatcagagtattaacactgtggccatgacaagtgtttaaaatttaaaagtacttttgtaatacttaatcctcttaagttgatttttatttttaccgaagttatacttgcacatggcctaaatcatgctataaagttttgttaagaaaaacagaagttcactttattttccaagtccacagattcctttgcagttcagtggttctactgcctattcctctctccagaaatgttctagtaatattccctggggtggaagccagctttccacacttcttccagaggtactaccacctgcctccatgggagaactggctctggacaaccgctctagtcttgctttgtctactgctcctgcctatctcccttaaaagcattagcttctctcccttctcctgtgacatacatagcgtattcctcactccatgacattgtcataggactgaaagaagccaggaagggaagttgtgtacaagtaagctctgttttctgttttaaagcgcaatcatccactgaaagaaaaaatagcacagagacctgtctagctgcttagaatggggagaagaaaattaagagaaaaaaaatgataaatagcttttcttttccttattctattaaagta

SEQ ID NO: 236080 - DNA, 471 bp, Homo sapiens
cctgagtaacatgagactccattatagtaaaaatgcatggaattaatttttcttctaggtataggaaaatgttgcaccataacaggtgtgcagaaactaagactgttaggacaacagcagtttaatgttatttatattatgtccctctcctagtccttctcctctcttccctcatcccactcaccaccaccccattcactacacagacttattttttgtagagcaagtgttcatattctgttccattatgtattataatatgaaaagggatgagttgaccaagtattggtgggtgtgtcgtatacttgctttagactaccaatggaagcgtaaattagtacaaacttactgggtgggtgtggtggctcacatctgtaatcccagcactttgagaggctgaggtgagtagattgcttgagcccaggagtttgaaaccagcctaggcaacatggcaaaaccccatctctacca

SEQ ID NO: 236081 - DNA, 646 bp, Homo sapiens
gccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaa

SEQ ID NO: 236082 - DNA, 561 bp, Homo sapiens
atagcagaattattaactgaatatatttttatatatataggcattttcctctagaaatatgaattggctgccattgtgggagagaggagaattattggaaaaaggaaaagtcacattccctctcatttctcccctattgctctctcattgtttctccatgacccagaacactgtctttaaaaagtcagtattaattcataaaaagacaattcccacagcacaatataactttattatattcactttaggtttttattttgaagagagaaatgctacttccatcaaaacttgtgtttttattggttagcaagtgccacctttgtcttcaaatggtaaaagtaaacaactagctattttttaattctgatgaattaaaagtatttttctagagaaaaatttgtgaaattattcatctgtactttttgaattgtatgtagccttggcaaaattgcctactaccttgtgtttaagaccttcagacattgattccttattgtgataattctgagtttttcaacaaagtttttcaaaatttgtttttgaataaaatgttgtattgaa

SEQ ID NO: 236083 - DNA, 320 bp, Homo sapiens
actgtccagtgtggtaaccagtagccaatgtagccatcaagcacttgcatagtgtccaagctgaattgagatgaactgcaagtgtgaaataaacactgcattttgaagctttagtgccaaaaaaaaaaatgtaaaatatgtcaattattgttatgtattgattccatgctaaaattaatattttggatctctcatattaagtaaactgcattattcaaattaatttcacctgcttttaaaaacttttaaatgtgggtattaaaaagttacgattatgtgtgtggttcatttatatctctgttggaaagagaagaatttga

SEQ ID NO: 236084 - DNA, 491 bp, Homo sapiens
atggccacatctgaaggtcatgggagagttaatgctccttgtgatctacaaagcttgtgcagcctgcttcttgttggagcgtgtttacaaatccagacgttgctaagagaaacaaatccaatatatataaaattataagttcatactttccagtgccaatcaaacaccaaagggttcttcctttccttgtgccatttcatgtttgtaccacctttatgcctcagtaagagtctttttcccagcaatatcaatcaacctatctatctatctcaattctaacattctaaaattgagcaaataacttcaaaattactctatcaatacttcaatacttctactaacaagaaacctactaagtaatgtttagtatttcttcatagtacttcttgtccttggaatgtatctccctgagagtgtacatcaaagtaatatattcaaaagtctcttgtattaattttttttattctgtgtggttatgttaacatttttat

SEQ ID NO: 236085 - DNA, 362 bp, Homo sapiens
ttggaaaacaatggaaggatctcagacacttcattgtctaaacattgttagatgggactaaacagcttcaagtgaatgtgccagctacaacaggcatgttgcaacaaattctcttctttatccccataaagccatgccctcttctttacctttataacagaatccagattttgtttaggtgtctggtgtccaggactccctctccaggtccaaagaaacgttgactctttattggtcccagcaattgggttaatattctccttgctggtgatcatctaagaatagtcacgtgatgtacttgtgataagtgagacatagaggaagtgggggaggggtagttccaaggacaatttcctgcccat

SEQ ID NO: 236086 - DNA, 434 bp, Homo sapiens
catgttttggggcagggaattttctctaggagatatataaataaatatctacatatacttaacatttattacgcacttactacatcccaagtactatgttaaacactttaaaaatctgtatcttatttaaagctcaaaataacctttgtgatgtagatattgttatcccaccttagaaatgaggacattgagacactggccacacaggtagtaaacaggtagtaagcactggagttagggtttgaactcagtccctgattattgatcatagactattgtgcttggacataatactttccctaaataacttctctgcatttctacaaatgatgatgctttcagatttgttccaactacatgtatatttctgtagagcctttggacatgaatataactttactcagtaaaacaccagttactaaatgtcaacttaa

SEQ ID NO: 236087 - DNA, 167 bp, Homo sapiens
cctctcttccttcgttttataatacttttgtggtagatacttttgactggctctctgaacgccctctccaagtgccttttatgatgtgttcctataatatagaagctggaaatctagaaatgatgtttcccaggctcccttgcagttaggattctacctgtgattag

SEQ ID NO: 236088 - DNA, 402 bp, Homo sapiens
gtgctagtccaagagacatgacaggggtcaaggtggtcaagatggatctgcttcctgcccttgttgagcttccagtctagcaacattaataaaatatatacaaatgtttacttagaagatgtggtaagtgctatcaaggaaaggtgctgttgggctgtataatggagggacccgatcattagatcaggtcacagctgcgagattgactggtttttttccctcaatagggtggaaatggctttattttgtagatataaaagtaatgaaccatggaattggttcttgagagttgtgttctaaaggcaacctattggcaagaattgtctgtgatcaaaactaccatatttcattgactctaagatgccattggttgtaagaagcaccatttttaagtgcatcagt

SEQ ID NO: 236089 - DNA, 248 bp, Homo sapiens
agggagcatagctgctccacacagcggaattctccgcgcacagacagcgcagccctgacgcctccagacaccccttcttgccgatgcccttttctagcttgatcttgatggttcctagagcctgggggtcaagtgttccctggctcgcttcctgtaacatcaactggaacttttcattgtggtctaaaaataatcccagcactttgggaggccaaggcaggaggatcgcttgaggtcagaagttcgag

SEQ ID NO: 236090 - DNA, 537 bp, Homo sapiens
gtgacttggctttttaaatctgtaaaatggaggtgtttattatctcacaggctgttggggttaaataaatctgctaaaggacccaacactcattgagtccctggcagagttagtgcttaaagttctcttttacagagcaaatataccacactgagtaaggcatggtgagttttagtcagtgcagtatactgagtggtgggttcaagcatgccaggagaatgtggttgccctcacggtgtattaaccagacctcatttgctagacataggtctttttctttaaactttggatgcagagttgaattaattacatcccattggtgcccaggttccctattatccaacaatgaggactccttggttttaattttgctccttcaatcctgttttctaccattctccccacagaaggacccaatctgttgtgtttgacacacctttaaatctatagcctgagaaaatggtgtagtgctttgcatgtggtatgtttttaatttatgcttaaccaaatgtacatgatactgtgttatagttattc

SEQ ID NO: 236091 - DNA, 547 bp, Homo sapiens
aaaaagttttaagcagaggagtaatgtgttagacagattactctagctacagtgggaaaaatgcattggaagactgaaagcagggatgagctgttaggaggctcgtgcaacaacccaggtgagacatgatactaaccatggagtaggagggcagcagcgaggatagggaaaaggaacagattcaagagatattaaagagaggaggatcacgaagtcaggagatcgagactatcctggctaacacggtgaaaccccatctctattaaaaatacaaaaaattagccgggcgtggtggtgggcacctgtagtcccggctactcaggagactgaggcaggagaatcgcttgaacccaggaggcggagattgcagcaagccaagatcgcaccactgcactcccacctaggtgacagagcgagactccgtctcaagaaaaaaaaaaaaaaaagtaaccaaaaaataaagcggtaaaaacaaaacaaaaataaataaataaataaaaccaaaaaataaataaagcagcaaattaatgcaaatattttcaagaaa

SEQ ID NO: 236092 - DNA, 2049 bp, Homo sapiens
  misc_feature (1714)..(1714): n is a, c, g, or t
gatgaagcatgagccctgcccttgcggactccaaggccaaggccagttgaggacaggagagccagccccagggtccggagtggtggtgaagactctggaaccagctcacccactccaagaacttccctagcctcctcatacctcactctcctcctctgtggaatggacatggagaaggctacttcatcaggtgactggtggtgaagttaggccgatctatttaaggtagttagaacagtgcccagcctatggtgagctcttgttacctgcctggtgcaggctctagaaattcagaaaggaagccaagaagagtaggaaagtcttttgttaggaggtgggctttgcagaatggatctgcagagatgggggaaggcgactctgtcctgtaggtgggggaactgcgtgagcaaaggcacagaggccggatgcactgaacctgtttgttcccccagaggttctgaggccacaggaagtggctggcgtgggagtggctggtccaaggggagctgcactattaagtgtggagggggagggggacaggagcaggaccacagggaccttgaccgccaagctgggggaaggaagtgtgaataaagccccaatgccaccaggcatctctgtactgccctcctctccctccccactccagccaggcacctgccctgtttcctgggaccccctgaaggaggacatcccttagctccacaaagagccctgccctagtcttcacatagtaattgtcttgtgtgtctcacccagtgataaggggtgggcaaggggcaggggtgggggctcttgagcacccgttttatagatgaaatgcctgagaccaggcgggagcccctggggcctccctggcttcatggggcaggctcaagtccctcaagggcgcggcttccctccctctcagcagcccacacttgttctatgtccggtgatgggtccctgagggtccgctggggcgcccctccagcctcccgccagagcagggctggaagactgccatgtctggggccaggctgagctcagtgcatgcctctgcgtagtgcattattgatggggcttctaattgtgcgtttcccaaagtctacaggcttttgatgaaaaattcatggcacgcccgaggatgggagcagactcaatcgattggcgcacagcaggcaggggaggacagggccccttgcagggaggggtggtgaagcctggtctgggaggcttcttgccccaggatcttggggatagcagggggcacacacccatttccctggtggggaggctgaggggcaggagcaggaagatttaaggcccacatctcagtgccagccagtgactggtgccatccagggaggatggccgactccaccacgggcctccctttcatttccctggaggggtgctagaccctccagagcccctcatgagagttgcacagaggagggagtaatatttctggagccactcttatatgccagacgctgctcggacgtgtacactcgcagcctcatttaatccccaacagcgttatgagatgggcacagtgatgcactccattttacagaggagaaaacaggcttagagaggttaagtgacctgtccaaagtcacacagctgcttagtaacagagcccactatctttccacttcaccaggcccactcaaataagaactaataggagtatggggattgtcttgtgccactcccctacttgtccctnttgttcagaggaagtgtccccattaagaaaaagtggagtgggccaggtgcagtggctcatgcctgtaatcccagcattttgggaggctgaggcaggtggatcacgaggtcaggagatcgagagcatcctggctaacacggtgaaacccagtctctactaaaaaaatacaagaaattagccaggcatggtggcaggcacctgtagtcccagctactcgggaggctgaggcaggagaatggcatgaacccgggaggcggagcttgcagtgagcccagatcgcgccactgtactccagcctgggagacagagcaagagacagagccagactccatttc

SEQ ID NO: 236093 - DNA, 574 bp, Homo sapiens
aaggtttaggcatgttctttcacttactccttagaagcagttcgcattctttgtgttgcctgtgaaatcggatggtgatatagggcttaaattttgaaatatgggacatttggagaacttaaggcaaatcaaaatggcataacatgatggaggaagcatgaagaccttgtgactggtagaaacaacaagaggatgtaggaaaagactatgtattgggaaagggggtagaaactatgccaaaattccatttgcccacttcagatgtctgcttgggacgaagtctgtgcctgggaaaagggatgaaaactttaacttcctttccccccacactttcatcccaagagcctagaattagagctgatttaatggtactaactagtactgttaaactaactagtactgttaatagacctttatgacagcatcctcagagttaactatttatataattgttctctggagcaaagcattcagagttcccagaagctacagtgaatttcacaccacttataaaccaagggactacctgcaaagtgtttctgttattttaaaatctaaagtctatttgaatttg

SEQ ID NO: 236094 - DNA, 448 bp, Homo sapiens
tctctttttcttctaggctgcctatgatactcatctgacctgatttctcctgcacagtgttgcaactgacgagtagcagacttgcccttgcctgcatttggggggatggctgagactttccttacagaaagccctactttcagcatgaacactaacccagtttattggctcagggtgtagagagttgccttgtcactggcgaagtcagatgcagccagtaccagagctctgcactagctgtgaacactaaggaagaatagctgagtgaggaagcagagtgccaggcagcacatccttcttcaggtgtttcctgccctgggccagatcccaggcactgcagcaatatctctgcatgatctagggctcctggaaatagcccattaagggcaaaactcgctgcccagaaaacattagaacattaaaagagcagggtctcaaatctgattgt

SEQ ID NO: 236095 - DNA, 383 bp, Homo sapiens
cacaaagacagaaaggaacacatgctcaatataagaaagcctgagaaacaaaaactcagcttccctgacgtgtggcattttcaaagcccacacatcataacaactttgaattctgagacgcctcaacaggaaacctcagaggttccatctgtctccctgatgagaaggacagctgaggtaccaagctgctgtctagaagagggctggcaaaaatctcaggaaccttggcccaggagctagaaatgtgcagttcattctttcctccagtctaatttacagccctgacactagctgttggctggttagcaggtctatctccatacataactagaaataaaccaacaaaaaagttggctcacctctcaattttatgtgtactccta

SEQ ID NO: 236096 - DNA, 557 bp, Homo sapiens
acctaaggcttttctgggaagagctgttaagattagactgttctcccaaaaagccaataattctgagtgtctccattaatgcctaggtagcccatactctcacccagccggtgcccttcagcctggaacctttggatggaggattggaccttgtgaccttcaagttcccttccgaaccaaatatgctctaacccaggagatggtgctgttgcccaggaagccggtcaccatgacgagagtacccgctcagatgaggatgcaggcggaggcggtgaaggtgctggaggccaggatgctgaggtacctccagacaccacccaggctgcagcaaatggaatgggagaggctaacacaccataatttttcaattccatgatgcccattttttctcacattttaacgtctctaaaattggggcacatcttatgattgatggcatcttacaattacacttggcagtactttttcttggtgatacaaaaaaacaacagtgtatcttacaactgatagcttagattcagtgaaatcctagaatacaacaggtttgaaaattctct

SEQ ID NO: 236097 - DNA, 424 bp, Homo sapiens
caagatgacaccatcagagggtcagaattgaggtgcaaacccagttatttgagggcaaatccaggcctctgtccttggatcccccagagtaggctgggcctgcttctctcttacttctacgtttttaatagacatgatttcttcaaagtgccattttatctccataggtacctccagacaccacccaggctgcagcaaatggaatgggagaggctaacacaccataatttttcaattccatgatgcccattttttctcacattttaacgtctctaaaattggggcacatcttatgattgatggcatcttacaattacacttggcagtactttttcttggtgatacaaaaaaacaacagtgtatcttacaactgatagcttagattcagtgaaatcctagaatacaacaggtttgaaaattctct

SEQ ID NO: 236098 - DNA, 354 bp, Homo sapiens
ttcataattgtcagattactttcataaacaatggaaacagtttcaggctcctcagcttctcacctcctgagcgactgtttatagatttgcaggccatttggatttacaattaatcttattaatgaggctgaaatgtgaagtttatctcagcctcaaagaagtaattcagcaaggatcagtggtttcacttaacagtctggctctgaggctggctgtggccctgttatccatggtgagcaccatgggaatgcaggcaagggctgtgagaggcttggaacaaggctccacccaggagagatctgggtgggcgttggtgaccagtagaacctaggtgtcctggccagtgcccttgga

SEQ ID NO: 236099 - DNA, 523 bp, Homo sapiens
acagattgactttgaatctctgggggttgggctaaaaaaaaaaaaaaaaccctacattttaaacaagctcttcagatgacccttgtgtaagtttgagagcatctgctggaaaaccactagaatttgcaaacggccacctcaaaatactccagccagtcccactaagccaaagactttcttttggtcatggtgggaggctgttgctgaaaacataccagagcccattgtggaggtcagctgacaggccgcatgaccttggcaatggactactggtcatctgggactgcttaggactgtgcaatggaacttgggggcaaaactgatggagacagccaatgggccttaaatccagcaggcaaagacagagtaagttcttatttgtgtagcccagggcttatcaaagtgtggttcttggaccacgtgcatcagtatcagctgtaagtatttggcaaaatgcagattcccgggccctgcaccaaacagattgactttgaatctctgggggttgggctaaaaaaaaaaa

SEQ ID NO: 236100 - DNA, 479 bp, Homo sapiens
cctctccttgctatgggtcttaccctcaagtcgctctgtgattcaaagatgaactgccaatcaaatgttcctctaatgaaagatccaatcactctacagcatgtgtgtattcaaagaacctatctaagactttcttttggtcatggtgggaggctgttgctgaaaacataccagagcccattgtggaggtcagctgacaggccgcatgaccttggcaatggactactggtcatctgggactgcttaggactgtgcaatggaacttgggggcaaaactgatggagacagccaatgggccttaaatccagcaggcaaagacagagtaagttcttatttgtgtagcccagggcttatcaaagtgtggttcttggaccacgtgcatcagtatcagctgtaagtatttggcaaaatgcagattcccgggccctgcaccaaacagattgactttgaatctctgggggttgggctaaaaaaaaaaa

SEQ ID NO: 236101 - DNA, 606 bp, Homo sapiens
ccctagaaaagtagatcaatttatatccatgtggagatgtataatagggtagtcaagagcacagcttagaagtcccaactttaccatttctttgccatgttgaatatgttaactttcaaaatcttgtttcttcttcatttataagtggagctaattatagtctctaagttaaggttgttgtgaagttgtaataatgtcttactgttgttgttattttcactgaccagttttgttttcaggacggttgtgattaaatagaagcagaaaatttaaaaacctatagaaaattttattttaaaaaaattttcacaattacaatcttatttgattaaatactcaacaaatatttatttacatattcagtagatatttatgcagctcctaagtgtctagatataataaccattttaggtactggagagttgatactgggtacaacagaaagaaagacatgggccttgcattgcagtggaggagtcagacaataagtaaatacataaacaagatggtttcccaaagaaatcatttgcgtgaagacaatgaatgtgatgtaatagagagtgactggaggcccatcttagagtagatggttaaagaagagctttc

SEQ ID NO: 236102 - DNA, 362 bp, Homo sapiens
gatgggaaactggggtgaaaatgcaaagaccagctttgttgtcaatattcgttagtggtggtgggggtgctgtggctcatgcctgtaatcccaacactttgggagaccatggtgggaggattgtttgagaccaggagttcaagaccagcctgggcaacataaaaagacctcatctctactaaaaaaaaaaaaaaaaaaaaaattgccaggcatagtggcgtgcacctgtggtcccagctgctaggaaggctgaggtgggaggatcccttgaacccaggaggtagaggctgctgtgagccacgatcacgccactgcactccagtctgtgtgacagagtgagaccctgtctcaaaaaaaaaaaa

SEQ ID NO: 236103 - DNA, 741 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgctacaacagttgatggcccaaggacatctttgctatcaccaagaagcgaagttcgatcaggttctccatctgccaaacctccctccataatgaaagaagataggtttatgcttctctttccattaatgtgcagccattctgtaaatctgcaaatcccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236104 - DNA, 695 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgcgaagttcgatcaggttctccatctgccaaacctccctccataatgaaagaagataggtttatgcttctctttccattaatgtgcagccattctgtaaatctgcaaatcccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236105 - DNA, 712 bp, Homo sapiens
agggtctgttcaggtgtttttcttctattaccaacaattctgctggtacatgcgtgagagtattccctggctatgaggacttgctggactaagagatggctgatgcaaatctttggttggcgttggataagcttcttttccttggcgctgactcatctttcctggtgtcagaagctgagattcgtcactgtttgctacaacagttgatggcccaaggacatctttgctatcaccaagaagcgaagttcgatcaggttctccatctgccaaacctccctccataatgaaagaagataggtttatgcttctctttccattaatgtgcagccattctgtaaatctgcaaatcccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236106 - DNA, 698 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgcgaagttcgatcaggttctccatctcccaaacctccccccatgtgaccgaagcttgccttgcgcacggctctcccttcacgccgccgtctttgccccgcctctgcacccctccgcgcccactcccctgcgcgggcgctccactggctcccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236107 - DNA, 857 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgctacaacagttgatggcccaaggacatctttgctatcaccaagaagcgaagttcgatcaggttctccatctgccaaacctccctccataatgaaagaagataggtttatgcttctctttccattaatgtgcagccattctgtaaatctgcaaatcctcaaatgttcctgcaaaagactgcttcaggcaaggataggaatgtttaattaccagcttcagtctcttggaggttagccacagttctttaaacgcagtagcaccaatggagattgccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236108 - DNA, 763 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgctacaacagttgatggcccaaggacatctttgctatcaccaagaagcgaagttcgatcaggttctccatctgccaaacctccctccataatgaaagaagataggtttatgcttctctttccattaatgtgcagccattctgtaaatctgcaaatcctaaaataagaaaatgatatttccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236109 - DNA, 809 bp, Homo sapiens
  misc_feature (2)..(2): n is a, c, g, or t
antaataaaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgctacaacagttgatggcccaaggacatctttgctatcaccaagaagcgaagttcgatcaggttctccatctgccaaacctccctccataatgaaagaagataggtttatgcttctctttccattaatgtgcagccattctgtaaatctgcaaatcaattaccagcttcagtctcttggaggttagccacagttctttaaacgcagtagcaccaatggagattgccgtgcggagctcccagggaggcgggacgcaaggagccggttcctccgaggtcgccgcggcgccggggtccgaggccccgtaagcgtctagtcagaccccaacttctctcggccgctgtcgtcggcggcagctggggcgcgagcctggacgaagggcgctgcccagcggccgcggaggcactgccggctcagcccccgagcggggcgggaactttcggccccgaggtccaccagcccgggcggacccccaccttccctcagtcggcttgctaccggcagcggctactgcggcgtccaaagctaacactacagccgccgcctggccaggagcgcgtcgcggcctaatgttgtcatccgccgcgt

SEQ ID NO: 236110 - DNA, 777 bp, Homo sapiens
gcaaggaatctgaattacagaaaaataaactttaaactgaaactgctaatataataaatgcagaggagacacagggcagcaaatgcacaaataaatgtatgtctttagccagtatgtgaatgatacccaaaacggctggttttccatctcaaacagtcatggaataacaacttcacagtgtttattaattgttgaaattgtctaaaacaagagaatatattttcacaaattcatctgacacagacacagctataagcacatgagaagacaggcctaaggaaaaaggtaaaattaattcacctatgtctgtatttgtcaactaaacaaagcatcaatccatttattataaagtataataaaactaaggacaaccattgcataattaaattgcctctgaaagccaattattgattatggagaaaaccaagttttacaactgtatgtgtgtatcatataaagatttcatttcctaatatagatcattcattatttattttgaaatgttaagaatttactatgtgccagtgtatcatttgaattctcatattttaaacattttaaactataggttaattttctgaaattttcaattagtgtcagaagaagttacagaaaaaggaataacaaacatgtttaaataattaaatggtttcaatggcatctctgaatttctttgatattattatcaaaatgttttcttcaattctactcaaaaccttatttttttgccctaagtctttgtcagcttatttcagtcttatttttacatgtaatata

SEQ ID NO: 236111 - DNA, 573 bp, Homo sapiens
actttatgttcaattcttgccttcagtccttgcttgaactcttgcttgaatcaagctctcatacccaacattccactgatcctttctttttcatttaccagtgatggatccatttgaaattcaatgtttaatttcctgtcatctttccattcctatcagtagcatgtggcacagttgctcactttctcttctattttcttggcttttaggacatcccgttaagctttacacatctatttgttgtaattttcttgttgcctccctaatcacattatgctttcctcttcttgtgtctccagaactttctgttctctgaacgtgggcttagtcctccagccacttttttctctgtccgcactcattgcctttccttatcaactcagctcatggctttcaaccccacctgcacagcttcatgtcaccttgggaggccaaggtgggcagatcatgaggtcaggaggctgaggcaggagaatcacttaaacccaggaggcggaggttacggtgagccgagatcgcaaccttgcactccagcctaggtgacaagagtgagacttcatctcaaaaaaaaaa

SEQ ID NO: 236112 - DNA, 459 bp, Homo sapiens
agatactgtgctaagtgctttaaagacattttcttatttaatcttgttgagaaccccgagaggcagcataagggacactgtggattgcaactctgcatccactctgcattttcttaagaccaaacgcctgcatgtagcccatgtgactgcggggggccagccccactcccagctccagggatgggctctgattggtctgaacatggttatcccatttccctgcctgtgattggttcaagtagacagacctaagccaatcagcttcaggcatcccaccatgtgaatgggttctcagtctatgggtgggtatgagacttatattcgaccaattatattgaaaggaaggaattttatttcacgatggggaaggactgtctattgctcactggatatgaacaacaaggcatgtggcctgaattatcaccagaagccatctagcaaacacgaaaaacaaaaaca

SEQ ID NO: 236113 - DNA, 446 bp, Homo sapiens
cctcatctcaaaaaaaaaaaaaaattaaagccttagtttacaggcatatattatcattgcaaaggatgactgcaaaagagagttctcactgtgaccagtcatgggatctttaaaagttgtcattgataaaagatgacagagtgggaggaaagaaaaaggaaaggaggctgggcgcagtggctcacgcctgtaaccccagcacttttggaggccgaggtgggcggatcacttgaggtcaggaattggagaccagcctgaccaacatggtgaaaccccctctctactaaaaatacaaaaattagctgggcgtggtggctggtacctgtaatcccagctacctcggaggctgaggcagaagaatcacttgaacctgggaggcagatgttgcagtgagccgagattatgccactgcactccagcctggcgacagagcgagactctgtatc

SEQ ID NO: 236114 - DNA, 558 bp, Homo sapiens
aatctgtgaataatatcctgggcccagccctgagctgtacatatgtggaactgatgggaagcatcaaagcaaaggctttgaaaactgaactactgtgtagagtcctgtctgccaattggcactgtgtagcacatgagcagggtagagccaaatatcacttcatgggctttgaaaactaactggatattggaaccatggcccacagaaggtgagcaaggacttatgagctgaatctaactaggtagatggtttgctaaaaccaaaaatcagcattctgaagagtctcctaaaataatattcaaaatgcataggatacagtttaaaattattcagcctacaaagaaccagaaaaatctcatcaactttcaagagaaaagacaacagatgccaaccttaagatgactcaaatgttggcaatattaggcaaagactttaaagcaggtaatataaccgtactccaaaaagtaagggagaacgctattaaaataaatggacagatacaagttcttagcaaagtagacacaatgtaaaagaaacaaatggaaatattataactgg

SEQ ID NO: 236115 - DNA, 406 bp, Homo sapiens
ctttagatttcacatctaaattgtgctatttgaagtttgcaggtagtggtctttgatttggaatttgatctctgcactggtgcttattaaccatgtgaggccacatattcagcctctttgaatctcagtctcatcaaatataaaatagatacaaccttataggattgaagattaaatgagacaatgtatggtaacgtgattaactcggtatctatgcatagagtacttacttttaataactgctattatgctccgcaaaaagctatactgtcctaagttgtgctagatttaaatttaaatgtattcagtattatgtagtttattcagtggaactttttttgagggggagttatcaatgaattttgtccatttgccagtggaaattaaaagtatgcagttgatttta

SEQ ID NO: 236116 - DNA, 405 bp, Homo sapiens
ctcactgatatcccagtaaataactacaagtgagacaatatcataaaatcactgtgaactgataaaacagaagccaggtgaggtggtgctggtagcagaaccagggcaaatggagaaggagagggaggtggaatggtgaggagaaagaagctgtttcccatcatggaagcaccagcatgggtggatacagataccaggagttggaggaagggcaccaatggtgaaggctgtctgcaggaagagtccatgggctggcctcccccacccaggctgaaacaggaaatataaccactaaggatccttaacaatcttccaagaaggtgcttaaatttccagagtggggattatcaccccaaaatatgttcctctttggcttagcatgaggagcagcacaacttgcctgct

SEQ ID NO: 236117 - DNA, 459 bp, Homo sapiens
ctcactgatatcccagtaaataactacaagtgagacaatatcataaaatcactgtgaactgataaaacagaagccaggtgaggtggtgctggtagcagaaccagggcaaatggagaaggagagggaggtggaatggtgaggagaaagaagctgtttcccatcatggaagcaccagcatgggtggatacagataccaggagttggaggaagggcaccaatggtgaaggctgtctgcaggaagagtccatgggctggcctcccccagtctactcaacaatcacctctcacctcttcccccaagagcagcaaatgaattttcccaggctgaaacaggaaatataaccactaaggatccttaacaatcttccaagaaggtgcttaaatttccagagtggggattatcaccccaaaatatgttcctctttggcttagcatgaggagcagcacaacttgcctgct

SEQ ID NO: 236118 - DNA, 464 bp, Homo sapiens
ttcatgaaaggatgttttccaactgataactactgggccagaggatcccttatactgttgtacgtatttggggtctgtgaatccttgccaacatagaagctgatggagtctgaggaatgacacacactgagaaaaccaagcatcatcattacagacactgtgtgaactccctgcctgccacccacacagcacagtcacggttatgtccatgcttatgtaggcctgggctctgcctagctgcgggtgatttcatcagtggatgccgctcagtttgcccctgcctgctggctggctcgtccccagccccaggcatcagggtgccccatggtggggcctgtgtggccctggcccttctctgctgccccagggctgtgaagccacaggtcggccccctcgttccttgatgctctctgtccattgtctctacaaatacaaagagagtctctgaacaggacaaaacacat

SEQ ID NO: 236119 - DNA, 466 bp, Homo sapiens
gcattcacacaaatatccattatgcaattagtccagtatggtttatattaagggaatctgaaagagactctttttaaagctgatttaaaaaggaaattgattttccttgttaaattgccaggggtatttggtacacaggaggcagaggcctgggtggtgagaagcatggactgtgaagctatacagaattggattttgaatcctcctgatctcactaacttgagcttttcaaacttgggcagctcttacagtcttatttatatgagatagtaatactattatttattatttggggggatcccgagattgattttcctttcacagtacctactggctagttgctttaatatgcattatgcagtgttagtcccatgcgacgcaggaggaagccaggacacagagcaaagaacagccaggaaaatgcccggggtagccagggccggctttgctgccaggtgtgcccata

SEQ ID NO: 236120 - DNA, 392 bp, Homo sapiens
gaggtgattggcccctagagggtgtggggcagagtttctgggggagatgtggctcaagcctggttcctgagctgactgggctttggcctcatctggcacctgccagaagtcagtgtccccagaaagacggggaagatggggtgggctgtgagagcccaaagctcttggggccttggggaggaatctgtgtcctgaaggccatggaaagcccgactgtgtcctgaaggccgtggaaagcccgactgtgtcctgaaggccgtggaaagcccgactgtgtcctgaaggccgtgaaaagcccgactgtgtcctgaaggccgtggaaagcccgactgtgtcctgaaggccgtggaaagccctaatgtttcacataagggagtgatgggatcatatct

SEQ ID NO: 236121 - DNA, 774 bp, Homo sapiens
agaactgatgtcccgcggcacagctgatgggaagattgcataaaggaatagatgggaaggcattcagataagagatcacaggtctgcatttgatcctggctgagtgagatgttggggctggtcatttcaccttgctaagactgtttccttatctgtgaaattgagaagatcacctttctcccagggtggttgtgaggattagctaagatcctatttgagatctttgtgtcttgtggtgtgccataggcatttgaggtagcatcgtgattatttccatatattttggccactggcaaagtgaacggtttctaagtcttgattataggactggactttggtggtcctcagagccccttaaaaggcataggaagcatcaagggcctccaagcataagaaattctccggttctagaagtttaatgagactctgctgctctgagagaggctttagaacctcggccattgcctcaaaatgtcaggaagtcagtggagtgcagtagacccacatagttccttctttctccggattgagggactgagtcccccttaatgtgaatgaaaggcttaggaagcttcaaagatgttccctcgactgacaaagcagacattctcacagcctcctccagaccctgccacatggcttgtggctgtactgaatgttacttgaaataagtgagacattagctggtgttggaacatctcgttaatagattttcatcttagtagtatttaatttgttatgttgcaaagcagtaagatgttcatcaccgtgcca

SEQ ID NO: 236122 - DNA, 371 bp, Homo sapiens
gctggcttcctgtgtgtattattaacacattgggcaagccactaagctgctttggggttcagttccttgatctgtaaaatgaaataatttgactggatattattaagtccttttatatctccagagctattttattcctttattcaccagacttttcttgtgaagcaccttctctgtgctaggcacaatacaggatgttctgggtacaaacttcttgcccacaaagagtatttagaacttccatcactttattcaaatcagcttagtcttttactctggaaaaatttagtattagcaagttttgtcaatttttactatcactgtataaggtatttgttaaaattgctggtattacttagatcttcatctcc

SEQ ID NO: 236123 - DNA, 422 bp, Homo sapiens
ctgtatagatatcctctcacactctttagggccaagttcttcccttataccaaaatgtggaactgctacagcaatcaatgatgaaaacagggcagttgatgtcccgagaaggaactcacaagcttactactcatttcattctactgctcccaaaataggctgacatgcgcatacaatagtcaactaccaccaagactgtaatcacggtaaatacacaatgacatgagtagattcagggaagtgaaagaacattcattcttttcatgtgaagaaaaagattttatcaaagaggggacaggctaagtaacttcaatttcactaaatttaagttgtgtgttttaatccatattctccgcataaaagcagcagcaaaggaaatagtgggtaactactccaagcagaaaataaactaataaaacttt

SEQ ID NO: 236124 - DNA, 1925 bp, Homo sapiens
tagctgagagcagtagctcacacctgtaatcagccctttaggaggctgaggcaggtggattgcttgatcccaggagtttgagactagcctgggctacatggcaaaaccccatctccactaaaaatacaaaaattagccaagcttgatggtggtctatagtcccatcctctttggaggctgcagtgggaggattgcttgagcccaggaggtgaaggctgcagtgagctgagatcacaccactgcactccagcctgggtgacagagcgagaatctgtctcaaaaaaaaaaaaaaaaagtaattttttaatattaggaattagagtgtggtggtcatcagttcatggctgacagaaacagcacttcctgctctttgcaatttagttcttataatggacaagtcttgtttcaaatgctgcctccttggtattctgtgtacaatggaaatgggggttggattagatgctctctaaagatggtctgagctctaaaagttttcttcctggacagcagcagtttccctggataaaggacctttttcctgagcatgtggctctgtctcagaagcagcccctctccctggttccccagtagagcttccaggctcagatgagtagggccagctggctttgctctacatagaggccctaaataattttagtggcttaaaagcagaagaatggttctccagctcctgtaagaggcagaattaacagagaataacttaaagggaacagcatgaaagaggccaatggaaagatagaaataaaatgaagaatgggggcaaccaactttcagggtctctcaaaaaaaatcctgggtcaggatcccacctgtctactgcaagctcccttcttcctgctcacagtgccttcttgccttaatagtacaaagaaaaatgctttaccatgatttaggtactatgctaagctcttgaccatacatgcatcatttaaccctcagttacaatgttggctccatgagggcagggggattttgtctgatttgtttacagttgcatcccattttctagaacaataccaggaccccggtatgtgttcactgagtatttggtgaaatgatgaatgatgacttgctgaggtcactacgattactaactccattttacagatgaatacactgaagctcctagaggttaagttacctgctcaagacaacgtagctagtaggagcaaagccaggattcaagtctagctgatcttaaagcctgctttattttagactatgtcctcacaggaaatatccatctgttttagtctattctcacactgttacaatgaaatacctgagactgagtaatgtataaagaaaagaggttgaactagctcaccgttctacaggctttataggaagtatggccacatctgcttctggggaggcctcagggagtttctactcatggtggaagcaaagtgggagcatacatctgacatggtaggagcaggaccatgagagagatgggggaggtaccacacacttttagacaacaagatctcacaagaattcactatcatgatgacagtatcaagggggatgctcttaaaccatgagaaacagccaccatgatccaatcaccttccaccagacctgcatgagcctgttctcacactgctataaagaactacctggctgggcgtggtggctcacgcctgtaattccagcactttgggaggctgaggcgggcggatcacatggtcaggagattgagacaatactgactaacacggtgaaactctgtctgtactaaaaatacaaaaaattagccaggtgtggtggaggtcgcctgtagtcccagctgctccggaggctgaggcaggagaatggtgtgaacctgggaagcggagcttgcagtgagccgagattggaccactgtactccagcctgggcgaccgagcgagactccgtct

SEQ ID NO: 236125 - DNA, 362 bp, Homo sapiens
atgcaactggtgtgacttcacaagtgctgtcctcggtcccaagccgggatgtggccactgtttgccagggatcctgctgcaaaggattccaaagcttggctcccagcccagatgcccctgcactcctgaggcagaggctctgcaagtcttctcctttctcattcccgaggctggggcttcatccttacaaagtgtccttacaaactcctccttccaaacctggcttctgatgagagggtgcagagagaaattgggctttggaggtaaatgtattcttctctgtatttcattatctcctggcacctagcactagagccagcctcgctcaatgggcataaaaataaacatttacatttgacagt

SEQ ID NO: 236126 - DNA, 1406 bp, Homo sapiens
  misc_feature (91)..(91): n is a, c, g, or t
  misc_feature (93)..(93): n is a, c, g, or t
  misc_feature (99)..(99): n is a, c, g, or t
  misc_feature (477)..(477): n is a, c, g, or t
aggtagaggttgcagtgagctgagatcgtagcactgcagtccagcctgggcgacagagtgagactccttctcaaaaaaaaaaaaaaaaaanangaagangaagaaacagatgaatggttttccatttcccaagcccagcagaggagtaaatggtataaatatgtgggatatgacaccaataaggaatgctttatttacaagtatcagaatgcctgatcaaaaatggcattactgctctcctatagcaagacatctatgagaaggtagctgctgctgtttgatggcctgtgctctgggttggcatttaggtgatatgagcatttatgattaccaagtctttccataaatttgggcttcatgtccacaatcacattcaaagacaggagactaggaagagtgcaggacagaagtgttcttccctgggctgctgctgcttttttttttttgcaagaaagaatctttggaggaactccaaantccgctccaccccagaagactcccttgccaatcatttgcctcatctctcctcatcagttgcaaggagattgctgtctggctttgctcaccttcacagaggaggacagccaagggagaaagagggtgagggcagcctgtggtagacattgtggcaacaacatgtgtcccagactggttaacactaattacagaaatttacatttcacctccatgtaggcagattttgggcctcatgaagaatcacactgcttgtgaagataataaacttctccattggtattcacagacatccctactatgtggcagactctgaattatgcacagggaatgccaaatttataagatcaatgtatgtcctggagtagaatttacagtctagtgaaatatggttagagaccaatggctctaggagttagccaacaagggactcaatcatggtgcccctcccactacacaaccaggacactccatgagggagggacttcggaagattttattcacaggacctctgtgacctcgtctcatacacatacaagaggagctttactcttctctctcttacacaatgcgtgtgactcagacaaaggttactactctaatttaacccttaccctctcccatctgagctactaatgactattttgcggctgggcatggaggctcatgcctgtaatcctagcagcttgggaggccaaggtgggtgaattgcttgaggtcaggaattcaaaaccagcctggccaacatgcaaaaccccgtctccactaaaaatacaaaaattagccaggcatgatggcacatgcctgtaatctcagcgacttgggaggctgaggtggagaattgcttgaacccataaggcagaggttgcagtgagctgagatcgtgtcactacactccaggctgggtgacagattaagcaagactctgtctc

SEQ ID NO: 236127 - DNA, 437 bp, Homo sapiens
ccaagctttctttctttaggtaacaagtgagcacattgacttattttcacagaatctcaagtacctatccttctgaaaccatttgtctaaaatattatgtaagttaaagaatcccctcattttttgtatgagagtcatagatatgggaataaaggccataaagagccacataagttgtaaacagttttaaaaatatgaactagaatgttaaagaagaaaaaactttagaaaggtcatctagctagtttaatcatttttgcagatggagaaactagggtaccaagagataaaagttgcacagatagtataagacttaggacttttaatgcaaatgtctggattccagttttttttttttcaacatttaacatttttgtgttttgtttgagtgtgagaaaatgaaacattattgcatcatctgtcctttaaattgttaa

SEQ ID NO: 236128 - DNA, 649 bp, Homo sapiens
actttttttctaaggaggaagtgcctactgctcctgaaagttaccatgcagccttgcctgtgatattaggttaaatgatacaatattgctgacaaccaattgtttcaggtctacgaaacagttttgatctacttactacatatctctcggacgaccctttcctggtttgtagaaaatctcaactcaagccaggtaaagaaggtaatccatttctttctctccctttctccttttcttctctctcctttttctctatttctttccccttttccttctatgtgtttcctgggtagtgggttctctgtctctctctctctcccctttcatcttcccctctcccccactctctctcctttttcacctctccttctgtccctattttcttggactttcttacagaaccagaagatcagtcatctatagtcctctgggctccccaaagaaccttgaactgtcacaggcactcactgtgctccttctaccctcaatgctatctctatcctctttctctaagtcatagatgagttccagaagagatcagaaagaccaggtgaactcagatcagggatatccttaagctctctgggggttggggcaggagacaaggtccacagacaaactaatgtctttcttttctttttcattttac

SEQ ID NO: 236129 - DNA, 554 bp, Homo sapiens
tcttatttataagagttctttatattttaagactattgatgcttttattattatatattgcaaacattttttccattttgtcatttgtctttttggtttagttatggtgtttggtattatacacagttgtttagtttttataaagtcaatcctgtcggcttcttcttttatcactgctcttgtcatgtttagaaaaccttgtggagaagagcttctaccccctcacctccaccctccacataatgctgttaagtacttaattcagacatgtgaaattaaattgtgcactagagggtccccagccttgctttttaccctgattattgctagcaagtaggctagttttaatttaagcttattctctcagcaaggggggatcaggaagatgcttgttgggacttatgtgtaacattttggtcccttcccctaggcaatgtatctacctttatggcagataattttgtctccattgagacccaagacagacttttatcttaagaaagagctgtatggaaccttttaccttacaaagtgccactgttcttaaatgaaaa

SEQ ID NO: 236130 - DNA, 390 bp, Homo sapiens
gagcctccaccagggaaatgtgaactttgcatttcaagaggcaagtaccaatttctctccagaaaatattgacttctggttctgtaattattaaaatgctgagcaatggtcatctaaatgctcgtagtcacaatgctaggctcctaacaggtacaacaaactctgctaaatggttgtcatttagcatctctgagcaccttcacaccacccctatagtcattgtcagagtttctaggaccttgagccttgtccactgcttcttcctcccagacatccacctcattcaactcatccacctccctgcagaatcagttgcctctctgacctataagatgagtgcctgccccacttgtggcccgtttttcaccgcctggcctgtttctgccccct

SEQ ID NO: 236131 - DNA, 1882 bp, Homo sapiens
  misc_feature (1323)..(1323): n is a, c, g, or t
tttctccagcggcccggtcgtgaagggcggtcggcgccgcagcggctccgatgcccgcccggaagagagcgctctggccccggcctcgcagctgcgggacagccgggagcggagcagagggcagccgcggccagttgtctccccagcggactgggaagggaactttatctcggcctggactcccgctgtacctttgttgggggttagtggtgaggctgcggtcgtccgagctcctgggtgtcgcgggcgccgcgatcccctcttcccgtagaagggcccagggcgctgctcgaggcgcgggaacccctggccagaggcgggcactggcgcagccccgcggctgctgctggccaagccgactgcagggatgagaaattccttgtaagagtggctggaaggctccgcggagagggaagaaactcttcccagagcgagctcccactgctccttgggaatggtgcactttccagttccagttggaccctctgggattgtcacaggaagcgctgccatgtatgaggagccctctgcaaactacagaaggatggatgctcttagcttataaataagattttgacgccctggttggtttgatgacttgtgtcatgaggagtaggggtgtgcgctgattccaaattcttccacgcggcatcctgctccggagcctcccttgtctcctagagaaagggacagggaatcgaaggatggggagtctgagggagaggcccctattccgcacgctgtctcctggctggctcctgaagggctggctgcttcccccacctggaagtccaggcccctgttcggaagtcctctccgcacagcctgacagtcccttggttctcttatgattgctctcctcccgcttcaggcctaggatggcaaggacagctcccacttaccagagccaaggcactacgccgttcctgggtgtcctcttctcctccagctcctttgtaagtcccatgctcctctatttacctagtggagggtgtcatgccaggaccctggcatatgatacaccagagctgcattgcttttccgaatctgctcaagctgtacaacatttctgagcctcagtaccaccagccatctgtggtcctccatttgtcctcttctcctacaaatacctccagcccctctcttccttcatgatgcttctagcattggaaatcctccaggacaattctgccttcaagtttcctagcctgagccactgagttgatggaggaaaatgtgatagagatgactcgtcctcctttaattttcccacttctataagcatataaacgtgccctgcaactctcctaagtgtccccagangacccgctttcccagtctctgagacaaacatttcttagccttctctcctgcaagagataacatttctcaaagtttctttgagcatgtagatgctgacaggggatgatctatcccttccaccaccaaacctccacaccagttggcactccacccttgttatagtggaggaagctgcaggctagttccagcacagtgaaccccagtagtgtttcgcttctcagcctttgccatctcctcatccctgagccatctccctgtggcagacactgatgggccaccagcactgcatcagtgaaggacttgctgccccagctgctggcgtgctgtcagcacagcctcctgcagtccgcctctccacgattgcggaaagcatctaggctgaagggtgcaggtgctgtatgcattggtttatatgcttcctgtacatttcctcaggaacccaacctgcacccgtccttctctaaagtatggttaccatcagcatccagacatactcctttttttttttttttttttttgcttctcttcatagcaaaatatatgaacagtttttaccttt

SEQ ID NO: 236132 - DNA, 2057 bp, Homo sapiens
  misc_feature (650)..(650): n is a, c, g, or t
  misc_feature (1849)..(1849): n is a, c, g, or t
aaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacnttcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttaaatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccaggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtnaatgtcttctgtttctcgctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgct

SEQ ID NO: 236133 - DNA, 807 bp, Homo sapiens
tttttttttactactattcactcacagaaaaaaaaaattctagtttcactgaaaaatgcttttggcgaagcagtaaaaattattaattttattaaatcttggcccttgagtacatttaaaaaatatattctttgtgatcaaatgggaagtatgcataaagcattttagtttggaaaccaaagtatcatagttgccttgaggaaaagtatttgtatgattgttttagttctgagctgaaccatcactttttttatggaacattatttttatctaaaataatctctgaaagacaactgtggccatacagactagtctatttaacattctctagaaaataaatcaagagacttagtcactttaaagaaatcagctattggctgggcacagtggctcactcctgtaatcccagcactttgggaggccagggcagacagatcacctgaggtcaggagttcgagaccagcctggccaacatggtgaaaacctgtctctattaaaaatagaaaatttagctgggcgtgacagcaggtgcctgtaatcccagctacttgggaggctgaggcaggagaattgcttgaatccaggcagcagaggttgcagtgagccaagaccatgccattgcaccccagcctgggcaacaaagagtgaaactccacctcaaaacaaaaaaacaaaaaaacaaaaaccagctatatcagtatttgttgccagtgattcaattcaagctttcaagcaaaaattcatcctgtgtaagacttcagtttgccatcatgagcacaatagtttcccaacacttcaagacctttc

SEQ ID NO: 236134 - DNA, 753 bp, Homo sapiens
tttttttttactactattcactcacagaaaaaaaaaattctagtttcactgaaaaatgcttttggcgaagcagtaaaaattattaattttattaaatcttggcccttgagtacatttaaaaaatatattctttgtgatcaaatgggaagtatgcataaagcattttagtttggaaaccaaagtatcatagttgcttttatggaacattatttttatctaaaataatctctgaaagacaactgtggccatacagactagtctatttaacattctctagaaaataaatcaagagacttagtcactttaaagaaatcagctattggctgggcacagtggctcactcctgtaatcccagcactttgggaggccagggcagacagatcacctgaggtcaggagttcgagaccagcctggccaacatggtgaaaacctgtctctattaaaaatagaaaatttagctgggcgtgacagcaggtgcctgtaatcccagctacttgggaggctgaggcaggagaattgcttgaatccaggcagcagaggttgcagtgagccaagaccatgccattgcaccccagcctgggcaacaaagagtgaaactccacctcaaaacaaaaaaacaaaaaaacaaaaaccagctatatcagtatttgttgccagtgattcaattcaagctttcaagcaaaaattcatcctgtgtaagacttcagtttgccatcatgagcacaatagtttcccaacacttcaagacctttc

SEQ ID NO: 236135 - DNA, 471 bp, Homo sapiens
cccagcattatcggtggacggttaccaggggatcccgagggatgtgtttccctgtgaccctttgggaaggaaaacttggttgcctcagtaaccgagtttggcttggatgcaatgatgcagtgagtgttctaggtgagcctggccgagaaagaggctgcagttgcactagggggtggattaacttttcttattaccgaaccaagacgtgaaaggaaagctggggaggaggtggagttttgctctgtgtttgtttttttactatttcagagaatacgaactaaacgtttttgcgttagggtttgtcttccaaatgcacgcccgggctgccatacatttaccaaagttttactactcaccacttagttcatacaaaggtttgaagctgatatcctagagttggaaggagcaggggacagtgacagttttgtatttgaggaaggcctgagaaacaaacgtgaaaaggcctttatt

SEQ ID NO: 236136 - DNA, 1813 bp, Homo sapiens
acttgagctcagaagatcaaagctgtagggtgcatgactgtgctctcaatagccactgcattcaaaccggggcaacacagcacaacccagtctcttaaaagagattcagcatcctggagaagccattggaaagagtagagaaaatgccacggatgaaatatccctgctgctcagactccactgacccaagtgaagttggccacagtctaacaaatgggatactgcagcggggttctggttctgaaacagatctggtgaatggtgctcgaagtgatcggctgttgaccaggtgtggcttctctgttgatgttccaaggacctcatcagcagaggaagaagcattattactaaccatctttggcaggatgaccttttgttgttgtcgttcaaccaggtctcctttattactctgcaatctctcccttttgttccctttccacctaaaactcggatgtctctgccaccgataagcacccagtggctttcccagattggaaacagcagaatcatttttcttcctcttgcttttcactggaccacaccatggataactctttaaacttgttcctatctctgaatctgcataagcaggttctgacaaagatcttcgatagcttggaggacaaggtgatgtttgtttcttaaagatgctcatcttccctgactccagtctttaacagtctctctaaactttaagattcctctactctgcagtctttgcagttgaaccacacatgtctgtgcagtccaaaacatttgactgcttaagcagctttctttgtgtggctttgaaccacagcagatgttgctgcttaagagctggtgtcatgttattacgccattttccaagatctcaaaaacttcagcagcacctaaaaacctcttgcctgaagcaaagtatcatcagagtagagacaaagtcaagatttccaaaggatcacctcacttcctgcagtaggttacatttctgtaataggctttcgggaaatgatttttttaagtgaaataaaaacaacaacaacccaccaacacctttatggaccagtagtagttaagtgttcaccatgcaaatgatagcgagttaaaaacagattgtgaagaaaatcaaattactcaagctgatattgatactttccagaagaagaaaaaaaaccttgcctagtcttggagtgacaactcttcagaagagttttgatggcctgcatttcagaagtttaatttcaagcaaatcaatgctatttatactacatctctcaaagttaatattgtttttcaaccaataggtaaaattcaaactggtactgtaagaggaggaaaaaagccaaaagaaagccaacaccatttttagtgtaaatatattacactatgaagaatttaaaaagcataaataggaagaaaaagagcagaggcagagggtatttgctataaactacagcaaaggaaaaggaaaatcttgaggcaagatcttgtggcaactggaacataggaatgtacatacttaaaaaatttctggaagaagaaagtttgctatataaatccaattgggataagttggctggaaaaatattccctatctgtttaaccaaagaaattcctttattcctctttgtgctccttacaactttaaaaaagacctgactacttaaaatttgttaaagcaagtaccttatactgaaccaagatcatgaatgccaagtttttgctggttaagttcttttcaactgcctgctcataagcccctgaaaataggggtttcaaatggaaagcctcacagacttcagactaccaataaaacagatataacagtgcaatc

SEQ ID NO: 236137 - DNA, 448 bp, Homo sapiens
aatcactctaagcacgtctgggtatatatcttctaagtcctcagaatgcagttgtgggagctgccatcttgtagcacacatcacaagggagagtagagtaataaatgtttcaagggacagtagagtaataaatgcttcgaagtggctaccttgggaagtggctttaatgagcactgcttaaaaagctgggcccttgttctgatcagaaagattcttcttcaaacctagaatactcaactatgattatctgtttactaaatgatttaccatcatggaataataattaaatgacatttatgttgtctgaaagagatagatacatgtatatttttacaagggtgttgattccctttaaagaactattatcttttctaatcctacttacctcccagagatgctgtctcttcaaacaatcataatacctaataaagacagtatgaggccgact

SEQ ID NO: 236138 - DNA, 480 bp, Homo sapiens
ccattgacttggtgtagggcattctctctaatccatcaaagagaaggaaggcatgtgctataggcatttccggctatggttttccccaccttatcagcagaagatatgttccaagatctctaacagatgcctgaatcctggaatggtactgaaccctatatatactgtgtttcagtctgacaaccaagatggctactaagttggcatggttagcttatatagtgtggatacactggacaaaggggtgattcaagtcctgggctggatggaatgggacagcacaagatttcatcactcagaagcatgaaatttaaaacttataaattatttatttctggaattttccaattaatattttcaaaccacaggtaactgaaatggtggaaagcgaaaccatgattgagagggaattaactatattgttttgtgaactttcacacttacctttagaaggttggagaaacattaaatggtgtttca

SEQ ID NO: 236139 - DNA, 561 bp, Homo sapiens
agctctccaccaccccatcgtgcagacgctggtcacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaaacttacatgattcttcatcgtcccaagcaagtctgacttgggccctttattgaaactctgtttcctctcccgctgcctgtctgcctccctctcggagtgcacctactgagcaccagccctccattccctgccagccacacccagaaagcaatggggctttctgggaaggcagaaatattctgtgacctgggctattcagaggggtggcgtgagtcgtgtgtgcctagcaaacactcaggacatggccggtgagacagaagggctgagcttttgtcctagctaatatattaattaattcattcattatttattttgagacggagtctctctgtcgcccaggctggactgcagttgcgcagtct

SEQ ID NO: 236140 - DNA, 1526 bp, Homo sapiens
tggagtacagtggtgccgtttcagctcactgcaacctctatctcctgggttcaagcgattttcctgcctcagcctccctgtagctgggactacaggtgtgtgtcaccacgcccagctgatttttgtatttttagtagagacggtttcgccatgttggccaggctgctttcaaaaccctgacctcaggtgatgcgcctgcctcggcctctccgtgcccagcctatttcctttgatttcttaaaccattttgaagaaggcccttccaattaaagaacattaatttctctttcaaattgaatataccatagataaatattgaaaaatcttcttactattgtaaataaatgttttaccttcatttataacttacctatatagttaaagcagaatttatgcctaccttaatttctggtttacatttaaaattgttattctggttattaaaaataaaaacctaaagagggcagtaataaaactacagaccagtgtcactagtttttactcagaatttacatattttttttttttttttgagacgcgacagagtgcgactccgtctcaaaaaacatatatatatatataagctcaggtggggcacagtggctcacgcctgtaatcccagcactttgggaggccgagacgggtggattgcaaggtcaggagttcaagaccagcctgtccaacatggtgaaaccccgtctctactaaaaaaaaaaatacaaaaattagccgggcgtggtggcgggcgcctgtaatccagctattcgggaggctgaggcaggagaattgcttgaacctgggcagcagaggttgcagtgagctgagatcgccccactgcactccagcctcagcaacagagcaagactccgtcttaaaaaaaaaaaaaaaaaaagaaatataagctcaaatttctgtttgacttccttaagctacaatatgaaatacgagagaccaaagtatggtgatttctgttatctttgataatagttacttccaaatcagccaaatctggtaataacagaaaaagcctctccaagcactagctgcaatgaaaaaataataatatgacaacataaatgactcattaataaagattcttttgatagcttttaaagccaaactctgctattaatgcaaattgagaagaaaagagaaagaagaggcgaattaaggaaaatagaagtagtatccaaacaagaaacagatcaaccaagagaaaatggttaacagagattattttcaaagagtaatgccaacaatatcagcaaagtaatttaggggccctcagtataaatgtgagctatgacctttgaaggcattttcttagggaaaggtgaaagaaaaatgaaaacatcatcatttgtaggtttcagtaaccccttcccagaattttcctgactcttaaaacgaggtaccttctctgataggaaggctcccctagtaatgattcagaaataacattttatgtgctccaagcctacgatgacgaataagtttttgtttgtttgtttgtttgttctgaatgt

SEQ ID NO: 236141 - DNA, 1094 bp, Homo sapiens
atctacattttacagatgttgagagtaagataggattcagaccttggaatctatctcatttcagagctgatgttttgtttgcctgttttgagacaaggtgtcagtgcgacagagtgcgactccgtctcaaaaaacatatatatatatataagctcaggtggggcacagtggctcacgcctgtaatcccagcactttgggaggccgagacgggtggattgcaaggtcaggagttcaagaccagcctgtccaacatggtgaaaccccgtctctactaaaaaaaaaaatacaaaaattagccgggcgtggtggcgggcgcctgtaatccagctattcgggaggctgaggcaggagaattgcttgaacctgggcagcagaggttgcagtgagctgagatcgccccactgcactccagcctcagcaacagagcaagactccgtcttaaaaaaaaaaaaaaaaaaagaaatataagctcaaatttctgtttgacttccttaagctacaatatgaaatacgagagaccaaagtatggtgatttctgttatctttgataatagttacttccaaatcagccaaatctggtaataacagaaaaagcctctccaagcactagctgcaatgaaaaaataataatatgacaacataaatgactcattaataaagattcttttgatagcttttaaagccaaactctgctattaatgcaaattgagaagaaaagagaaagaagaggcgaattaaggaaaatagaagtagtatccaaacaagaaacagatcaaccaagagaaaatggttaacagagattattttcaaagagtaatgccaacaatatcagcaaagtaatttaggggccctcagtataaatgtgagctatgacctttgaaggcattttcttagggaaaggtgaaagaaaaatgaaaacatcatcatttgtaggtttcagtaaccccttcccagaattttcctgactcttaaaacgaggtaccttctctgataggaaggctcccctagtaatgattcagaaataacattttatgtgctccaagcctacgatgacgaataagtttttgtttgtttgtttgtttgttctgaatgt

SEQ ID NO: 236142 - DNA, 506 bp, Homo sapiens
agaacccagatgatccagacacagtggatgtcatcatgcatatgctggatcgagatcatgacagaagattggactttactgagtttcttttgatgatattcaagctgactatggcctgcaacaaggtcctcagcaaagaatactgcaaagcttcagggtcaaagaagcataggcgtggtcaccgacaccaagaagaagaaagtgaaacagaagaggatgaagaggatacaccaggacataaatcaggttacagacattcaagttggagtgagggagaggagcatggatatagttctgggcactcaaggggaactgtgaaatgtagacatgggtccaactccaggaggctaggaagacaaggtaatttatccagctctgggaaccaagagggatctcagaaaagataccacaggtccagctgtggtcattcatggagtggtggcaaagacagacatggttccagctctgtagaactgagagaaagaataaacaagtcacacattagc

SEQ ID NO: 236143 - DNA, 668 bp, Homo sapiens
ggcccaaagccttccgggagtcgtagtccttccgcccgctcctcgtttctttggaggttggcccttccagctccagttctgcccaggtcacaacgccgacgacatggtggacaccgtgctcatgaacttcctgcggggcggctggcccggggcgggggcctgggctctccgggctaggggggcgcccttccgcgctgccgcccgctgcagttcgcctcgcaggaggtggtgccgtacgggcacttccgccgcctcgactacttctcagaagagaggagcgcccgggacctgctcaagcgcctggaggcgccgcggccgtcggcggtgctggacctcgtgcactcggccgaacgcctggcgctggcctcggccgcgcggcccccgcgccccggcgcctgcccccgctgtggggcgctggccagccgcgcgctctgccaggcctgctccctcctggacggcctgaaccgcggtcggccccgcctggccatcggcaagggccgccgggggctggacgaggaggcgacgccggggacgcccggggatccggcccgggcccccacttccgagaccgtccccaccttctagcgactccgggcctcccgccgggatccgacgcgcccgggtgaggtctgcctgtaaatgacactgtgaataaacccgttacctta

SEQ ID NO: 236144 - DNA, 417 bp, Homo sapiens
ttggtcccacactgagtcccaactttgacctcagcctgagacacaacctggttattgtcctggtagagacagttccccgaatccagcctctgcccaaaccctcctcctagacatggctgagccctaattttgatacaaaatacttgaattcatcttcagattcagttctgatcctatactgaactaactgaacactaccagggatctgactccctgatattcgctggcgtctccctgcgtgttctgaacctatgctgaccagcaccagaagggttcagaggggtgatttcttgccttgggatgagagagcaatgttagggatgaccagcagagggcgtgcaacatcaggttctagaggcaagcgtccaagagcccacctgtgagctaaaaaaattaaagttctcgtttttgacacca

SEQ ID NO: 236145 - DNA, 363 bp, Homo sapiens
tctgaatacttaacaagtttaatgagctctcagatgatgccaatggttctccaccaaggaccacgccttgaggagcaaaggtctgtagatacttcctattctctttttgagcccctccaaccaggctttacctctctccattgcccccttgggttgctacaaactgctctggcccattttaatgtcagtgctcaattcttcttgactgtagaatttgactctcttgagaggctttctcctcttgtcttctaggacccctcctacctcactgattttgcctcctttgtggatcctctccatctttccggagtctacacaatggaggttccagtgtggagatatcccttctctatccacagtctc

SEQ ID NO: 236146 - DNA, 358 bp, Homo sapiens
agccgggacgtgacagaggaaaagaggctgactctgagccggaagactcctgccagggctggcaggaacagtgccagggcagcacacggtgaccctgttgcctccccagacaaggtggggttttgcccactgctctcctgaagagggtgagacctaatttcacctcctccctcttctctgcaccttgcagaagtgttgagagaaacgtccacttttcctccgacaagatccaagaggaggcgggccagggacttggggagtgatgaggaagtactgtgtattttaatataatgccacatttgggaagctaacacattatttgtttctagaagtaaagctccagagaatcttatgggct

SEQ ID NO: 236147 - DNA, 315 bp, Homo sapiens
gcgatctgttcgcctcagcctcccaacgtactgggcttataggcatgagccaccgcgctcggcccccactagtcctttaacctcctatctccctgggaaatatataatagtaatagccaccgggcgcggtggctcacgcctgtaatcccagcactttgggagggcgaggcgggtggatcacgaggtcaggagattgagaccatcctggctaacatggtgatactctatgtctactaaaaacacaaaaaattagccgggtgtggtagcgggcgcctgtggtcccagctacttgggaggctgaggcaggagaatggc

SEQ ID NO: 236148 - DNA, 352 bp, Homo sapiens
gctacctctgctctctcttctgtaagattatttgtatgttaatttacatctgttaagagcctgccttgtgaaaacaaaaaaaaaaaaaaaaaaaaaaaaaaaaaaaaaaaaaaaaaaaaaaaaaactcgagactagttctttctctcctcgtgccgaattcggcacgaggtcaaaatggataacaaaaggaacacccaatacaaattggatcctttgaatcctccaagtctgaatttcttgaggcagtctgtgagcactcattggccgtgtctttaaagtctacatttctagttgttcttcaaggcttagtcattttctatcacgatgctcttacttgggtgttcagcagcc

SEQ ID NO: 236149 - DNA, 237 bp, Homo sapiens
aatcaatgactatttattgcaccagacagcatgctggatagagatctcagtgtgactgtggccttcagtgaaaaagaaagagagggggagagagagagagatctcagaactgaagccatctcatatcccaaagccagcctgacttccacatcgtgttcttgaggggcagactgcctcttccaaatccaaggacctggggagaggaagctgctctgggtgctggaatgaagggtgaat

SEQ ID NO: 236150 - DNA, 4099 bp, Homo sapiens
  misc_feature (937)..(937): n is a, c, g, or t
  misc_feature (2383)..(2383): n is a, c, g, or t
aacccatttacaaaatggatcactggccagactcctcactagccgtgtctatgagagagtgcttgcccatccccgaggtagaagaacagcaccctgaggtgccgctgccccagccggcctggtgctgacaggctggaagaagtgagttgccctctgtagagacccccagagcagatgtgagaagacggccctagtgggagtgccatctgacaagggtcggggagctttttatggacaagggatgccactaaaaattagggatcctctgttttatcctggactgctagctccttttaaataataagtcttatcgagttctttttttttgaggcagagtttcactttatcatccatgctggagtgcagtggcgcaatctcggctcactgcaacctctgcctcctggattccagcgattctcctccctcagcctcctgagtagccgggactacaggtgcctgccaccacgcctggctaatttttgtatttttagtagagatggggtttcaccatgttggccagggtagtctcaaactcctgacctcaggtgatccgcccacctcagcctcccaaatttctgggattacaggcatgagcctctaggcccagccagagtttcattgagttttaatcaaagactgtcttgtgatctgtgattaatccagactaggattcagtaggcaaaagagcagagggccacaaggggagtaccttgtcactgtccatttctccccatcctccaaagcccaaggcacccactcatctactttgtgtccctatggatttgcctattctggacatttcctagaaatggaaccatatggtatgtggccattcgtgtctggcttctttcacttagagaatgtttgcagggttcatccctgttgcagcacacattagtactgcattccttttttagggctgcataatattctatcntcctttgatgtttatttcagcattttctacacttgtacagcaaacacaaacacacaaatgacgcccctgacttctgtatctgcagtcatccttttccctcacatagctgcccagctttgcccctggtttctttctgatattgactcgatgtcacttcaccaacaccttccctggctaccttgttaacagtggcaaaccctgtcctatccttccctggttcccatttgtgcttcaaacctgttatcttctaacttactgtatgtaccacgtagttttcttatttatttcttatttatttgcccacctctcccttcataagaatgtgcaggatacactgctgtatcctcagtgcctgacacagtgccaggtccatggtagctactcaacacgtggttgttgaatggataaaagttgccggagcagaatatctaatcatttttgcgacccactgctaatttcacagactcctccttatgtctgtggatagtggcctcattgattgatgctttaagaacataactggggccaggtgcagtagctcatgcctgtaatcccaacactttgggaggctgaggtgggcggatcgcctgaagtcaggagtttgagaccagtctggccaacatagtgaaaccccgtctctactaaaaatacaaaaattagctgggcgtgctggcgcgcacctgtagtctgagctactcaggaggctgaggcaggagaattgcttaaacccaggaggcggaggttgcagtgagccaagatcaccccactgcaccacagcctgggcgacacagcaagactctgtctcaaaaaagaatataactcatccaaggaagggttgcagagagctccacgtagagagcaagatagttgggaggagaatggaggagagggactggctttttacagcttaggtttgctgatgaaaaaatgaaaagcataaaaattgctcccatctgggctctcctttgattttatttttgtccatagcaccaaaagaacacagagtaatgaggatatcttgagtgaattgctggagtactgcagacccttgaataattctggttaatctagacttctttgctttcttctaaggatctgttcagttgggaaaccctgcttgtcgacttctggtaacctctttgtcttggccagttttaacagcttgtttctgctgaaccagccaatacttaggaagctgtgtaaggctttttttccccctccttcttcttaatgagtttgattcagaggggaagcccaggctgaactgaccttccggaaaatgtaaacctgtttaacaccaaaccttacacagccagaacatgctgtgcccaactctgcctgcccgccttgggctgtgaatcggcacctgcaagtagggctcaagggtgttacagtcggggtcctacctgcctggggtcattcttgaccacctcaagcagacagagncaatttctaggcaacatgatttgtaaagatctgacctctaggttgggagtaggcttccagtttgagaccatgagctgctggaatcgtagacttccccagttcaccttggaagagtagagttcagttctaacagagctgccagaaagaagggctacggctcctcggctgtggctcttaccattgtccctccttgagctgactctaactgccatttccctattatcgcatcccttgcagcttagaaatgtatttttaacaatatatctgggttcagccactggaggttcctcacatggtggaaatagcatggagtcgagcagacagaggagggctcaagtgtcacctcccaccatgtggcgtctgtgtgaccttgagaaagtgacttaacctctctgaacttcagttgtcataatagctaatatctcaaaaagctcttcattcattcattcactcactcaacagacaactattgagtgtctaatatgcccccaggtacatgctaggtgccaggaaaacatactcaaggaaatttgagtctggttgaggaagacattagagcataaaagccattacggcaccacatgatcattgctttggcagaggtatgtgtatgaatatctgggagaactggcccagaccagggctgggaattttgggaggcttgggatagccctggtgaaaagaaagttgtttaaggcaggctgcagagtagacacctcagcttcctcctctgcttccgcccctcctcttccccacaattcagtttccccaagtcaatctgcacactgcagaagtcctctgggggaaagagcagagctctaaataggaccagccctcctggaaagacagaaagtctagatctgaagtcctcacttctttctggaaggaaacctcgcagagcagataccaaattgctcccgcaagaggatccgtagagagaaaggccccagctgcagagaccgtggcccagccgcagccccctgcatgtctcgggtcaagcggagaagtcaggccctccaagtggaaagtccaggctggagcggggcaggcccaccgcctcctatctctgctggctgccgccacaattgcagagcagctggcgagaccgcaagcgttccttctcccagcagcagcctgacttgaaaagcaaaccacaaacccctggcctgatgcctgctcacccgcctcactccctggcaccttccaaccaggggagcctggagctcacgcgtgaagttgcagcagcaagcaatctgcctcgcttctggtgcccaccgaaaccaaggtctgccagacagcagcgctgggacctctcccctccccagcaggatgggccggctctggaagcacgaggtgttccaaagtgcaaacaagctgctgttaaataattattcccaaacgccaaagcccttgctggtttgcttgcttgcttttttctttttttgcctcgcacagatatcgctagggcagagtattgacatttcgttttctttttgttatgggtgataaagcacggtgtttcttgtgagtgtatgcctgtatttccctgcagagctggttgccagtccattttcttctatcccatccccatcttccgtacagtccgatgacctccacagaggagatcgggatgtctctatgatgccacgtctctggatagagctggagcaggcataagagaaatgccaactgccaaccccccccgccacccctgga

SEQ ID NO: 236151 - DNA, 607 bp, Homo sapiens
gtgctcaaagctcagaaggcaaaggactccttgccactcaacagtatcagctcaacacctcagccaagaagaatcagggagcacaggcacacactcaccatgctgaacagacagcgaggaccacatttttattatctgattcctatttgaccatctgatgtgcaaattttacctatcatgttgcctttgctccagatctaggtgagatcagatggaatggaggctccatctggtcttcaggaagtctcaagttttcactgatctacataaaatctcagagcaaggcaatttggattgagtgagtccaaacccagtgccttctcctttgaccctggcacagatacactggccaagagatgggtccaaagtcatcccactccatcaaagccatcactgtcaggagtgataacatagcccacatttttcatatgttttcaagatctcaaaatttctactgaatattacaggagggcaggtgcctttatccgccagtacatcatcttcaatatcagtgattttcaatttcctgcttccattcaattgaatactttgttggaaaaaattacatgtgaagtccactatagaaaataaatttgtaacaactggg

SEQ ID NO: 236152 - DNA, 2565 bp, Homo sapiens
  misc_feature (1403)..(1403): n is a, c, g, or t
ttgctcaccactgaaaaatgtcagtgtaaatgtgaccgctttaaagatgagtcaagtaattcttggaacagggaaaaaaatgaatttgccaggtcaggagttcacctgcctttgtcagagttgaacccaaccactcttgacctcgactcactcccttagggttaagaaagcccaaacacattcctgagcacagagcaaacactcccatgtcactgaaaagaaacaaaaggatgctaaaaagtgctcagacctgatcacattttttccaatattttttccttttttttttttttttttgagacagggtcttgctctatcacctaggctggagtgcatgtttttgagacagggtcttgctctatcacctaggctggagtgcatgatcatggctcactatagccttgaactcctgggctcaagccatcctcagcctcccaagttgcgaggactacaggtgtgcaccacaacgtcccagctactttttaaatttttagtagaaacgaggtctcactatggtgcccagactggtctcgaactccggagctcaagtgatcttcctgctttggcctcccaaagtgttagaattacaggcatgagccacctcgcctggctggtttttgcctttcttatagaccctgggcatgtaagcatttattagtttgcatttttgaaacagtaatttcaatattttagtgccaatgtcaggccgcttaaacactgtattacatatcttcatctgtctggtggaactattggtgtgatcctagagaactgagtcctattctgccattcatttaaagtgttttaaactctaatctctctacttaatgcacagtagtcagattattctcttaaacatttgcctagtagaggttaaaatagtttaatccttatgaagatggaataacttcaaactcacattgtggcacttagatcttccaccaagacttcatccgtgaaatccacacctccctgttgggttcccaattacattccaaatttacatttcttttgagaatctctgcatactccagctctgtcctgttgatcctattctagaagtgcttaatgcagcaagacacagaaagttaaacgcaaattgctgcaaaattcaccctcagtggaggactagaaacacaacatgtccaatttaaagctcagttcacaagcagttcaattctgctggcatcagaaaaggagattctaattaaacattcttagggaaggacatcaaatgaggttaatgggaaacgttaccagattaaaagcagttttttgacaaagtaacagatttggaaattctgactctctgaaagccttgatttgaacctcaaacttgatttcaccatgagaagtggggatcaagggcctgcgcagttcttttcctaaatcgattcggtgcnccccaccccgacgcaggcacaggtccgcaaccagatagggagatgcctgaatttcaggctacctttgacaaagctttcttcctccctccctccctttgcacgctgcatcccacgctgcctgcttaaagcgccctcatgtgtctacagatggtaaaacgtttatttctcaacagacattccagtgatagcatccaatgacctatgtaacggcacccttttttgctgtacgcgttttttgagatggagtctcgctctgtcgcccaggctggagtgcagtggcgcggtctcggctcactgcaagctccgcctcccgggttcacgccattctcctgcctcagcctcccgagtagctgggactacaggcacccgccaccacacctggctaattttttgtatttttagtagatacagggtttcaccgtgttagccaggatggttttgatctcctgacctcgtgatccacccccctcggcctcccaaagtgctgggattacaggggtgagccactgcgcccggccccagtcacttgttcttaagtttcttaagcaaactataaaatagcaaaagaccaaaaaaaaaggaaaaaaagcagttcgcctaatacattgttccagcatttccttgaaagtactgagccatctcaattgctctgattttgtgagaaaattatgaagcgttgcaaagtcccagtgattctcttgttacttagctaagaatttgaaatgtaatttaaatactattctttacaatccattataaggattttaaaatctttttgcttctttaataaattctaacaaagttttgtgtttattcttagtttcaaagaaccaggtccccagtcctgggaggctgctcagctggccaagccagtgtttaatctcattatagcagccctgcaggcaaaggcactctggtctgaatctagtctatctgagaaatacacaatgctgctctcatcattcaaggttcttacacattaatgattaattatcagaagtccctttgtctgagaactctgttttttcccacagctcagaggagcttctggggctgccactaagttccagtttcataggaagaattgccacaaacaacttttgcagaataatgagtatattccaaagcaaatttgtctgagaaattatgtagacttctggca

SEQ ID NO: 236153 - DNA, 406 bp, Homo sapiens
gagattcagaaaagtgatgtagcaataggagcaaatagcaacttaactttagggtagaaaggagaaaacgttaaagagatacagtgattttgacagccttttcaagtattcaaggcagagcaaggttaccctgagcccaggttcagaaaatctactccttgaaggatttcactacatgttattccatatgtcactgtatctgcctggcattaccccttcttaaaacacacattaaagtctcttctagagtttctacttaaagaccctaaatttcagcttatctgtgtcagttttcagataaaaagttattttggaaaagatgaatcttccatattaaaaatatatgattccaagaaaatgagtttttttcatcagcaaactagttacactcagcactatctactta

SEQ ID NO: 236154 - DNA, 3126 bp, Homo sapiens
  misc_feature (784)..(784): n is a, c, g, or t
  misc_feature (847)..(847): n is a, c, g, or t
  misc_feature (1738)..(1738): n is a, c, g, or t
  misc_feature (2939)..(2939): n is a, c, g, or t
  misc_feature (2947)..(2947): n is a, c, g, or t
  misc_feature (2954)..(2954): n is a, c, g, or t
aaccccctgtcttcattatgttctgacccaccaggatagggcactgtggattttggttttgaagcttgtccagagtcactcaagagagacaaagcggccattctactgtgtgctacccaacacccaccaggtaagctgctgtgtgccaggatgaagcccctggaagactgcttggctttggtattccagaatttgcttaaatatgttgtacacacacccctgagtttaaaacagcaaggctgagaataagatcttcagcaggcacaagggtaaaggaaagagatacctgtttccagtatatcatgatgttagtttgcttaactaagtcccatttaacatttaggggatcaagatttgggatgttttcatttttattgaagaaatacttgacaaatattttgaaggcctaatgtttgtatgggctatgaaatctgctatggtaaatgcaaagtatgggacccaagaaatgtataatctgtttgggaggacaggacatgagaattcaaacaagaatataaggctacgcatgactaagtacttaaggggtggcatggacagcagtgaggtagggttttggagaagagaaagatggattggagctaaaattattaggcaaaacttcatagaggctggcattgaagtggcaggtggataagtgggaggtaggtaaaggagaatgactcccaattatggcttaatgcttccattaaaccaattctacataacacatttattgtgctataatcaggagttggaatacgtaaatcttcaattcagaaagacngttcatatcaatattggaaactaaagtcctaaagaaggctggtgtttgtttattgtgggtaanctctggcttgtcagatttcatcccacttgacttccttctcttcccttccttagcagtctgttcaccatcagtaacttctactaaatgttcactaatttttaacaaccttgcacatagagagtgagatttaagttaactgtttttgttttagaattctgtaaatgttaaatagaagagaggcatgaaatcatttctgataaaaatagaagttaaatctgtgttaaagggttttgtggcccctttctccctagctctgtctctcagctgaataggttgtgtcagggagtgacaacgcagtggtgtgttggtgctatctgtgttgagtgaccggcaaaagaccacaaaaggaaatctttagtttcccctccaagtcttgttctttacatgagagcataggaagcctccagaagacttgcatgatcctagtattgagtcctcttctatgcatctatcaaagaaaatgagagaatttcagaggggctgggattatttatttatttatttatttattttagagatggggttttgccatgttgcccaggccattcttgaactcctagactcaggcaatcctcccacctcggcctcccaaaatgctagaattataggcatgagccaccatgctcggcctggaattcttatttataacccagtgacacaagactgtaataaaactattaatagataataatcaacctcatcatttggtcagtttctcttgatgcaaggccagcaaataaaaactttgtaaccacttaaaacaaacaaaacaaaaacaaagcttccttcactcagaaggaaagtctgcctatgaaagccttcacccatttattccccaccacccccctccatgcacaccttacctactttccatattatccactcatccantggggaatgagtatcactcatgatgaacaataatggattcagacccagccttagtggagtttattccccagcaagtctagttccgattgtcttttaaggcctgtcttcatgaattctttcctagcctttagctagaattaatcttatccttcttcataatgctaaagcaagaatcttgattttctattaatattatattatcaaccatgtcctgtgttgtatcatagctactttgtacatatctttttccaccaatagatcctgaatttcctagtgtcttcatatcatccttacacatttaagtgctcattatggttgaattggattttttttcctcacttgaaaaggcgtttttcaaccctttagctaagtgccagcacaagttagatcgtgtgacaaagaatatgtagaaagggcattgtaaacaaaagagaaagttggaaagttgcctagagagcatggcaaagtgcttggaatggttggcaccctgggtttaaatgacggagtcataggaaagaagtccagataggtaagcatggggctggtgacaaagaactgagctttacagatgaggaagatgagacacatagatgtcatttgatcagcccaaataataaaggaattagaacccctcacctgattatccacaccacaggcccagcaccctcacgtaagctcggacagtgattttatgctaccatgccaattcccagggcaattggctgggaaaagatgaagagagtgacagagagtgtctatgacactaatgtctgtgtggttcggccacattattcctctctttgtagtgatcgtgcaacttgaagaaaggcaagagcaataggaagcaaacaaccaagaagcttaggtgtgttgaagacaacattcagcactgatctgtggtgtgctgtagtggccaatctgagtccccagttagtgtgaaatagactagcctgtgaattacactctgaagcaaatgccaagagttgccaattttgccatttgcttggctctttaccttggatttcatagaaccaatattttaaatggtacctgggctaaaataatcagcaaaggtattgagcagataagttatcaaaaactacaggccaggcatggtggctcatgcttgtaatcccggcactttgggaggtggaggtgggcggatcacctgaggtcaggagtttgacaccagcctggccancatgatgnaaccccntctctactaaaaatacaaaaattagccaggcgtggtggtgggtgcctgtgatcccagctactcgggaggccgaggcaggagaatagcttcaacccgggaggcggaggttgcagtgagctgagatctcaccactgcactccagcctgagtgagacagagtgagactccatctt

SEQ ID NO: 236155 - DNA, 396 bp, Homo sapiens
gctgacagcagggtgagcttggcattggtctggcccttggttgtgggccgagtagggaggacaggactgcctcctctttccctaggcctcatgacaagggccaggcagctggacacgctggactctgaggcccccaggtttccctctaattctctaacatgtttgctttccacatcctggcctcgcttcacattccagctcattaggcaggacagggccccatttctccaggactctgccaatttggaaaccccaagggccccgggactggggttcctcctgctccgacatgacccgagcttcctgataggtgggaaccgccaccactgtgaggatttcacttcctggctcctggcctgctgggaacccctcacccgcaaccaacatccacagcag

SEQ ID NO: 236156 - DNA, 419 bp, Homo sapiens
ggtcaacatagtgaaaccccatctctaccaaaaaaaaaaaaaaaaaagttggtgcatgcctatggtcccagctactcaagaagctgagggagtttgaggctgcagtgagccattatcatgccactgcactccagcctgtgtgacagagtgagaccctttctttaaaacaaaagaacaaaagaaatgataaatactcaaggtgatgtataatttgaaaaccctgacttgatcattacacattctatgcatgtaacaaaatatcacatgtactccataaatacgtaaaatatcatgtatcaattaaaattttaaaaagaatttacagtaacacagtggagcaaaaaaagaagagcacttcacagagagaatcactggggagactggtatacctgcagtgtgtggaatggctaggaacaaaa

SEQ ID NO: 236157 - DNA, 524 bp, Homo sapiens
  misc_feature (287)..(287): n is a, c, g, or t
  misc_feature (290)..(290): n is a, c, g, or t
  misc_feature (333)..(333): n is a, c, g, or t
ggcaatagacggcgcttatttggcctggaatggttcaaggataatcacctgagcagtgaagccaagctgcttccattggtgggtcaattttgctgtcacttaataaaaaccattgagccctgggactcttaactttgagaatgcattggacaggctctaacatgttccccgtgatccccagctcctagaattcacaccttgcgtaatctcctcctattgaatatgaatgggacctgtcactggcttctaaccaacagaatatgtgaaagattttggaatgtcacttntgncattatgttacatagattgtaataccctaatttcaagagaacnttctcccttgttggctttgaggaagcaagcaaaaaggtgagaaggacccagttgtcaaggaattgagggcagcctctggctaacagccagcaagaaactgaggccctcagtctgacatcccacaaggaaatgaaggctgccaacaaccacatgatcttggaggcaggtctttctctagctgagccctgatg

SEQ ID NO: 236158 - DNA, 478 bp, Homo sapiens
ctttacttgtttataaacgaatgtaaagtcttctaatatctcacccctctgagaaaataaatagtgaatttttgatgtttctggattttgtgacatgcttttaatgtcatatgaatatttacctatgttgtaatctagaacttctatgatttcatttgtttacatttaaaattctgatggatctggaaatcatttgtttgcttcagcataaggaaagaaatgatttttcagtttgatgtttttccaatggataatcaaatatactatttgctaactaatccaattatgttcctattgttttatgttgtcgccagtaccatacactaaattccatatatcctctggtataatttttgactttatctttctattcctgagcttgtggcaaattttaaaattactatagattaataagagctttattatcaagaaatgcttgctgatttaaaaatactcaatataaaagtgaataaagctg

SEQ ID NO: 236159 - DNA, 383 bp, Homo sapiens
accgcatggcgagcgtgcgggccaacacctattgccgcctcctttcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgaccttaactcgggcgtattcaacaaccagtagaacgccatcatccaggagatcgtcaagtacgacggcgagatggtgcagcaggccgagctgggtcagcgcctgggcctcttcccgccgccgccgccgccgcaggtcacctcggccatcgccacgctgcagcaggccgtggtcatgagcttctgcccgcaggtggcgcggccg

SEQ ID NO: 236160 - DNA, 289 bp, Homo sapiens
gtaatttgtttgtattaatctaacccttttatcatctcctccactgtttccttttctatgtccttactctaactgttaccattttacaaatgattattttttatattgcatctatttacttgctttgtttccctaatcgataatgactccatttccaattctggatactcgccttttatttactatcccccaccccatcaatctccttatagatgactttgattaatttagtaggatgcctttgtgatggtggacacattaaatttttttaaaaatgttattttcctcc

SEQ ID NO: 236161 - DNA, 1861 bp, Homo sapiens
ctacaggatcaagtccacgcatcccagtccttgctggcacagctccagtgcccctctccattttcctcggccatatccctcttcattgccgtgttgaccagtcccaccaagtatctcgccctcattccaggacaccacagcctcctcgctggtctctgggcctctggcaagctcttctctccctcttgtctccttgacagacttgactcacccttcaaggccctgatctcatgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccatggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttc

SEQ ID NO: 236162 - DNA, 1203 bp, Homo sapiens
acactgaactgggctcttgacgggcatcatctcttaatcctcagaacatcaccagcgaggagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccatggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttc

SEQ ID NO: 236163 - DNA, 948 bp, Homo sapiens
aagagaaagtactgcatatttcatacctactatagtctaggactgaggatacagcaatgatcaacataggcagaggctctaacagatgccaggagccagctaggcatttgtccggctatcttatgataatattatagggagggaggtgctcccataccccaagtgggaagagtgcggctcagtgaggctgagaaacttgccgtgggtcacacagcagatgactattggagctggaatctgaaccagatctcattcctaccatatctgctctttccactacataaatttgttaaacaatggtgggtaaaccatgcacctttttttcttttcgtattttgatttcagtgttgtatccatgatttggaacgagcccacctgagcctaatgatgcgacgagatcattggattatatatgtatttactttaaaaacacaaggtagaaaactttactgagtccatgaaaagaaaagctggagacacgtcaaagcctgttttgatttaagtggaatagatccagcttgagtgtaaattcgagactgtgtttgcttgtgtcacactctatttttcaaattactttcatatgtcctgtttcatttatttcccccagttcggaatgggaaaactgaggcctgggacttgaaataacagatgtatgtttgtacagcaaatcatcatgagagccaaaactcaaacccatactctctcaccgaaccccactgcttctttcagcacacaataattattattatgccaagtaagtttaacaaggtgacttggatcgattcattctgatgatttgagttggctcctgggatcatctgggtaaatattaggcccacatctctttccaaacatattccatctctctctctctctttggttttttcttttttctacattttcacctctgctccctcatcatacctccctccctttctctgttgaact

SEQ ID NO: 236164 - DNA, 340 bp, Homo sapiens
atgcattctttatagtgaagtgttactatatcacatcttattgattttagcgtatcagtatattttctttaattataaaaattaatttggttttaaaaatttatttgcaaacacactttttcaatttgacactatggtttgttgcctacctagcttagtatataatgtcagcttatcctaaggctgtccaagtacttaatttacttaagtgttcattttaactaacgtgctcactgtgtataggaatttgtattttgtaggtgcttggtctatctacaaagaaaaattaggaaatgctttattataaaatgctcctagaagtcctaattgtgtttattta

SEQ ID NO: 236165 - DNA, 380 bp, Homo sapiens
taaggggcggtgagaggcgcccagattcacctccagagtaggtcatcccgggctgctgctgggctcttcggagaactttgagctctttatgaacctcctggaacttgctccgcagcttcaaagtgtgcacaggttgggcgcagtgattgccccaagacgcgcgccggtctcttaggagtatgtaacttccttgccccttggattaggagatcagaggtgctgggtcctttatatagaccaactgcagctataatgctggaagaactgaaacttaacagccttactcctgccaaacatttttcctgaatactttatgacaactgagtttgccgggtagagtggccgttttaaatgagctttgttcgaacaacgctaactca

SEQ ID NO: 236166 - DNA, 391 bp, Homo sapiens
tctctggtatgtttgtttgttgtctgtttccatgctttaggatgtaaaatccccaggaacagggatattttctgtcttgttcggtgctgcattgcagacactacaatacagcctggtacatggttttagtttctaagatagtctagggagacaaatctttcctagcaggaataacaagccttcattctaaggattaatttagatcattagactatcttcactttaagtattgtggaaaacattaggaagcaaagtccctaattatgtctacaattatgaaaaaatcatattttaaaaaatctttggtagcaagaaagactataatatactcaaaaatgggaatgtttttccatgtgtttctttacttatatcacttcttttctgtttcttt

SEQ ID NO: 236167 - DNA, 399 bp, Homo sapiens
gatttcaaagttcaggtttttagcaggttggatatttatttcaatgtcaacttctcctcaagccccatggacattctaccaagaggtagtagttattttcagaatccaaaaatacatatatacaatgcaagaagtttaagaatgagtgaacactagagttaggaaacggaggctttcatggaaacagaattcatcctcgtggctcgtggcattccgatcacaagttaaactatttgaaatgatggcttaataggcacccctcgcagtgtgggggagataatgagtgtagagtgctcgacttctcactgcctgactgcttcgtgttgaaattagtaaatgtactatcataggaaaatggatttttgaatttaattttcattctttccacattcctatgcc

SEQ ID NO: 236168 - DNA, 344 bp, Homo sapiens
cttccatttggcgtgataggttggagcctacccgtagtgaggagagaagggaggaaatattccaaagacaagagaaggaaagggaagatcttaggtctgtgccaacagggcctaatgtatctccatagggggcagccattcataaagaaagaatgcttgtgagttacaacattttgacaactatctggacaatgaatttaagttaaaatctgtttgcagattaaagagtatatattgtctcaagcccttaattctaagcgacaattatttctgtgctttgctggagaaaatgatatggaaattttaggagacttgtgaatatgtactaatttctgcataatctg

SEQ ID NO: 236169 - DNA, 2756 bp, Homo sapiens
  misc_feature (1198)..(1198): n is a, c, g, or t
  misc_feature (2042)..(2042): n is a, c, g, or t
tacaacaatgaaaacagaacaatctatttaggagaaacaaaaaacaattgttcatatttttttaacaaaaagaaggagtgggaatattttctttaaaatccctattggccaggggtgctggctcatgcctgtaatctcaacactctgagagactgaggcaggaagatcgcttgaggccaggagtttgagaccagcctgggcaacatagcaagtcctagtctctacaaaaataataataagaagaagaagaagaagaataaatccctttaaactacaataagcagagaccagttattcattggctatatttttaagattgccagcttttcaaatgcagcaaaataaatgaaaaaagaactttcaacagggatctagaagtcagttttcccgttgagtagatcttccagcccaatacatttattagtctataatgaaaatatctactttgatttcttagaggtttcttcaaataaatatattgaaacaattttaaaatgaccacatattatttaattttaaaagcacacttttagaaccccatttcttatgaaaggtttcatatcgagatcatttgttattgtgagactgtatctggtggaaaggaaagataggagtatttttcatatgtcaaatgagtagactaaaacatgggaggagagatttatgactttttttttacatcatccagctatggtttgggacgtgtttgttttacatttttcttccccagaatctctacactgtttgatctaatgaagtatttggcaaatctatagactatatgataatcacagtttactttgtgagggagtgtcaaattatagtgtcggtttgtctatattgatgactcgccataatccagacgctgtgcaagccatttaaacttccttagcttcattttacaggttaagtgtttaaaaattgccccttctgtagttgctgttaaaatgcaaacattaacaaaatgtaaattaataatataggccacaacaaatgcttgttgccagtctctcattttttgtttatcctttccttttttccctttcatagtaacctatggcttgaaagcaaagaaaagggtgaataagaagccaagttccatattagcatctggaatgggagcaggggatgaatggagcagattttataaatgtaattttataacatttagcctattatgataaaatgtcaattacanttattactgaaattatctcaacagctacatttgcttacattacaatataaagtcaccgacatttttcccaatttattgttttatagagcactaaacacaaaaataccaacaacctaatgaaaactgttgtttgcctgactttgtcttatctttggcaatgcaaactaccttgggacccccatgagaaccttagctgcattcattcctggttaaaaatacatgacattttaaaagcatttttccctcagttttcaaaatagaagatgcagtttgtttctcgttagggttggaattgtacagcaaagttgtctgggtagcttttaaagtgtgagggttagagtttaagaaatgagataaattttgcatttgaaacttgttagcaatttcttcagtcatcattattttaactagctgtatcagtaatcccctcgggagtgattatgctatacaaactaggaacatgccagaaaattttcctgggtctgtaagccactgagtttttaattacttggtatctatcctgatagaaagagaagctattttttccctccatttgtatcagaacacgtatgttccattgcttgttcatcttctctagtttcttcatagcttattccccagagaccagtgagaaagaatgtggcagcatcggtaattgtcagaatggaggcatctgtgatcttctgactgggcactgccagagccccccaggggttcatgggaaaacttgtgaagatagaaggaatgtctggtgccagtcagttaagttcttggggtttctaatgagaagtaaactaagtgaaagttgcatgtgtatttttcaaaatggcctttttctgaagangtaaaagactgtgaaagctgtgtctgtatatataaaagagtacaattgttttgactgatgacatgtgtaacaacgaaataagtgatatttaaatctccaactgtgatctaagcaggacgaatcctcttacagagaaagcctttttcttctactgagcaaaaagttacaattatgtatataggtttagatgtaggagcttaggagaagttattttctctgcataacaaaatgaagaacaatagagctccttggggaaaccagggaggaagacagatgaaaattagagaagaaaagggaaggaggtagagagaaaaagaaaaaaagagatgatggataaaaatctcacaaaataccaatgagtactgtgcatagattttgtgtgtgtgtgtgtggaaaccagtgaagaggccacaattcctacatgggttaataaagcacaaaaaaaagaacctgcttgcacatgcacaaaagctgaaggcagagagtcagtgaggatgtaagtctctagggatggccagaaatcatgaggagtttattagcttctcacagttgatagaattggggagctggaaatgaagtttacttcactttctgagatgcagtaaggtccctgctggcatttcagttacttatctttgtgagcaatgttcatttatttatttaaaaactacattaaatggttgcaaggaatggcaccagacattatgatatgat

SEQ ID NO: 236170 - DNA, 582 bp, Homo sapiens
acactttgggcattctgtgggaaagaatgggagatagattggagattacagtactttttgatgaagattagcacccactggtcatctgtaagagagttgagtagctaaccatcacagatcaaggtgtacaacttcagcatgtctgaccaagagaacatgtgtctactctgcacatcagatgtgggcgagtggtttgactgccttttgtaggattgagatgtccagatggccatgagggagttctaagtacccctatgagagatgttgatagacctactcagtttggtgctgaattaatgcccccagagctctgtgctcacatttgagctaggaaaataccttggcccatgaagggcgtgtggtggagatgagaaggaagggatgcttggtaaagctggataagaccaaagaaatgaagaagatagtaggaagaaataggaaaaaaagaggggaaggggggaggagggaaaaagaagaaacattaaggaagttctgctttgttgctatattcaactccgacttctgtcagtgaatttgatgactaaagagctagtgtagttctctttggagagaatgttgatg

SEQ ID NO: 236171 - DNA, 577 bp, Homo sapiens
agtgctgaacagccttaagctgatcaaactgtaacaaataggtggatgatgatgctttgttacacgcagaaatagtgattattcagttatttgagtcatgccaggtgccactggctcatgcctgtaatcccgaggcaggtggatcacttgagtccaggagttttgagaccagcctgggcaacatagtgagatgcctgtctgtacaaaaaaaaattttttaaattagcctggcatggtggcacacacctgtagtcccagccacctcggatgctggggttaggaggatcacttgagcctgggaagtcaaggctgtagtgaacagtgatcacaccactgcattccaacctgggtgacagagtgagaccttgtttcaaagaaataattgagtcagtaagtgatcccagggacattgaaaatccaaaaacagggctgagtgtggcatggtggcacatgcctataattccagcgctatgggaggtcaaggtgggaagaccgcttgagccggggagtttaaggctgtaggcagctatgattgcaccactgcacgcgagcctgggtgacagggagacctcaaaga

SEQ ID NO: 236172 - DNA, 445 bp, Homo sapiens
atgtctaaatcacacacgtcactgctgtaatatggtacttactatcccatgaaacatccacaaactagacactcagaaagtggtgttggaataagggaggttctatggcccttcttctcctgccccccacccatgcgccgcccaccattcctttccgtggaccactgaccttcaagtttgaacacagaacgggcaagtggcctttggagctgagggtgggacgtggcctttggagctgagggtgggacatggcctgttgagaagagcagggccaaggaaggatggaagcctgagagacactggcagggggtggagaaaggcctcctctctgcctggcacctcattcattcacttatccattcattcattctccaggcccagccccgcctgtgggcctatggtgccacctccagagcatggatcctgccctctgagctgttgttaa

SEQ ID NO: 236173 - DNA, 701 bp, Homo sapiens
gggtaggccgaggcgggcagatcatgaggtcaggagatcgagaccatcctggctaacaccgtgaaaccctgtctctactaagaaatacaaaaattagccgggcgtggtgggcgtgctcagcacagctccaggacacaactggctgttcttgaaacttgcggtgatttagaggtgatgggcggcaccagcacattgaactgaatgcagaagttgaagtgaaaaaggcttcctgttccttgagcgaacagaccgaaagcgtgtgtgtgtgtgtgtgtgtgtgtgtgtgtgtgtgtgtgtgtgaagagctggtggctgtgggtgcgtcagttggtctgttccttgagtggacagtcagttggtcttggactcccagcaggacagaacgaaagtacgtctgcgtgtgaatgtgtctggaattggttccttccggtgggttctcggtctcgctgacttcaagaatgaagctgtggaccctcgcggtgagtgtcacagttcttaaagatggtgtgtccggagtttgttccttcagattttcagatgtgtctggagtgttttccttctggtgggttcgtggtctcgctgacttcaggagtgaagctgcagaccttcgcgctgagggttacagctcataaaggtagtacagacccaaagagtgagcagcagcaagatttattgtgaagagtgaaagaacacagctccca

SEQ ID NO: 236174 - DNA, 687 bp, Homo sapiens
cggaggaccgagctagaagaaatgaacaaggccctttaactgtcttctagtgtagagacatccttcattggacatttagtagaattcctcttgggccacaagaataaggagcaaataaacaactatggctgttcttgaaacttgcggtgatttagaggtgatgggcggcaccagcacattgaactgaatgcagaagttgaagtgaaaaaggcttcctgttccttgagcgaacagaccgaaagcgtgtgtgtgtgtgtgtgtgtgtgtgtgtgtgtgtgtgtgtgtgaagagctggtggctgtgggtgcgtcagttggtctgttccttgagtggacagtcagttggtcttggactcccagcaggacagaacgaaagtacgtctgcgtgtgaatgtgtctggaattggttccttccggtgggttctcggtctcgctgacttcaagaatgaagctgtggaccctcgcggtgagtgtcacagttcttaaagatggtgtgtccggagtttgttccttcagattttcagatgtgtctggagtgttttccttctggtgggttcgtggtctcgctgacttcaggagtgaagctgcagaccttcgcgctgagggttacagctcataaaggtagtacagacccaaagagtgagcagcagcaagatttattgtgaagagtgaaagaacacagctccca

SEQ ID NO: 236175 - DNA, 711 bp, Homo sapiens
ttgttgccaaaataagtgttttgatctgtccattactctgtgtaactcccttcatcctcaaatcgtaagtgtaatgggtgagtgtctcttaatagcaaggtatttgtagttaatcggtgaaaatgatggtgcatcccttgtctggtggctgcgtcagtttgtgactcttgtgtagtcagtgctctgtgggaattcagtgtggcccgtttgataaactttatagaaaaatggaatgaattcaaataaaagttattgtcttgaaattttgaaatgttttcagtgtgtgtgtgtgtgtgtgtgtgtgtgtgtgaagagctggtggctgtgggtgcgtcagttggtctgttccttgagtggacagtcagttggtcttggactcccagcaggacagaacgaaagtacgtctgcgtgtgaatgtgtctggaattggttccttccggtgggttctcggtctcgctgacttcaagaatgaagctgtggaccctcgcggtgagtgtcacagttcttaaagatggtgtgtccggagtttgttccttcagattttcagatgtgtctggagtgttttccttctggtgggttcgtggtctcgctgacttcaggagtgaagctgcagaccttcgcgctgagggttacagctcataaaggtagtacagacccaaagagtgagcagcagcaagatttattgtgaagagtgaaagaacacagctccca

SEQ ID NO: 236176 - DNA, 359 bp, Homo sapiens
gggtaggccgaggcgggcagatcatgaggtcaggagatcgagaccatcctggctaacaccgtgaaaccctgtctctactaagaaatacaaaaattagccgggcgtggtgggcgtgctcagcacagctccaggacacaactggctgttcttgaaacttgcggtgatttagaggtgatgggcggcaccagcacattgaactgaatgcagaagttgaagtgaaaaaggcttcctgttccttgagcgaacagaccgaaagcgtgtgtgtgtgttttaaaagaaaaaacccaatgaggaacaattggagatttttatgcagaaactaaataatccttaataaataaatctctattttggaatca

SEQ ID NO: 236177 - DNA, 487 bp, Homo sapiens
gggtcaggcctggtttcttaggtgttctttgtgctactcctcattttgtggagaggcatccttggtagaagtgaattttgtaaaatatgcaaaggtatggctgaatagtgaactcttcccctgtcctcaggaaaagcacatttggtacctcctgtcagaggggactcagcaatccactaaagactttttttttaatttattttttacttttgaaaaatgttggcagggtgcagtgactcacccctatggaagcgggtgaattacttgagcccaagagtttgagaccagcctgatcaacatgatgaaaacccgtctctactaaaaatagaaaaattacatgggcgtgggggtgtgcacctgtggtcccagctactcgggaggctgaggtgagagaatcacctgagcccaggaagtcgaggctgcagagagctgtgattgtaccactgcactccagcccagaagatgggagtgagaccctgtctcaaaa

SEQ ID NO: 236178 - DNA, 420 bp, Homo sapiens
agaggttagcactaggtctcctgcccaatctgtccctgaactacagggtaattttgattcccagtaactttcatagacctaagcaacagtcacacaaatgtccataaaaagaagctagtgtttctttaaacactcgcatccatgttattttagtacagggtagttttcaaaaatctgagaggatttagagtagttgatcaaaataaaaaacttctttacactttatttaaatcctagctaacagaagcatctccaaacagtgaaataaacattctgcagttcagcagtggggaaaacaaaatgtgttattctaaaacaggactgtcaggctgggcgcagtggctcacacctgtaatcccagagtgctgagattataggtgtgagccacctcgcccggacagcatgtatttcttacattag

SEQ ID NO: 236179 - DNA, 495 bp, Homo sapiens
aggctggagtacagtggtgcgagcatggcttactgcagcccctcctgggctcaagcaatccgcccacttcagcctcctgaatagctggttctacaggcacaagccaccaatcttggttaatttattatttttatttttgtagagatggggtctctctgtgtcacccattctggtcttgagtcctgggctcaagccatcctcccacctcacccttccaaagtgctagaattataggcataagccattgcacctggcctcattttgcttatttaaatacctcctggtggtgactgtctcagtgctaaggtgaagcccacatcagagctcctttagtcttgggtgtgtcaagaactctggctgtgaccagacccccactctaaatggggtcacatgcttcacctgtacattgacagaggggccccatgtgtgtactgagacccaactggaataatggatcatgagactgttgtgtttcaacaatagcagaacagtaaa

SEQ ID NO: 236180 - DNA, 2132 bp, Homo sapiens
  misc_feature (713)..(713): n is a, c, g, or t
  misc_feature (855)..(855): n is a, c, g, or t
  misc_feature (1302)..(1302): n is a, c, g, or t
  misc_feature (1305)..(1306): n is a, c, g, or t
  misc_feature (1344)..(1344): n is a, c, g, or t
  misc_feature (1349)..(1349): n is a, c, g, or t
gtttaataatgattatccaaccattctcttttcctttgaaatatccataacaaaagggaactactgacttggctttgtgacaagcttaaaataaaacttcaacacatgcttataattaatttttgtgaaaaaatgtaaaacagtcattatagagataggacataaaaatagtagctaacacttattaagtacttgttgcttgtcacatgttatattaaatgcccaaaaactctttataatgaattgggttataatacctctgtttgacttaaaagatgctgatacagtttgaatatttgtcccctccatatctcatggtgaaatgtgatccctaatgttggacatggagcctgctgggaggtgtctgggtcattgggatagatccctcttaagtgacttggtgccctccccatggtaatgagtgagttcttgctgttagttcacgagagagccggttgtttaaaggagcctgcacctcctcctctctctctttgctccctctcttgctatatgatgcgcctgctcttcctttgccttctgccatgatcggaagcttctgaggcctcaccagaagctgagcagatgctggtgccatgcttgtacagtctgaagaactgtgagccaaataaacctcttttttaaaatttaatttaattttttttttttgagacggagtcttgctctgtcgcccaggctggagtgcagtggtgcantcttggctcattgcaagctccgcctcccgggttcacaccattctcctgcctcagcctgccgagtagctgggactacaggcgtccaccaccacgcccggctaattttttgtatttttagtagagatgggatttcgccatgttngccaggatggtctcggtctcctgacctcatgatccgcccacctcagcttcccaaagtgctgggattacaggcgtgagccactgcacccggcaataaacctcttttctttacagattgcccagtcacaggtattcctttataggaatgcagaacagactaacacaaatgctaagaaaggccgagtgacttgcccaagatcagacagccagtgatgggtagagccaggttttggttccaggcctggctgagtccccagctggagctagctacagctacactcttctgctttgccaggggaattgcagcaggaggtgaagagtgggatagtctgctgggcacggcggctcatgcttgtaatcccagcactttgggtggccgaggcagacggatcatctgaagtcaggagttcgagtccagcctggccaacatatcgaaacccgtctactnaanntacaaaaattagccaggcgtggtggcacgtgcctgtanttccngctactcaggaggctgaggcaggagaatcacttgaacctgggaggcggaggttgtggtgagctgaaactgcactactgcactccagcctgggtaatacagtaagactctgtcaaaaaaaaaaaaaagagtgggatagtccctgagaaagggataggtatagggctgtggaaccacagagcacggagagtgttctcccaggtagagggcttgggaagcggacatggaggaagagatagtctattccagaagaggaagtaggagagggactggtggagacagtgagcagcacatgccaggagcagcaggagggtgggcagaggcatagcaaaggcccaggcacatttgaaggtgattgtagagttcgatctgcagccatgggagtggcccccagtcctctgaacagcgcgacccctgtcatccagtgttgtggatcctatgtgctgctacttggactttttaaattactctggattcagagagcacagccacacagtttcatcacttactggctgtgtgaccctgggcaagtcacttcacctctctgagctgaaggtttcctcatctgaaaactgggggtaatgatagcatctccttcttaggattgctgtgaggattcaatgagataaacctcaaattagcacatgcctggcacctccaagggctccatagaaaggtggggtattactgtcttaccgtgtaattgaatggtggcattataacgctatttttcaggaggcttgtgaaaaaaataacttctcattaaaaaaataattttagacttt

SEQ ID NO: 236181 - DNA, 556 bp, Homo sapiens
aaggaaaagatcgatcgctgttctggtaaaaggctaggagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 236182 - DNA, 534 bp, Homo sapiens
accccacttttacaactaaggtcaggttttgaacttgagcacctcaccttggattggtaactactgcctggcatctgttcacaaacgaaggtataagcagaatgaccaaatgtttgacatgaattcgatcatttcataacgtcaagggataggtgtataatggtttcctttgccacatctttccttttgctactttgtcactggattctagtgtttggttattgaataacttaggctaaagagccaaaaataacgatttagctgtagttggaactatagtttcagttcgtgtaaatatttccaatttgtatttagaaatccaaacttctcagagttcatgataaaatattccagacccttatcaaaaggttatagtttagcgtaactatatttaggtgaaaggtcaggccgggcccggtggctcatgcctgtaatcccagcactttgggaggctgaggtgggtggatcacttgaggtcaggagtttgagaccagcctggccaacatggtgaaaccttgtctctactaaacatac

SEQ ID NO: 236183 - DNA, 406 bp, Homo sapiens
gatactgagtttgatccctcagttaaagtgtcagttgctaggtttttcaacgctaaatgtacacttttacctttgtcattaattagtaatctttagagtgatgctttggcatcttatgaatatcttgttccccaacaattttttacccagtggttttcacattttgatttaattttgctttaatagttatatataacatctttatgtgtttctaaaatcaaaagtataaaacaaggtacatgaagagaattcttgcttccattcctgtccccttcacctctctttctcgatagataaccctttaattagtttttggattattctttttcttgccgttatatgtttaaaatagaaatatatttgtattccctctaccttcacttcaataaaatatagatacactatt

SEQ ID NO: 236184 - DNA, 361 bp, Homo sapiens
tctctgatggcatctcactagcaaaagggagagggggctcatctccgagcacgtatggggtggggtgggtctgaggggagaactccaaagtcactccaccttgatgagagcactgaggacacagcagataaactcgaaagtcaaagaatatgggacgtatctcggatgtgagcacagtgagcacgcggcctgagttttggtagaatcgtgagccctgaacagtcagagtttactgcccacttttgctggaggagaagctcctgaacaactagagagactgtggttcccaaagagcagccggtaggcctgaggactgctctatgaccggcgtcagtccctgcctccctccttccgttcctcc

SEQ ID NO: 236185 - DNA, 730 bp, Homo sapiens
aacaaaggttaacagtgctccctcccattttccagaagttagtttttaacagcatggtgtgtatattgaagctttatataccttagtacaagctaatgtcacctctcgcctggaataatgaaataacttccaaattggtctctcgatgatccatattgcagacagtgatctttttattgtttactctgtttatgcacctcccttgattaaaaaactcttcagtggcttcccagtgaatatttttcttttgccttgccccacattcctcattgcctttcttctgtccagccatactggctggtgtcagtttcttgagcatgtaatagtattttctacctccagagctttgaactcactgttttcttttggcatacttatgcattgccctttgccttgtcatttagaccacaaattattggctgtttttctcccttttcttttttatttaattttgtaatacagtatttattagataagctcagtgaaacttttctgaacacccacatgtgtccttgctagatcgcctactcttatctttcattgcatcctgtacttttccatcagggaacttttcattatacttatttggatgatatttgattaatatttgcattcttaacacagctcctagactgtaatgaccaagaatgcaggcaatgtgtgtatggctcatttttatgtcaagaaaaatttattgtttataaacaattaattttgtacaccaatctca

SEQ ID NO: 236186 - DNA, 773 bp, Homo sapiens
accgtttaaactgttttacctcatttggaaacccacagcctcaaataaatttgctgtccaagagcaccatctgctggatgaaggtatttaagctaccccattgagggagagggaaaaaaagtctataggttaaatgccactatgtctaacaccttggtgtgaaaagattcccatgcctcaccaacaggtttcttataaaggagctcttgatttgacaaaattctaatacaagagaaatctggaactgacaaaaattcactatcattgaatttagttcatcttaaatattgcttatcataaagtaaacatttctgagctggaaggaacgagagagagcagttaattcaatttcttccccttgtagatgaagactctgagaaaaacacagagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagc

SEQ ID NO: 236187 - DNA, 776 bp, Homo sapiens
gaggaagaggtggtggagatacattggagagaacaaatacaatagacttatctgaggtcaaatcaacagaacccagcaacggatcagacagagagagaaagcagaaagagtgaaataaaactccacggttctagcctgagtgattaagggcagagcaatgttctggaccttgctgggagattcaggaagaagagggaaatctgggtttatttcaaggaggggtgggaaggagagatgagatgaaggaggaccaggaaaataaaatatttcaagttagctaagctgcattggaagtgcttaccgcatatccaggtaagacgtccactgggtagttaagatctatgggtctggaacccaggagagaaattggggttggaaatgcagacttgggagtcaaaatcataatgatgttctcagtcttttggatttcaaattttagtaaaattatcaaaagaaaaaaagcaatttgcacgagtaacttttttgtttgtgaattaccaccatctactttcacaaagaaccagacactgtaattcccaaaaggtataaaaggcatcatcttagaataaaaggtcctccttcaaagagagtaaatttagccttatggaaaacttcctccatcatccccatttttctcattttgctgcaaacctgtaaaacttgtatcccacagacagtttggattgcatttggccaccatgggtttgagacatggcgggaacaaaagtgtgagttcttttgtttgttttttagagacagaatctcactctgttgcc

SEQ ID NO: 236188 - DNA, 454 bp, Homo sapiens
tatgtcccttttctagtccagttaccgcctccctccccactattctgaagtcaatgtgtgtcttcccatccatgtttaatacctagtgtgcatgtccatgaagaatggatagtgttctttggtctgtttttgcaattttatacaaatagcagtccatacatactctcctgaaagttgcttttcccttcaacaatatcttccagatgaatctagaattctgcatttctggtgagcagaggatgcgccaaccccctgcaatccccaccccaaagtgatgctgatgttctggtccaagacctgcacgtagcctggtgaggcttggagtcctgggacaggtctgtttgtcagccctttcttcctaaggaagcacagccagatgacctttggggcttggagactcacaaatgcccctcgccagcagtgcgcacatccgtcttcactcatcttcatcagt

SEQ ID NO: 236189 - DNA, 476 bp, Homo sapiens
tattgttttctttattgaaccccagacccatcctccataattttgccactttgcaatgtaaatacaatattgtgtgttactgcccaggatctggggactgggactagccgagcaagcttcatagcttcattccatccccacttgcattgtgccaatgcaaatctgagcatagaagatttcattgagccagcccatttggagacagtatctgccctcaaagggcttctaagccccagggcaagccagttgtggaagacagcagtatggagcagagtttgcaggacaccttgaaatccctacagcctctgagcaggagactaagcctgaaagacctggactatgtgtgaagtaaccatgttaatgaagctatttcgcactcttgcactgcaatcaccaaacttagcaatgctcaagtagctctgccggtagtccagatgggcctctggcgtatttaaataaatgatctggtttcctta

SEQ ID NO: 236190 - DNA, 427 bp, Homo sapiens
cataaatcgccacggagaaaagagaggctgcggggaggttattgccacacaaccctcacgccgaaggcccgctcagagcattagtggaattaattcatccttcatgagagcttgcagccggccctgtgatctatggtagcaaccaatttctcactacgggcaaaaggaaaaaaatgactcaccctgatcgactacacaaatctgcgttttaaaaatggcctcacattatctggagtgtggctcccagaggcatcatttgaaattcataccaagccaaaagcatccataaatcagcagagaaagttttgttagtttctgctgcggctgtaattatctgagactgcattatacccccatcaaggtaattacatttagattacccttaagtgatggtaataaaagaaagagaaatcagtctgaaactagt

SEQ ID NO: 236191 - DNA, 386 bp, Homo sapiens
atctttgtctattgactatacaactacaaagataaatttttaaaaaataacttgctgcctaaagcttagagcctagtagaagcattaatgacttaaggatcaaatttaaattggaaatatttaaaattaaaggttcttattgtatcacatgaggtatgcacatctatcatggagtataatacaatccttggaaatcatatttttaaagacaattaaatgacaaataaaaatctacagaataatgctttgtgaaaaagtagggtcctaagctatacataccatatggtttttcaaatcctgaaaaatatacaaataagcaaagaaaaatgttagaaagtaacatattaaaatgttaaagggggcttatctctggaaggagaaggttt

SEQ ID NO: 236192 - DNA, 445 bp, Homo sapiens
caagaatagcaccaagaggttggtgctaaaccattcacgaaggaccacccccatgattcagtcgcctcccaccaggccccacctccaaaattggggattacaattcaacatgagatttgggtggggacacaaatccaaatcatatcgagaattacaggcataattaaattattccttggtccctgtctctgacttccattaatattagagaaagggtaatacatcttcattaagttgggtttatctcaggaatgcaagcttggttaagcattagaaacccaatcaatgtgatttactctattaatggaatgaaggattacaataataaaatctttttcaaagaatgcaaaaaagcatttgtcaaaattcaatatccattaatggtaaaaactctcagcaaactaggaacagtaggaaacttccttaaaataataaaggcatttac

SEQ ID NO: 236193 - DNA, 430 bp, Homo sapiens
cttgaatatttatcatttcaatgtgctggggtcatttcaagttatctcttctagctattttgaaatatacaatacatgttgttaactatagtcaactagtttgctatcaaacattttatctcaatttttacatgaagcctattaagcaggtatgatttcctctagtcagacaaggaaatcaaggaaatgagaggcttagaaacgttttcacatttacagggctgctcagttgtgggattagaatcagaggttgattcacaagctctccagagctgccattgttgttcacatcaatacttctgcccttaccattttgttttcaaaactcttcttggtaatagtgacatgtaaacattaaattttaaacttagagaactctaatttcataaaagtagtattagactttacacccagctccgcacaccctgca

SEQ ID NO: 236194 - DNA, 533 bp, Homo sapiens
tctttcttggctcctagaaatgggggcagacaggttggggtggaagggctaatagcaatcttggatttatttccaagtaggaatcagaaacagctgggggcataatcatagttcctgacaatgtaaatagtgcattgagaggaaatgactgtgcagtagccctgtaagggacatattattgtcccctttgatgggagaagccgtttcctaaagttaatatgtgctggaagcctaaaccatggctttcccttctgttggtagctgccttgataagcagcaatcataaagtgttccccagaggtaaggatgctacagttgttctcctttatgtacatctgagcttacattgaggatcttgggcttaccctcaggtgtggaggattcacatttagtgtggaacagaacacctctcaacatctgagccttgtctacttcccctagctgattggctttcatctgtatagttgagatcccccactgacctccaggcaggcatggtcagaataaagaactcatgggatttgcaactgcca

SEQ ID NO: 236195 - DNA, 295 bp, Homo sapiens
aatggcagggatggctggcggcctccacagggctgggaaaggtggccagggcctccctcagagccttcagccagcctgcgggagagaaagatgataaacggtgttgtttttgttgttgttgtttgagacggagtctgtgtcacacaggctggagtgcaatggtgagatcttggctcactgcagcctcagcctcccgggttcaggagaatcacttgaaccaaggactcggaggttgcagtgagctgagattgtgtcattgcactccagcctggcgacagagcaagactccgtctca

SEQ ID NO: 236196 - DNA, 546 bp, Homo sapiens
tgagagctttagccaaactaactcctgcccttcggttgctgtgaaaagaagtgtgacacttgtgttataacttatgaaactcagaaatatttcttcattgtgtatataggaggattcttgccagagttgctattgtttgattccatgttgaatgggtttcacaaaaggatagggaaataatgccgccaaccagtaatgccaaggtgtggccaagattgtgtttgtgtcctgtgggctggatttgacagaaagcagtttgtcactgaaatataattaagtgataatctcctttcattgtcaaggttaaaatggctttcatgttattcccaacctttctaacaaagaattaagtctaaatgcaaaatgtttaactgatggttttggttcaactcctcctgctttgtgtttcactaactgcacctgtcagattttcatctcttatagttctcacatttcaaatgtgcatgttatggtaatactgagtgttattttttaaaaataggtttaagaaaagtatttcttaaccaaataaatcaatcttatcag

SEQ ID NO: 236197 - DNA, 415 bp, Homo sapiens
cagtgtggcaatttctaattgttttggttcttttatatagtatttaaatagtatgtcagtgtactttctgttttaaacatttagcatgccctgttatcagtattgtttcatttttaaatgatttttgaagcttaacttattacttagtgtctaaaacatagttaatgtcctccaaaatgtcatatgaataatgtacatagagatgtatgtctaaagttaaaaatgttacagtgtactagtaacatcttgttttggtcagaaaagtgtgtagagtacttgtatttttttcattcaaaatagaaaatttggtgttattatagaaattgatttaaaatgtttttatttgactgatttatgaatgagaaatgaacttctttgatgtttcaggatttttacttcattttttttcctcagt

SEQ ID NO: 236198 - DNA, 426 bp, Homo sapiens
acaagtgtgttattttggcttgatgtgctctccaaaacccattcctttcctttcctgcctctctgtgctcttcctacaaagtacgaagagcaagcatatactttcagtcaaatatctgaggagtattttacttataaccttaattgccatagtcattggactttaattcattaaatgccagcatttggaggcaactggagatatgataatgagtatatatgattatagttgcatatatatagcttccagtaggttaataattgggactaaatcctcctccacccacacactttctaataatttgttcaggggctctgccagccagtgatattcagggaacaaattgtcatcctttatgtgcattttaaagactggcgtttgctggagactcacactgtcgtgcagaagcttgagttctctgagtca

SEQ ID NO: 236199 - DNA, 2318 bp, Homo sapiens
  misc_feature (1240)..(1240): n is a, c, g, or t
  misc_feature (2043)..(2043): n is a, c, g, or t
tcaatggataaataaacaaacaccaaaaaccagagtgcatttctccccccgagactcccttttgtatctggactgtgacatttcctcattttccagtttctggccctggaaagagctagcaaacagcacactccccaggtttggagaaaccttctgagccattgactatggatttgccaaggtttttgcactggggagttctggagaagctggcccccaaagtgaatttctgtaaagtaaatcctattttcccattgacttggcccacacttttggagatatgttcctgctgtcaaaggctggtgacaggtgggggaagagctggaactcccctgggtgtcagctgccccgagcttctactcattccaccttgagagcagactgatgctggccaggagcacaggagcttagagccagggggagatgcaacagcaggggaagagatttggcatctggtcccagaagcctctgctgccagtgggatgctctgctgctaggcttctgggatagcacactccgtctcctccagactgatctgtttctgttcatctgtccgtacatccttccttctcacaatcccaccctccctccttcatccatccatctgtccatccattcagcaatcatttttgaaagactctaggatgctaggggacatagagggaaattaaagagaatcaatgttctgatggcaaagaattatatcccagtagaggtgataggcaaggcctccttcctcctttttctccttctcctactccattgctttttcctcttcatcctcctctacctcttctttcttttctgctctttcttcttcttttcttcttccctcatcaatatcatgatcatagcagcctccaccgttaagtccccactaagtgccaggcaccatcctaggtgagattctgacatactctaatttatctcaacaaccctgcataatagtttctttttctttttttttttttatgagacggagtctcgttctgtcacccaggctggagtgcagtggcatgatcttggctcactgcaacctccacctcccaggttcaagcgattctcctgcctcagtctcctgagtagctgggatttcaggcgtgcaccaccacacccggctaattttttatatttttagtagagatggagtttcaccatgttggccaggctggtcttgaactcctgacttcaagtgatctgcccgcctcagcctcccaaagtgctgggattacaggtgtgngctaccatgcccagcccgtaatagttaataatgctcattttgcaggtaaaaaagcaggctctgagatgtttagtgatatacccaaggtcacactttttagtacatacttgtgtatgagatggaatgtgttgagtgcggaggggaaagtcctccagcctgtgccgtcaggatggcattatttagtaggtaggattttgatacatagtagatggaaagaagggcattcttagcagggggaacagcctaggcaaaggcctagaggctggaaaggggtaggtttgtatgagccatggtgaaccaaagtgtgagaaagaaatggcaggagaggtttgagtccgttaagagaagccttgagtgatgagctatggctgacattggaagcagtaggaagccactgaaagaaatcaaaaggagggaaaggttcaggaagatggccatgaagcctggcatgggaggaggatccagagcagggagaggcaagctggaggccaggaggggctatatgggcctagcctccattaagccagaccctgggtgtggctatttctgcccagccagctactccagcagttgggagaggccaggacatagcccacatccttggtggatgggccacaatggcagggacaagggcagagtgaacgagttagggcagagcagctgcctgcctgccttctcccctcactgaagccccacagctcccagggggctcctccgcatcctgtcccaccctgcccacttcactccttgagccagggaatggttgccagtaccttgctgggcctcagctcttccatcgagcntggacaacccaagcagcaccctgagaaccatcccagaatatgcagagtgtcagagctggacatatggggaagctgaggcccagaaggggacagctagttgcctgaggacacacagagatagtggcacggctggaacttggggctagatctatagcataaaactccttccaagggagataagttggtgtctcccttttctagctgtggaggcttgaacatattttcttttcttttcttttttcctctcctgtctttgcctatgttttcttttcttt

SEQ ID NO: 236200 - DNA, 542 bp, Homo sapiens
catgagtgttgtggtgggaccagcatcaagcgcaagagatctgccgagtccacgtggatacactatgaccccgcagaccatgaaggtagatgaggaggtaatggcattccgtggtgcccaatgtgatggcatcagggttcttcctagcagcatggaagacactcctgccctcaagagggctaagtccagtaaaacccaaccaacaggagatagttgggcaggaagactcattctgagtgtagatggctctgggttttgtgagagggtgaaatctttggtcgttaaacaattctagctgccctagaatggtaaccccaagtcacttcagactggaaaagattttagtggctagaattaaatgtagagatggcaaaatacaccaaagccacagcattaatagacttgcatgaatttaggaataacctggaataattaatatttaaggcatttgcaatgctttaaggatgttgatattttaaaagatctgattctaatttgacatctgtattgaccttggacttgtgacttcttagttgaaaaaa

SEQ ID NO: 236201 - DNA, 389 bp, Homo sapiens
tatattttaatcgctccataattacggaattattttaaataatagcaataattataattgtagtatttaatgtcaatatttctacaaattatatttaagtaaataagtatattgtgaaaggagagggattcaggatcaggggtatgttcaaaaatctatttgtttttgtcattgttgaataaaaatctcccatctcaaaatctttgtaaaaggatatccatggaaaaaagaacctattactttattctccagtcaaaattaaaactggttcacaatggccacatcttctatttatacataaaacacagcttttaacatagactaatttttgtctgttaaaaatgaaattgagattcagtaaagatggattcaaattcaatacgttaaat

SEQ ID NO: 236202 - DNA, 407 bp, Homo sapiens
aaatgcaataatttttttaaaagcaaacaaaattatttaaaatacatgaatttagcttgccattcaagaagtaagataaaaaacatacaatgagtatatactaaaataaaatgatggaaaaaataacaaagagttacatttttgaaatgcaaccatggaagagttctgaggatgaaataatggaagcagacaataaatgtaataaaaccagtggggagaaaatgaaaattctgtcaagtctaacgttaggactcatgtaagagagccaggcacaatggcacacctataatcccaggtactgagtaggctgaggcagtaggattgcttgagcccaggagtttgaatccagccggggcagtataacaagacccaatctctataaaacaaaaaaacacaaacacaaacac

SEQ ID NO: 236203 - DNA, 447 bp, Homo sapiens
ttcctcagtaagcttcattatttctagttttttatttcaagtgcaactcttcttttcacttgaacacttggaggcctttgtaaggttattttttggcctaattttcatattgttatgtctcaggaactttgcatgtcattagggaggcctgaagagacagagatggagagtgaccagtggaacagtcagaacacacacaacatttaccaattaagtttgctgtcttataaggaagggcacactttatggtgccccaaaataattagtaacatcaaagaccaccaatcacaaatcacaataactaatataataatagtgaaaaagtttgaaatattgcaagaattaccaaagagtgacacagaaacacaaagtgaacacatgctgttggaaaaatgacactgtagacttgcttgacgcaaggttgccacaaaccttcaatgtgtaaaa

SEQ ID NO: 236204 - DNA, 313 bp, Homo sapiens
gggtggcagggccagcgccagagctcttagactgaaggcgcttcacatgcttataggctaaaaaggcagcttatctggcttagtactggtgagcgaataaagaagaacgaagattcaaggccggggtacaggcactgcagggcactgtgagccacagtgagaaattcacatttcactcctttcagtgggagacactggaaggtgtcacaccactgacgactgtgaggctgtgaaagatcattctggctactctgtttaaacagctaaagccacggaactcaatgagatttatgcatggaaggaaacaggttta

SEQ ID NO: 236205 - DNA, 306 bp, Homo sapiens
gacactcccaaaataatgctttactaggtttcttttctaagtgttctttaaccaggcaagttgacacctaaccgtcacaacccgctaggttgtcctgcggcctttctgctctaagccatttgtctttttcctgctggattacaggttatttgagtgtagagaatgtattcatccacgtgtatcttgcagcttccaggaaagcaacttaagcttaatagccgctccaatgtgaaagatattatggaataaattgtcaaaaaagacagatattacatttacttttgtgatagtttacatctataagga

SEQ ID NO: 236206 - DNA, 384 bp, Homo sapiens
taaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataatttaaaacgataaaaagcaacataattttatatgttgtaccttgtacttccttataaggtacaacactacaatagccttagtgtgtagttttctttttgctatgtatgtatatatatatattcataaaagtggaaaaataacatttaataaatcctctttattttctgggaaatccttgcttta

SEQ ID NO: 236207 - DNA, 171 bp, Homo sapiens
ttttccccaggctgctctatttgtgcctgtagcttgatttttcaggctgtctttcattttgaaagaattttaccaaagacaagttttagctgtctgcccaactagtttttccttttctcctccctcaactggatcataacttatgactctgaggctgagggaggggatagt

SEQ ID NO: 236208 - DNA, 383 bp, Homo sapiens
agtgtgtcgccatgaggctcttgactgtgtggaatcacagaagaaaaattaaatggcccttacccaaaacaagaaacccaaaagaggccaggtgcgggggctcatgcctgtaatcccagtactttgggaggccaaggtgagcagatcacctgaggtcaggagttcgagaccagtctgaccaacatggtgaaaccccgtctctactaaaaatacaaaaattagactggtgtggtggcatgcacctgtaatcccagctattcgggaggctgaggcaggagaaatgcttgaacccgggaggcggaggttgcagtgagccaagattgcagaaagctgagatagcaccattgcactccagcctgggcgacagagcaagactccactca

SEQ ID NO: 236209 - DNA, 354 bp, Homo sapiens
attacaaacgtattgtattttagacacattacaaccaggagaacaaactggaagctctataggtatgttctgaccattaaaatatctggacagtgttaaaaaaaaaatcaggagtttaacataaagctagttttccgccttgccctgaaaacctggatgatctggactctttgggtctatgttcccagatggtccccagcaggcagagccaggagggtggcccatcaggagtggcacggtccttccactgggcacatcccctccccaggccactgtactccttcattacctgcatggcccctgaagacactggagttgatgacttcctggagtggataaaatgggcttttgtga

SEQ ID NO: 236210 - DNA, 145 bp, Homo sapiens
tgcttcctccttttttgctttttggttttgccttgcgttttctttctttctttctttctttctttctttctttctttctttctttctttctttctttctctctctctctgtctctctcccctccctccctccttggtgccttctc

SEQ ID NO: 236211 - DNA, 1344 bp, Homo sapiens
attttgagcaatatttcctttacctgtcatatatacagcatgttctgaaatacatggagtgtgatactggtgaaattaaaaaaaaaaatgtagcactttaaatttttttccttaaaggttgttttggtaattttaaatcctgaaatataattattacggggatattaagctcaaaattattctaaagttatcttttgttaaatgtggtttgttaagagatttcccattgttcagtgttagtaagtggacagtgaacaaagaggacagatttttgtcaagcataaacaacttttgcatcctgtttattaaatggaaaatacctcaatgaatgtctgtgctaaaagtagattccttcaggtttttagttttgtcctattaggggtggagtcatggaacaggaagaaagacatccagtaaacaggaattgtgtgctaagagatacattttgaaagggaaatggaggctcatgcttagaatttgagttataccatttcaccattatgagtaccttttcaagaatgttagatttaatggagtgctaaatggtctttttcattactgctatgagtgataaattgtcttgaccaagatagcatgttgcagaataaagttttgaaagttgacagaggtattttctcagattcattcattatcatgtttagcttgatgttctcaacgttttatactattaggagataattttccattttgggtagaaatagttttagtgtagttaaatatggttagtatagattcagtaatttagtatagccatttgtttttacatttacatatatttattcaagaaagtttgaaaatgggaggtataatattaaaaaattactcttcccctcctgggaatcaagcaaataaacagcaaatgaacctgaacttacctttctcttttaaaagcaattgttattggaaggtatatattaattccaatgatattactgtttcttaaaagatattttttgggatgtctctttgtaattgccaaatgttaggttgcatgtgacagctttaaatgttacaagtatcagagaattcaggatttgccatgggctgcgaaaatagagaagtggataaccaaggtaatgtagaagactgttctaattaccgggggatcaagatgaggaaaggttctcagtgacaactctctagtagacaaagaaataggaaatgaaattaacaagaccagcctgttatttagcagatagggcctgggaggacagaatttaacattgataacaccaatttaatgtttcatgaaagatcgtataagcaatgatgttgaatcttggtaagccaaaaatttttttctggaaaaaaaaaaaaattttt

SEQ ID NO: 236212 - DNA, 1291 bp, Homo sapiens
attttgagcaatatttcctttacctgtcatatatacagcatgttctgaaatacatggagtgtgatactggtgaaattaaaaaaaaaaatgtagcactttaaatttttttccttaaaggttgttttggtaattttaaatcctgaaatataattattacggggatattaagctcaaaattattctaaagttatcttttgttaaatgtggtttgttaagagatttcccattgttcagtgttagtaagtggacagtgaacaaagaggacagatttttgtcaagcataaacaacttttgcatcctgtttattaaatggaaaatacctcaatgaatgtctgtgctaaaaaggaagaaagacatccagtaaacaggaattgtgtgctaagagatacattttgaaagggaaatggaggctcatgcttagaatttgagttataccatttcaccattatgagtaccttttcaagaatgttagatttaatggagtgctaaatggtctttttcattactgctatgagtgataaattgtcttgaccaagatagcatgttgcagaataaagttttgaaagttgacagaggtattttctcagattcattcattatcatgtttagcttgatgttctcaacgttttatactattaggagataattttccattttgggtagaaatagttttagtgtagttaaatatggttagtatagattcagtaatttagtatagccatttgtttttacatttacatatatttattcaagaaagtttgaaaatgggaggtataatattaaaaaattactcttcccctcctgggaatcaagcaaataaacagcaaatgaacctgaacttacctttctcttttaaaagcaattgttattggaaggtatatattaattccaatgatattactgtttcttaaaagatattttttgggatgtctctttgtaattgccaaatgttaggttgcatgtgacagctttaaatgttacaagtatcagagaattcaggatttgccatgggctgcgaaaatagagaagtggataaccaaggtaatgtagaagactgttctaattaccgggggatcaagatgaggaaaggttctcagtgacaactctctagtagacaaagaaataggaaatgaaattaacaagaccagcctgttatttagcagatagggcctgggaggacagaatttaacattgataacaccaatttaatgtttcatgaaagatcgtataagcaatgatgttgaatcttggtaagccaaaaatttttttctggaaaaaaaaaaaaattttt

SEQ ID NO: 236213 - DNA, 244 bp, Homo sapiens
aagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataat

SEQ ID NO: 236214 - DNA, 467 bp, Homo sapiens
cgttgcgcaaggccaggcaggagcagggcccctgagcaggtattgtaccagccggcgtccctctcagtttccagcagccttagctggcctgctctgagggactaggtgctgcggtagccccgccagcccactaggacctaaaaggaacgcacccagagttgaataaaccagaacacaaatcctcccaagactgcctctggccagtggaatgaacccgggtctgatttcgcgcctacagaaatgaacacatattagtgaggtttcaggagagtccgtgattgaatgctcccagacaaggcttccttttgttaggaaaggaaaataaagcaagcattcacattctccaagttgtggtgcctgaggagagagctctctgaaagcagcccacaccaccagcaaagccacttccaccttctcagcttcctctgtttgcttcatgtcctttccttccccactcccccgccaaa

SEQ ID NO: 236215 - DNA, 540 bp, Homo sapiens
cagtgctgcttgagcatccacacaacatggcgctagcttcccccagagtgagtaatccagaatgaagaagacagaaaccacaatatcctttatgaactggccttataagtaatattttgtcatttccataaagtcctattggttacacaagactgccgtattcaatataagagtgacaacacatggggataaatacttggaggtgtaaatcattgggaaccatcctggaagttgcctacaatactaggatctatggctacaattccctgggtcttggcttcaagacagagaaaagggaaagaacatgaaacagccccatgtggtttttgttttttttttaatggacaagagtaagaaatggtgaacatttcttctactcatattctacagttagaatttggtcacataatgtatctaactatgaaggtagctaggtaatatcatctcttgttgggagggtagctgggaatacctctatacaatggaaggaagagcatgaacttttggtggagagataatgctctctgccatgataaaatg

SEQ ID NO: 236216 - DNA, 320 bp, Homo sapiens
agagagttggggaaaaaattaaaatgcaccctatatattatacagtatattaaataaacgttctggaatgcgctctttctaagattggtcagcatttaaaacatggttgaggaaaaagaattctactccttaatcacctgtttcaactattcaggaaaaatactgacacactgactgcctaaggcagaagatcctacaagttttgttatgtaaactctttttaaaagttttaaaaccaccctttactattgaatgtcatttgcacttgttttccccttgttttgtattacaagtctcagtaaaattctcatttaaccatg

SEQ ID NO: 236217 - DNA, 294 bp, Homo sapiens
gcctcctttgaaaaggcaaatgagaaactcaaaagaatttaaccgttggtgtctcacctatctgtggcctggacgctccctccccgcttggagtcttcctgcctttgcttcaagttgtcccgtctttccagaccgaaccgatgtgcttcttacatgtatcgatggatgtatcctgtctccctaaatgtataaaaccaagctgtgccccgaccaccttgggcacatgtcaggacttcctgaggctgtgtcacgggcgcgtcctcacccttggcaaaataaactttgtaaattaac

SEQ ID NO: 236218 - DNA, 445 bp, Homo sapiens
acacattctttcggagagggagggcaagacttttctccggagcctctggcaactcgtggagtctatataagctctggattgattgatgaccaccggcggccaatggctctgacaccacgccatcctcggtcgggcatcacagccccacgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctcttctgacatcttttttcacttaaacttttgtttgtcccacccccccgacctgtttgtgtttgtttgcagcatctcaaatcaattatacatttttcatgacccgc

SEQ ID NO: 236219 - DNA, 434 bp, Homo sapiens
ccgctctgggagtgtctgccttatgcagttgtagatagggatgaaacacaacctggtctcctgcagcgcccccaggcttgctaggattaggaaaatccagcctggagaattctagtcagactgtttctctgctcttgaaccctgtttcctgttaagatgtttatcaatgacaatgtgtgcccagtgggacatgaaacttcatcagtaattctagttttgccctgaccttgtgacctcgccctgcccatttgccttgtgatattttattgcctttgaagcatgtgatctctgtgacccacatcctattcatacactccctcccctttgaaaattgctaataaaaacttgctggttttgcggttcggggggcatcacggaacctgccgacatgtgatgtctcccctggacacccagctttaaaatttctcctttta

SEQ ID NO: 236220 - DNA, 339 bp, Homo sapiens
aagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaag

SEQ ID NO: 236221 - DNA, 427 bp, Homo sapiens
ctttaatcaatggtaaattgtgagatgatgtaagcacatttccctgcaaactttgtaaaaactataaattttttatagtgggatacattcttccccctcccttttttcctcacaagtcttacaatgtttcttaaataaaattttcactaaaacacgattaaaatatagcaattgcaagataaatgtctatgaagccccatagtataactccctgacattctttactcaatcaaattggggctcagaaacaataccccaaaatgaaggccaaagaagcaacctcagaagcaaaatttttctgtgactttctcctgccctcttgtctctcagtcccattctcccctgaggctagacatagaaactagaattccggtttcccaaggtggcttatgacaaccagaatcctttttccccaaagccaaccaca

SEQ ID NO: 236222 - DNA, 381 bp, Homo sapiens
ttattaaaggtctgtaagattttaataaagaaattttcagagcagaataaaggaagacccaaataaatagtgtagcataccatcatgatcttggattgggaggctgaattttataacaatgtccaaattaatctacaagtccaatgcatttccatttaatatcccttccctcacttttttggggaatggaacctaaaatttatatttgcaaacagatatccataaagagtcaaaatattcctgaatagggagtcgttggtgggtagggaacaggagagatagagttcctgctatggtaattaagttggaatagtaagggcacatgtataaaactcagacatggcattacaaatcaatggggttagggagactttggctcta

SEQ ID NO: 236223 - DNA, 133 bp, Homo sapiens
gggcaccaacactttaatgataattaaactgccatttttcttccctcattacacagattactaaaagtgatttttaacctttgttagggttgtcacgattattttcagcctagatcccttctgtcgtcttctc

SEQ ID NO: 236224 - DNA, 465 bp, Homo sapiens
ctgatatttgctttcagtatcacggtctatcttcattcaagtcacagacctttcttcccctacccaaggaatcacttccccagccaccaatacagaaagacaagagggcacttctacatcacccattcaaaacaaaagaaaaaagaagatctcctgaattgatggaagctttcatgagaagtattcagcattttcaaatttgagtgagggcctttaagctgaagctagttcatctctggtcccttattcaccagaaggggaagggtcaaccttgacctgcaatgaatgactcccatggcgttagtgccttttcttctcctcacagaagtgagcaacaaggaccaatgcttccttccttcctttgtatacattaaatgcagcaagatgtatgtcagagcatacctttatttgtgtactactgtggatatcgtttagaggacaaataagattttacattatggaagc

SEQ ID NO: 236225 - DNA, 473 bp, Homo sapiens
atatacaagtaacccaaaagaaggcaggaaaggggaaaccgaggaatgaaaaacggaagaaacaaacagaaaacaagtaataaaatggcatccctaaatccaaccatatcaaaaagtacattagatataaatgttctaaacacaccaattaaaaaacagattgtcagaatggataaatacaatcaatattttcaaagaaaatttaacacctgaaatgagatgtgcagtaagtataaactgcaatccaaatattgaaaacttaatagaaaaaaatgtggaatctcattactttttatattgatttcatgctgaaatgttttttgtgtactgagttttaaaatatattattaaaatttcacctattacattgtatatttaaaaacatgactaccagaaaaatttaaattacctgtatggcttacattaaaatttccatcagacagcaatcttctaaggtatggcttttgtaaaaa

SEQ ID NO: 236226 - DNA, 2277 bp, Homo sapiens
  misc_feature (1732)..(1732): n is a, c, g, or t
tcactgacatgagcagagtgctgaaatatttgagtgtctggcacacatgtacgttctcagctgagttccaacaaggtggtgctctgccttcttgcttctgctctcatactgaaaacgtgtcctttttgtggctaatagtaccatgtttttcacacttttatgttttttattggtgattttgctatttaaaatgcccctcaagcattgtgctgatctgctgtctatgtttctcaatgctaggcagttgtgttgtgctttacaggaaaaatacatgtgttaaataagttttgttcaggcctgggctgtagtgctgttggctgtgacttcaatgttagtgaatcaacaatatttattaaataaggagtcttgaaacagaaacacacataaaacaagcttatgtattgattggttgacaaaaatgttgtagccagaggttcacaggaacctaatcctgtatttcccctaggagcaatagttcagtatttgctacttcactgtgtgtggcaactttatggaacataatcactacaaataatgagaatggactgtatcctgaatgttatttattatatttgtttatataactttgtagttatataattgtgaatagtatctgtttttatgctatattttctaatttggttttaactgatgtgcagagtattggttttggtatgctgatgttatgtcccagctctgtcattttactagctgtgtgacccatgacaagtttgttagtttcctagatttgtcataacaaagtgccacaaactgggtgactttaaacaacagaaatgtattgtctcacagttctggatgctagaagtctgaaattaaggtgtcagcaaggccatctccctctgaaaactgtaggaaacccctcctttttttcttcctagcttctggtgattgccagcaatctttggtttcccttggcttgtagctgcataactccaatttctgcctttgttgtcacatgatgttctcctgtgtgtgtctgtgcctaaatttcccttcttttacaaggacatcagtcatattatactagggcataccctaaaatgaccttatcttaaattgattatatctgcaaagacctgatatttgataaggcaatgggggttacctttaaaatgtcttttttgaggagcacaattcaacctataacagcaagttgcttaaccttcctgtgcttcagttttctctgacataattgtatcactctgataataactgtatcatttttaagggctgttgtattagattagttaatattattagtcaaaaatatatggaaaatccttagaactatgcctggtccacagtaagaattcaatgtgtaatctagtcaggtgacttttatttagcaattttgccgaactcctattggtttcaatagtttgtagactatcctgaatatactgtttagataatcacattgtatagaaaaggtaatgttgtcttttctaatttttatatattttatttcagtttcttaccttattattgtagggtaagccttgttattgttgtaagactttcagtataatgttgaatagaagcagtgatagtaagataatgagcaccttgttttgcttgtaatttaaatgaaaactattctataattttgtcattaaatgtgatgattgctacaggctagggtgatatcatttctcaggttaagaaaagttatttctagtcataattttagtgagttttaaaattaaatttngaatgagtactaaatacttttttttgcatctgttaagatacttatatgttattttccaatatcaagctggaaaggataggaatggagcagcaaatgaaagttcaggctatgggttaggagttgagtggaaacttgtttggaactagcctgggttgagggcaaagcaagaaacaaacaaacaaaaaaacacaggaatgactgtttgcctttactgtttggcaggtgaaaatatatggatgtaagaactagcttaaaggtggtattaatagtaataataacatgatcaataatagttaacgtcaacattcctcaccagatccctcaaaaacaatagaaataaaagggaatatatttcattttgtagcatacagagcatagttattctgtgcttttaagtgaaacaccagcataggaaaaaacaaaaaacaaaaactggagcccaggaggtcaaggctgcagtgagatgtgatcacaccactgcattccagttggggtgatttagtgagaccctgtctcaaaaacaacaacgacaaataaaaacaaac

SEQ ID NO: 236227 - DNA, 470 bp, Homo sapiens
agtttaattttcccacccccactcaataggagttggaggtacaccacatgccctgcctccctcccccacctccggttcaggccatttcattccatcagatgagcctgcatggagaagaactgtgcttctttcatagagggatgtccacttagattagattgattacggttaacttggtgatgtttaatatagcctttcctttgcacctgtagtgcataatttgttgtggtatactcaagatactctaaaattttaaactatggggtttccaccccaacacatggacacactaacacaacccaggatgatgattgtctcttgctaatcttggaagtccctgagaacagatttgttccccagaactgtaacggaaagatcatggtcagattatgggagtgggaagtgaggcaatagtgggagggacaaaagagagacacaaagtcttccctgatgttaagaagtcttatgac

SEQ ID NO: 236228 - DNA, 242 bp, Homo sapiens
tcccttagccagtcctcatgtcctggccggaaggcctgctcttccttccccctggctcagccaggggtctgcattgctgtccattgatagaattgttggtgctttatgatccagctgctcttgttgccttgaaccaggatttgaatattgtaacattaagttttttgcatgtttatgtccagtagattatgtattttgagactagacagtgggctaattaatattccacacggggtcccatg

SEQ ID NO: 236229 - DNA, 390 bp, Homo sapiens
ttagcagtgcccttggtgaatagcagaagcaaacataaatcctgcctgatagaattggacttcaatccagatccatagcaaatttaagatggcactgactgttaggtttatctaattgttcattcctggtttacaggaatgccatttattctgaataatgataggtacccagagatcttattgtattttgttagcttataaaacctactggaatttctgtgtagacaatcttatcgtctgtgaataacgacagttttcttcctattttccaatacttactgtttttctttttcgttttctttttttcattcttactcttatttgttttattggtcttattatctagtactagtacaacagtacatagaaatgatagtaaacacatttgcc

SEQ ID NO: 236230 - DNA, 469 bp, Homo sapiens
ctgaggttaggtaggagaggtgactgggatctattgagagaaaagtctgctctgttacccagtctggagtgcagtgaaacaatcacagctcactgcagcctccacctcccaggtttaagtgatcctcccacctcagcctcccaagtgtctgaaactacaggcatacaaacctgagaagtttgatttttgctaactggggccagcacggacactaagcagggacctgacatgtcaagtttggcagggcttccctagcagataggaccttaaaaaccctcactctgagccctattcctaaggagacctttgcactgaatgtatatgccttagtctccctaacccaagtttcagatggattattcaggaggtcagacacttttaatcaactgaagattattaaatatattttacacacagtctgtacttctttccacttgtaacaaaattaaaagaaagtttcccatccaaa

SEQ ID NO: 236231 - DNA, 909 bp, Homo sapiens
  misc_feature (1)..(2): n is a, c, g, or t
  misc_feature (4)..(4): n is a, c, g, or t
nntntttggcctctagacagccaaagccttttgtcacccaggctggagtgccatggcacgatcatggttcactgcggcctcgacctcctaggctcaagccatcctcccatctcaacctcccgaatagctaggaccacaggcacacgccaccaaaccagggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgagaagatactgttaatggggattttggatggccatataatgaaataggaaaacgattaatggaagcccaggaggaaagacttggtgttattatagcagccatcttggattgtgagtgtgtctccaacaccatcttgaaggtgcagtgacttgcatatagtaggtgcttgatatttaccaagtaccccctgtgggtcaggccctactctcaccctaaggatacagcaggaagcaaagcagaggtggagaagatcccactaaacacacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgag

SEQ ID NO: 236232 - DNA, 437 bp, Homo sapiens
gcggccgcctactactactaaattcgcggccgcgtcgacttttttcctagtggggctacaacttatgcttaatacaaataaatgccttttattcatttaatacagatatttaccaagtaccccctgtgggtcaggccctactctcaccctaaggatacagcaggaagcaaagcagaggtggagaagatcccactaaacacacaggcaaggcacatcagtgggtgatgagcgctaagaggaagtatggccagatgaggtagagggtgaggatggggcggagaggatcctacctgttggcaaagccttttctaccagatggtccaggaagatttatctgataagcaacaggagggtgagacctgaaggagcctccagatcagggctgcctgggggcagggacgtcgacgcggccgcgaatttagtagtagtagtcgacc

SEQ ID NO: 236233 - DNA, 513 bp, Homo sapiens
tcatcacattcccatgaagtagttgatggttttgtttttatcttcattttcaaatgtagaaactgaagcttaaggttatgacatttgcccaagaccatgcagctggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgagaagatactgttaatggggattttggatggccatataatgaaataggaaaacgattaatggaagcccaggaggaaagacttggtgttattataggtttgtatcatatcaccattttcctgttctatttggaggaagagggaaaggggaaaggaagccagcccttattgtgtgcctgccacgcacctggtcctgcagtgctgggaagcactgtgagctctgactcccaga

SEQ ID NO: 236234 - DNA, 534 bp, Homo sapiens
ctgtgcaaatccagaaaatttgtagtgagtgtactgaattatttgccaatgatcaatagtgctgggctctgaatgcaatctgaaataaaaattgttttcctgaatgtatttatcaaaatactgagtgcttaccaaatactggtgcttactgtactagttgacccgtacaatcagtttaagtaagctaacttaaatttatgacttttgacttattcctgatctattcacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgag

SEQ ID NO: 236235 - DNA, 572 bp, Homo sapiens
tgaggtgtgtcgagtgttctctacatggggcactgtggaggtgtcatcggctcagttccccaggtagtagggcaggtctgtaatgctgctcccctttcagatgaggaaaggaaggcccaggaggccatgtagtcaggacttggtccaggtgtgtctgtctttggctccttgtccctgggtgagaatgaattcagctccaagtaaagaccctgcagctaccccgctcggggctgcctggggtccgtcatggtctggtggcatgggacaaggcagtcagggctcctaaatggtccattgtgagaaacaatgtttgaagcccccatgcagctctcccagtcccctttggcagaacaaatggatttcccagagaaagaccagagtaagcatgtctgggcacacttgtcatcagctgggagccaccagaagtcttaacaaagctctcacgtgacaccatttcttgaagttggtcttcagaaagtactcgcttgccaaagtggagcgcaatgttcaggtctaaaaccaaccaagcacattgaatattttgaaaaataaaatcaagaggttgaattcca

SEQ ID NO: 236236 - DNA, 381 bp, Homo sapiens
gaaagtatttgaggcgctagtactgtgcctggtgtggtgcactgtaggactcagaaaatgctcgtagtgcgtggcaagggagggttctgggaggcagaggtgcatcccaaataagctcctgcagctttctcctccttccttccaacatcctgtccctgactcctgacccaaactgataagagcagttgacctggttcataacaggtactcaaaagcatctgtggaaacaagttacttgaatccgccctccccagatatttttaaacccaaaggcaagattgttaatccaagatgtctccaatttggagcgcaatgttcaggtctaaaaccaaccaagcacattgaatattttgaaaaataaaatcaagaggttgaattcca

SEQ ID NO: 236237 - DNA, 306 bp, Homo sapiens
ccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctac

SEQ ID NO: 236238 - DNA, 254 bp, Homo sapiens
catctttctagggctgcagcctcaccgcaaatcccaggtaggggaatggggcttcctgtatggagacttgggatgggcagggagagaatcttgactagacatccttacttgtagcaaaataatgacttcttgtttcagttattaattgctacctaatcagcaccacaaaacatagtgatttaaaacaaccgttttattttgctcacaattttgttgatcaggaattccaaaattccaaaattccaaaagtcaaa

SEQ ID NO: 236239 - DNA, 486 bp, Homo sapiens
taagcaactttgagccctttttttttaaggacccgaagtttactaatcataagccctattatcagaaatttctggcaaatctattcaagcaaactaaaacaaaaatatcaatagttaaactgaggaagacttgggatgttggaagtagtggttagctaaataaacagttaattactgattctaaaaaagtattgatttttaagataattgtgataaaacctggaatacataatccccaattatttcataatagaatggagtctcaaatattgttctccatgagcactgaatgtttttgataacgaaaaacaattagttttagtgactcctttttctcaagctgtttgttctgacaaaaagaccaattttgtatttgaaactcagagcaggcttcttcccttcagtcacgatcttgccttttatctcaactgagatgctaaaaacaaattcaataagaaaacaagaaagatctcttagaaattaaaa

SEQ ID NO: 236240 - DNA, 143 bp, Homo sapiens
tgtaactaagacaagtgggggttcagaaaggtagaactgtaatggggtaaggggataacaatatggctgaaaaaaacttgcctgctctttataataggaattttaaactatctctgacaagagtttaacttttaagaatgaac

SEQ ID NO: 236241 - DNA, 261 bp, Homo sapiens
agttcgggaaaccgtgcttttatggtggagtttgctttctgccttggtctccggatgtgtgtatctgtgggtggatgtctgcatgcaaatggcagtgtatacctgtgtgggtgtgtacaaaattcccaagtgaatctcagctttctggggacttccaggtcttgagcccagcagatgccatttgaagaaaaatcacttgaaaatgagatagaaagaatggaaactaaatcctagctctaaaggcaccaggctgattaaaaa

SEQ ID NO: 236242 - DNA, 346 bp, Homo sapiens
aggtacagagcctctggaactcaatgcacatcctctggacacttaagaacattccagcattgcacaagaatgcattcccattcattcaattgctttcagggagacacactctgtttgggggcatttcattggcagaacagattacaatggttaaatctgatgtgaaatatattatggaagccacatttccctgagaactcactagatccaggaggctggtcaacatgtgattctgactgaggttaggaccagtcatcccaggagcctaatttatcagaggccaatagtcattcctggttccaggtgatcactagagcttaggaaccaaaccaaccccaagggtaac

SEQ ID NO: 236243 - DNA, 423 bp, Homo sapiens
gggtttcaccatgttggccaagctggtcttgaactcctgacctcgtgatctgcctgcctcggcctcccaaagtgctgggattacaggcgtgagccactgcggctggcccacagctcttaatttctttgaattaattttcttggctgtaaaattattatctttatgtgtttgccttcccaagggttacaagcagaagagtacttgctaggcttttaggtgttacggcccacatctaagcaataactatgtataaaaagggcttaaaaatagtgaatagggagtgtggtggcacatgcctgtagtcctagctattcaggagactgaggcaagaggataatttaagcctaggagtttgaggctgcagtgggctatgatcacatcattgttactcagactgggtgacagagttaagaccagtctctt

SEQ ID NO: 236244 - DNA, 467 bp, Homo sapiens
gggagaagtgtttaaagttcggatcccgcagccatggcccccgcggcgtcctggggagggggcaccggggcgaggggcggggtggggggagatgcccggagccccggggaggcagagacccagaggacgaggagagggagtctctgagacgccgggacaggagagactcagagacggagagacagccaaggagacagagacggggagacgagcagagacggggagatgcagagagggagagagacagcgagatagacgcgcaaagagagcagagacggggagagctgaggacggagctccgggctggagctcagcacagcgagcgcgggcgggcgcgcgccggggacagcctggccggctgggggcgcggggcggccctgcctcctgcgccttctcctcttcctcctcttcctcctgctcctcctcctcctcgttctcctcctcctccctccactcctctgcgcgcc

SEQ ID NO: 236245 - DNA, 392 bp, Homo sapiens
ggagggcctgtggacgaggccaatcctgggtgtagagggggtccctaggatgagggtgggacagatgagggtggagcattgggtgcttaagggacacatggagacaggtccagcaaaggagctggtgggcacagctgggcagttgggggtccggaggccgtgctgccctgggagtggagggcaaagcaggtttcacctgagcgccgcagaaaggagtggagagcccgggcgtgggactcacgcttgaaatcccagcactttgggaagccatggtgggaggatcgcttgagctcaggagtttgagacaagcccgagcaacatagcggaagcccgtctctaccaaaaatacgaggcgggaggatcccttgagcctgggaggtggaggctgcagt

SEQ ID NO: 236246 - DNA, 623 bp, Homo sapiens
cacagaggaagaaaagagaagagtggattcctgaaatctaaaaaaaaaaaaaaaaaaaagtctaaacttaagggatgggtagagaaagaaagaaaccattgaaagaaactagaggtgagaccagttaatttgcttctaagacaaattaagagggttccagaataataaaatggtcatcatagtccagtgattcagaggtcaagctgaaaaagacagaattgtttgaatagatgtggcagttagatatcaatgatcttagcaggtgctattttcaggtagttcaggtggcatacatagtcctctggttagaagaatgcctgaaagatttatccaactataggctgtatcattggtctttatttttctctgtatttcaatgagtgcaaattttttctttcatttattccttcctctcttttcctttcttcctttctccttttctttccttgctcctttcccctcctctcccctctctctcctctcaagagatgtataggttcctttcctttctctctctctctctttttttttttaacaaagattctctttttgtgattttttttgttttattttattttattttattttattatactttaagttttagggtacatgtgcacatt

SEQ ID NO: 236247 - DNA, 429 bp, Homo sapiens
ggctgagtggcacttaagcgggccatgccgtgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccggctaccgtggttactcctatgatgacattccagactttgatgactagcacccacccct

SEQ ID NO: 236248 - DNA, 501 bp, Homo sapiens
gaccgcgctcttcgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccggctaccgtggttactcctatgatgacattccagactttgatgactagcacccacccct

SEQ ID NO: 236249 - DNA, 404 bp, Homo sapiens
ctgggattacaggcacgagccacctcacccggcccatacctatgctctcttctaagaattttatagctttatctcttaaatttaggtattagatccattttgagttaatgtgtttatattatgtaaggtaggagtctaactttactcttttgcatgtggccagccagttttcacagaactatttgttgagaagactattctatcttcatggaattatgttgtccatcttgtcaaattgttatagatatttggtggagtaaactaaaggatattttccacataaatctccctgttataccataaggcagttatctttcctgttttgcagagaagcaaaacaagctgctatgagattatatgaactgtccacgtgaacacaattaataagtaatggaatcaggatt

SEQ ID NO: 236250 - DNA, 444 bp, Homo sapiens
ttgaactcctgggctcaaatggtcccacctcagcctcccaaaatgccaggattagagtcatgaaccactgcatctggccttagtgaaatcattaatttatttcaccttgatcagaagttggtgatttcattgtcattctagtcagttccaaataccgttaatctgtatatacctgttcctaaatgaaaattattttacaagtacttgatcttctctcacaatacgtactagatggaatgagtgttttttcaaggaaataataaaatacttacaaactgtaagaatactgggtcgtggcagtgtttgccttgagcatattgttaatatgattaaaaatatcaggactcaacctatacagcaaaccaaaatagagggtcttttaaaatttttctgttatttccaggatataaggtaattttaagacatgtgaagaagatgaaaaaa

SEQ ID NO: 236251 - DNA, 458 bp, Homo sapiens
  misc_feature (426)..(427): n is a, c, g, or t
  misc_feature (432)..(434): n is a, c, g, or t
atccatgtagcttttctctggttctgttttgatggtcaccaacaaattatagcctgtttttgtaattgccttattgagtgacttgccatggagatttgacaaggtgtggctcctgcttgggccttcatttgctggcatactacatgaggctgagagccgtgttagtcctcgcagtgggcagccaggaaagcagggcttagcaagggctatctagggccttgaccaagtacagtgtacttggtagctgtttcttgcccacaaagcaagtgaacccaggtcagatttggcctgtcagataggtttgcacttttgaattttgaaatattctaagatgtaactttgtttatttatttatttagagacagagtctcattatattgcccatactgaagtgcagtgggccgagactgcgccactgcactccannctggnnncggagtgagactctgcctcaaaaa

SEQ ID NO: 236252 - DNA, 588 bp, Homo sapiens
cctgtttttacttaaatctaagattaaagcaaatgctaaagtcctattttttccaactttttctgctccctctcttctcagaggtaatcactgtcttgaaataaagccttctaggaactttttttgttgttcttctgcataactggattttatattataaagaagaaatcacctcaattatgttcagctgttttttaacaagtaaatactctttacaagtacagaaataaacttgaaagttattccacagaactctttgtaaattatcacttagaactatgttattcctttgtagaagatgtggaaatgatttgagatatttagacttttttgtaccaagtaggtggcatcactttgaagttgagactgagaggtgaagatttatgttttctgaatcagctgtgatactatcaagtaattttcatctattgtgtatctttgaacattaacagtggttgaccagatactgatgtgtcatttgttgctgcatttttgataatggaacataaatttaaagtatcagttcgggaattggccatttcatatttcttaaggaagccattattaaagcatgtgtaatgaatgaaa

SEQ ID NO: 236253 - DNA, 197 bp, Homo sapiens
ctgctatggctagaggtgcttggggccccccgacctaaccacccaccaccatgttacagaggacactgacggccagagtggggctgggcctgggcctcctgcctcttggccttgctcttgctgctgctcaggatgaactgcacggggaagccctctgtcctcgctcacatgctaacccagtgacagcgcccactgtc

SEQ ID NO: 236254 - DNA, 804 bp, Homo sapiens
tattttagaaagctggattcatatttcacatcattggctttcaaatttgaagtgactgtcggctattttttttaagtatcatctattttatcttttgttgttgttgtcttcataatgtgttaacattaaaaagctttccagatggcttctggcttttaaatgagaaaattggatatttttactaaatattttcccttaaaaacctgccaggctggtggttattctataaattagtgagattaaaaaaaaggccccatttgcttttcctgttttaatcttaataagagcttgatttcactactcaataatgtcaaagtaaaatagcatcttaaaatggaaaagctttcttctcctactctatttctaatctcctgccttaggctaccatcataaagatacctaagattctacagaagagcatttctgataaatacaattcataagggtcaaactgcattaggtctcccagatttgaacaagtggagtccaactgtaatccacgatattagtgagtgtaaagaaagaatggccagtagaagctggccgcggtggctcacgcctgtaatcccagcactttgggaggccgaggcgggtggatcacctgaggtcaggagtttgagaccagcctgaccaacacggtgaggtctctaataaaaatacaaaattagccgggcatggtggcacatgcctgtaatcccagctacctgggaggctgaggcaggagaattgcttgaacctaggaagcggaggttgcagtgagccaagatcacaccattgcactccagcctgggcaacaagagtgaa

SEQ ID NO: 236255 - DNA, 483 bp, Homo sapiens
ggtcctctatacatgtgttccctccgtctccaaggccacctcctctcagctttctccattgcatccccttcccatattctctctcctttcatccctgtgccactcccaaagcccctgcactttccggagcaacgtatcagtccccaaaccccactcatgtcatgtggatggcacagcttccagtggggctgtgcctctagtgatctccccagacctggcgtcaccactgtggataagagagatgggacacccagtgccatggtggaggccatcatgccgcagaggagggtggcagaagcttctcaagcaggaatgcattaagttttgttttgtcttttaaaaacctcacccagaggccaggcatggtggctcatgcctgtaatctcagcactttgggaggccgaggcagatggatcacttgaggccaggagttcaagaccagcctggccaatacaacaaaaccccatctctactaaaaatacc

SEQ ID NO: 236256 - DNA, 385 bp, Homo sapiens
ttggtaatgtgtttaggagggatgggcctataaaataacgacaacaaacacgcataccactgtctttccaggactggattaagacctttagagagccgaacctcttaaaaagattatgctgttcccatccctctgtgatccaaaatgcaataaaaacaagagtaaactatcctcattgctattgctattgaagtgtactgtttgctttgcctgggctttgcccagggttaaatggcacacattggaagtccaagtcacgcttcggccacccaggtgctaaaatgagacatgaggcatgaagacgttgctgggcacttccacacaatcatcctacatgacctaattggatcgaccattttaatggaacggtctcatcaattcgagc

SEQ ID NO: 236257 - DNA, 471 bp, Homo sapiens
agatcaggtgtcccagggtcaatgtaccgtgagaacgtcgctcctggaatatttccccggtctcaaaatacgaaagtgaccctgcagggacagcagaggacttccatcttgggaccatgaggttactgcacggaaatctttactcttgggagtgatctgcttacattccgtgttgagaaccagcacaacatacggaggactgtgcatcttaaatcggtctgggatgctgggtcagtttgtccactttttgtgtagataaaataagcaagtggttaatagtgtgttcagtaggtacgacgtatcaggcaccatacatagagcaggacactgaggttcacagtgatatttttctactgtggtcagggttgatcacaaagtatgcagcatggcagaaaccaccaccacccgtaaagtgcttaccaaaattgacatgcctgtattttcataaattgtaacatttgttgtgttttg

SEQ ID NO: 236258 - DNA, 458 bp, Homo sapiens
ctttctaataatatattaaacttaacttggatattttatgcacttctctgcatttgtggttttctttcactctttaaaaaaagttttaaaatacctatatatgatgcatacatgatacatacaagtgtacattcatacatatgtgtgtaaacagtggtgataaagatacttgtccttggacagaatggttttggtaaatgtgctgggctgtctgctttggcagaatgtcttgctaatcctaattaaggtagtttaagcctcctatatatttgttttcaggtatttgatttcagtcaaattgtgagaagagattatctgtaaactttaacattgagacatttaggctgggagtgatggcttacgcctgtaattccagcactttcagaggccaaggcagaaggattgcttgagccaggagttcaagaccaacctgggcaacacagcaagaccctgtctca

SEQ ID NO: 236259 - DNA, 395 bp, Homo sapiens
ctcgatctcttgacgttgtgatccacctgccttggcctcccaaagtgctgggattacaggagtgagccaccacacccggccgccattgctttttagtttttgtttttatccaagccacataatatagtgggtttttaacaaaagggcagtcttgacatttctcttcttcccgtttttgttactgcttcacaactgagtacgtaacaactggtacttcagtgatacagtggcctattttctttcttataaaagacattactatatcatacagtattttaacctttcctttacaaatctcatgatactgagatgcctttggttaacaaaaattgccattgagtctggaagattgtttgtttgctgactgaccagccccctcatctcatccttctcac

SEQ ID NO: 236260 - DNA, 497 bp, Homo sapiens
cactaattcaaggtcaatttgagattttttttttcctcatatggttcagccagttctagctaaaatgtaaagaattaaactcatttggaactgaaaaaaaatggataaaggaggtttttaaaaatcaaactgccatagaaactgctttacccaaattattgatccactgctttccttgggttacctattggggcaaataaagtttagccatgtgaacaggtcccaattttatcaaaaataatctggatccagctgtcttttatatagtaatgagtttgtgaagctagaattccaaaagctattggtaaaagctatcggatcttgcatgtatatgtataaacatgtttaaatgtgttatgtgtatgtgcatgtattatgctatgtgttatatctagcatggtaccgaatagcttataagtaaatacgtactcataaattaaataagtccagatgctcttcaggttcacgtgaattcaataatctttggtgaataagct

SEQ ID NO: 236261 - DNA, 421 bp, Homo sapiens
cattttggtggggactgacgacagactctaaagacaccctttgcccacctctagagtcttagcatttcttccattgacgggatttcccaccagcgccccgtagccaccctgcgtattccataccaggattcactggcccaggacgtggaaggacagactcttctgaagtggctccacatttcattgtctcctcacctagctgagacctcaaaaattccagaacattctacttgtttcacctagtttaattttaaagatcttggactttgaattccaggtggcagactgccagtttggagggcaagttgacagtcttgactaaaatggaatgtgtgcaaaaggtaagataagcacgttacaccccttcaccccatcataagcaatgaccaaaaagaccaatcgtttaaaaacaacaacaaca

SEQ ID NO: 236262 - DNA, 490 bp, Homo sapiens
cactgtgaaatctgggtaagattcaaagttaaagaagcctcgttaggagcctgttgctagttcagagcaggtttaagagcagcttgacctggatgggcgtgtgaatggaagacatattttttagaagattatttgacaatattatcaaaagtcttcatttgtgtacatttttaacccagcatttccatttctaggtgtttattctaaagaaataatttaggccaaatgtggtgtaatcccagcactttgggaggccgaggtgggtggatcacctgaggtcaggagttcgagaccagcctgaccaacatggtgaaacctcatctctactaaaaacacaaaattagccaggcgtggtggcacatgcctgtaatactagctacttggaaggctgaggcaggagaatcacttgaacctgggaggcggaggttgccagtgagcctattgcaccattgcactccagtctgggcaacaagagctaaactccatctca

SEQ ID NO: 236263 - DNA, 516 bp, Homo sapiens
tgagacagaatcgcactctgtcacccagactagagtgcagtggcgctatctcagttcactgcaacctctgtctcctgggttcaagcgattcttgtgcctcagcctctggaatagctggaattgcaggagtgtaccaccacgcccagctaatttttgtatttttcgtagagactgggttttgccatgttggccaggctggtcttgaactcttgacctcaagtctgcctgcctcagcctcccaaagtgctgggattacaggcgtgggccaccacacccgaccaagaatatattttcttaaaaagtatttggcttttgtccttggttcctgaagtagctcctgaaggataaaggtgaaagacagtctcttcttacttacaagatacttctttctgtcttttttcccgcacatcacctcaactttccttttctttttttttcccccattcccctacctgatgcaatggtcttaggaccagggctgcaactacatgtgctggaagcaggaatgattcctag

SEQ ID NO: 236264 - DNA, 615 bp, Homo sapiens
tcatatatagtacaggaaaatctattccaaaagctcagcacatcttatagccttaattttttacaaagttaatacatgttcattttaaaaaactggaacaagatagatgataagttaaagatagatgatatatattaatagatggatgatagatagaaatagtagctgcaaagtgtaggctatctactgtatctggcactattgtcattgattactacatttaattatcacaacgaccctgtgaagtagaatattcctgatgttcagattttttttaagcaattttaaggagtaaggtgttatgttactcaaaatcttatagttaacaagttacagagctgcgatgtgatcctttgcattgtgtctcaagatcctgtaatgaatgacaagtatgcaatacagacctggacataattgttattaatagggtcatttcagatcagtccaggcctttttttttttttttttttacaaaagtgagatcatacttatataatactcagcaacttgctctttctcactcagcaatcatagataaccttgcatgtcattctgcatacatctccttaatacattcatgctttggttaacaactttcctgcttagcaacatacc

SEQ ID NO: 236265 - DNA, 361 bp, Homo sapiens
tgggttccagccacaggggccagcccaggcagggctcaaggaacctgctttctgggtgtgcaaggtccttgggtcctggccatctgaaccccctctgagagcctagatccaaacccataagcctttacatggagtccctcagagatgggcagcctgttgccctggaaacactcctcttgtttcctgtccatgaccagggcctgccttatgctgacctgaatgaccatggggactcaggcactcatggatgggtggggaaagcagctgggacctcggttcctatgcaaggcttggtgaggtgcctcctctttggggctccccaatgctaaggggagatagataataaacaggtgtgtcaaca

SEQ ID NO: 236266 - DNA, 684 bp, Homo sapiens
tgctaattcagataggctcccttttcagaactctgttttactgggtaacactttcctcccttgacaagagatctttaaattgcttaggttagccttacagaatgagaaaaggaagacatgaaactacctatgagtatgcagggtctaaggaacaggatgtgagtatcttagggtcaatgaagcaacttaactgcagaatcattacctcctatagaaggaatcttatggtcattcttttctttctccttccttaagctcttaagacactaaacgcagtacaccatagttcaaaaagcactggcattggaaataaagtttaaaacgttcaagtgcaatttgatctaaatgtcagttagaagtgtaattttgggcaagttgtttacctcactgagcctcagttttctcacctgtaaaattgggataatgtccaatctataggtttgggagaattaaaataataaacaaaagcaccttgcttaatattagtgaaatacagtaacaacaacacagaagcaaattccaaaaccctcaatccccaaactggaagctggttccattaccgatagcctccatctatagctaacatatacatcctgcctactatgatttcagcacatttcctcttagatggatattattttattgtgaatatatactgataaagagtaatagaagtattaaaac

SEQ ID NO: 236267 - DNA, 362 bp, Homo sapiens
ccctcctggctgctggttatttttatgatcaccccgcacttgcatgcctccccgatatgtctgccagccctgcggatgtggccgcctgggacgcgggtctaccctgagcagatcgtggtctgggccgtggcttcctttaggggaaaattcaggatcctggctgagcctgggagcgcttcctgcctcctgcccctccacgtgggttgtgtggaagcacccagtcctcgtggagaaacactggacgtgtctctctacaaaagagcttttactgttagtggtctagttttttttttttttttctgtttctcaaaattaatcagtgacatagagagctgccaatcagactgcagtctgtgcggccg

SEQ ID NO: 236268 - DNA, 711 bp, Homo sapiens
tcaagttttgctgccaccatctgaggaataattttatttgattttggcattgatttcactgttccatctttctttcttaaatagtcctactaatatgaataatagttaaactcatttgctttacaaatattaactcattgaattctcaccgtatttctgtaagattgctgctatgcaaatgagagaaccactacatgtattataacctgcccaacatcacacagccagaaaatggctttaatccagactggtttcatgtgtgtcataagctgtcccctcattcctcataagatattatatgtagatctcagatagtttgaagaatttctactcccagcacttgtgtttattggcgcatgtctttactggttcattcttaggactgtaagctccctgaagggagagaatgtggccctttagatattaagccgccgccgggcgcagtggctcatgcctgtaatcccagcactttgggaggacgagacaggtggatcacgaggtcaggagatcgagaccatcctggctaacacggtgaaaccctgtccctactaaaaatacaaaaataagccgggcgtggtggcggttgcctgtagtcccagctactggggaggctgaggcaggagaatggcaggaacccaggaggcggagtttgcagtgatccgaagccgcgccacttcactccagcctgggccacagagcgagactccatct

SEQ ID NO: 236269 - DNA, 419 bp, Homo sapiens
  misc_feature (10)..(10): n is a, c, g, or t
caatgtgtanagagttccagatgttccacatccttgccagtacttgatattgtcaggttttgtttgttaagtagttctaataggtgggaatgggtcatatgataattaaatatttaactttgtagaaactgccaaactgttttccagagcagctgcaccattttgcattctcacctgcaatgtgtaaagagttccagatgttccacatccttgccagtacttgatattgtcaggttttgtttgttaagtagttctaataggtgtgtagtagtatttcattatcttttgattttacatgttttttagtggctaatgatgttaacatcttttcatgtgcttacttgctattcatttaaccaaagaggataaatgcggacgcgtgggtcgacccacgcgtccggttctagatcgcggccgct

SEQ ID NO: 236270 - DNA, 267 bp, Homo sapiens
ccttaggcatttttactttaccacacatttcagaagagaaggaatgaaggggaaccagctaatctacaaatgttcacctacagtagatcaggccaaaaaaaggagagaagaatatgacccaaagcttcttcagaaataagaactgcttattaatagtctaatgcaggggtgtccagtcttttggctttcctgagccacactggaagaagaagaagtgtcttgcgccacacataaaatacactaacactaaagaaagctgatgagcta

SEQ ID NO: 236271 - DNA, 1601 bp, Homo sapiens
agatgatgctgtttttaggagattgtttaaaagttcatgcttgttagtgtttggtacttaaagatacttttgaaaatggtttatttgccatctttttttgtgtgtgtgttgttttttgttttttggttttttgagatggagtctcgctctgttgcccaggctggatggagtgcagtggcgcgatctcggctcactacagcctctgcctccctggttcaagcagttctcctgcctcagcctccaaagtagctgggattacagtcatgtgccactgcacctgcctaattgggaaaacaagttttaaatgacatctcttttttccaccagatgttgctgtagcattacatttatctgctgtgttaaattgttactaatatgcaattatgtaaaataactttttaactgaaaatcttaagtgtagagatagcttactagctaatggttcaattgtaaattcagatgagccactgcgcctggcctatttgccatctttgagctaagctaaccgtacttaagagtttgttttcctttccaaagaaaggaatgtagagagtaatatgttggtaatatgatttatattagtgaagagtattatgaatggagtttctatttacttgttattaaacaagttcaaatgatttttttttttcttttagtgattagctttttcttactgcttcaaatttggtaaaagtgttctatgagatattattttatttattttttggagacggagtctcactctgtcacacaggctggagtgcagtggcacaatcttggctcactgcaacctccgcctcccaggttcaagcagttctgcctgccatagcttcctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctcaaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaaattaagctcaattctgtattttattagggctctgttatgtccttcatctgaaatgtacacatttttggtgtatgcttggtactggagattcatatatgcaaatattctcatgcaagaagttccacagtaacaacagc

SEQ ID NO: 236272 - DNA, 363 bp, Homo sapiens
atattggtgaagatttagaaaaagatcatggatgattgtagacataaatatttaggtagctgcagagcctgttggagagtcaattgtagaggacagcagttatcttgaacctgcagattaatgtgatacaaagtttgtgaaaggtagttcttatatattaagttctgaattactaaagaatatgaaactatatctaaaatgaggaaaatggtgaagaagctgcattgtctataaagaagagattttaaaaaatgaaaaatttaatggaaaatagggacagaaggactagaaatatagaatagttggaagggaatacaaatgcaaaacaaagtaaattgtgaaaagaagaagcactttatatag

SEQ ID NO: 236273 - DNA, 625 bp, Homo sapiens
catttccttgcatggacatgggaattcactgctagcgaggctggtgatgaactccgcaaaagctgggaaatctcgtttgagcaggagcgcccattatcttggccaagctgctgcagctgggctgagtgggtgtggaagtgtgggtggtattcatgtaagttctccagccaagcccaagttcctctgcagacctgtgcatgatggcatatccagatgattccaacctcctgctgtggattcagtcccgcttcataagacttctctgcagtccccagacatcaacaaggaccaataagctatcttttctgtgtcttacctgaattcttgtccctgtgaagcattagcaaattgaaatgtttgttttctaccagcattcgggggtattagttttttttatttaaaaataatcacagtaaagacatcaggaataacacacttgtaggacattcacgaggtacagaagtatgcacaccgaaatctggacttgtcttttcctcttctgtagcctgccagcttctgcctctggaagtaacaactgttaagtttctgcacatctttccagatttattaattgaacaatcatatagcactgacaccgtgacaaagctttgtcaaaggactttgg

SEQ ID NO: 236274 - DNA, 697 bp, Homo sapiens
gtcttactgtcctctaggctggagtacggtggcgtaatctcagctcaccgtagcctctgccgccctggctcaaacaatcctcccacctcagcctccccaacggctgcaactacaggcatgcaccaccacgcccagctaattttttattttttgtagaaatggggttttgccatgttgcccaggctggtcttcaactcctgggctcaagcgatcctcccacctcaacctctcaaagttttgggattacaggcatgagccactgcagtcagccagtaaggatcactcttatccctagtaaaaaggatccgtgatacaaaatggccactgagtcccttctctctccccagtctcttacacattctcataaacagtgattgactcacttattttctgcagaagatagaatggcatgaatgggatggaaacggttcatatgactacttggatatctctcatcctgtgaaccagtctaacaagcaattaccttgaggaatctgaaaataaaatcgtgatatgaattcatgaatcaggaaagaaccgtgtacttgcataattagctttctttagagaatggggaaatacatatctgatacaagacaatttttaaggtgtaatcccatcatttgcaagtcactaagaataaatgtgaaggtgacagtgggaaaaaaaagaaagagaaagagagatgggttggtat

SEQ ID NO: 236275 - DNA, 643 bp, Homo sapiens
gtcttactgtcctctaggctggagtacggtggcgtaatctcagctcaccgtagcctctgccgccctggctcaaacaatcctcccacctcagcctccccaacggctgcaactacaggcatgcaccaccacgcccagctaattttttattttttgtagaaatggggttttgccatgttgcccaggctggtcttcaactcctgggctcaagcgatcctcccacctcaacctctcaaagttttgggattacaggcatgagccactgcagtcagccagtaaggatcactcttatccctagtaaaaaggatccgtgatacaaaatggccactgagtcccttcctgcagaagatagaatggcatgaatgggatggaaacggttcatatgactacttggatatctctcatcctgtgaaccagtctaacaagcaattaccttgaggaatctgaaaataaaatcgtgatatgaattcatgaatcaggaaagaaccgtgtacttgcataattagctttctttagagaatggggaaatacatatctgatacaagacaatttttaaggtgtaatcccatcatttgcaagtcactaagaataaatgtgaaggtgacagtgggaaaaaaaagaaagagaaagagagatgggttggtat

SEQ ID NO: 236276 - DNA, 537 bp, Homo sapiens
cctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccg

SEQ ID NO: 236277 - DNA, 453 bp, Homo sapiens
ccttattgaaaggaatcagtggaaagctataccatatttatgggtgggataattaaaaatcattaatttgatatcctgcatttttctttatagcatttacttctaccagccacactctaaatttgtttacttgcttatcatgtctatcatgtctctgtctcctggaatataagctccaagccgggaacttgttttgtttcttgctctattctcagttcctagatcagtacctttcacatgggagtggattaataaatatttatttaatgaaggatgaatgaacgaatgaatgagaggtattaacactgtttactctgctacaggagtccttggctaaaaagattgagaaccagtaagctatagaacactctatgcaaaacgaaaaccacccatacttttcacatggaagcataagacagttttaactaaataaatgaaaacttttcttcaaaa

SEQ ID NO: 236278 - DNA, 476 bp, Homo sapiens
tcgaagaatggaggagcttcacaattcaccatcttagccaccacttaccatatgtttagttaaaacattgaggtggatataaaactgtgttaaatgtgaaagactcgggagccagtacatctcctcttaagcctaacaaggaaacccaatatagggagacaagccaataggatgaatgtcagatgcagtaggagggtgatgcacacagcaaaaatgaagacattcaacatagggagaaagcccatccttacggtcaattacagaaatacagcagacttatatcaaggttctcttctgctttgctttaatagaaattacaacatttaatactagaaagagcataaggatctagtgtaatgttggtgccatgggaaactgatacaatgttttggaactcagtaaaattatatttagcaaaagtgatttgcatattctttacccagtatggttaatctacactaaagaaagaactcaac

SEQ ID NO: 236279 - DNA, 445 bp, Homo sapiens
aacctcctctcctaaactcctcgtgtgtgtccatgtcctaaattttcctggcatgagatgatgaaccccaggtattgatttaccccagacaatgtagccacttcatcatcgcatctccttctcttaatctgatcttcctcctttctttataagggtccttgtgatttcactgggcctacactaggtaatccaagataatctcccatctcaaagtcttcatcacattggaaaatgccttttgccatggagggtaatatattcacagattctggggattaggaagtagacaattttgggaggaggcaatatatggactgagtcccaggaactcgcatttctaacaagcccccaggtgatgctggctcaaggaccacactctgagaaccactggggtagactaactactgtaacaagtagccccaaaatatataatggcttaaacaca

SEQ ID NO: 236280 - DNA, 413 bp, Homo sapiens
ccttccgggatgtatgtgcagcttttaggaattgaaaccaccagctcttggaaacttgtgccaggcttcagggtgggagaggcagttttagagctgcagccgccaagccaagccaaatggccccatcatctctcgcaagagcaggagagtacctgggggcagaggccatagttgtacctttctaggcaaagggtcagtgtctgtagtgtccatatgggcagtggggctcggggggaagcaggcccaggggtctgtttccaatgacctcctcaaaagtcagaactggaaggcaaaaccccgtatagactgggtgcacctgtaatcccagcatgttgggaggctgaggtgggaggattgcttgaggccagagtttgagaccagtcttggcaatgtagcaagacccctgtctctac

SEQ ID NO: 236281 - DNA, 453 bp, Homo sapiens
ttctacaaacaccaaatttgctgtgaaatttacatttcagaatctctcaagaaatagtgcccagcagcaattcttactgttttcactttttcccccgtcttcacatttttatgtttgacagtgccaacatattttctcaacatttattctgaaaggaatgtactttgtgaattccttaaatgcaggatgattctgattttattggcctaatagctcctccttatgcgtgggttagtataacagaatgcatttgagacctgctatactattttaaattaagacatttcatgtagcacatagtattttaaaatgaagaacattgtcttggaaagcacacaggctaactgctattttcttgatgcaagaaatatttaaattctctgtgcttcagtctatacaatcagttttccagggatgctgtgtatataaaacgagggagtgtattaagagtat

SEQ ID NO: 236282 - DNA, 371 bp, Homo sapiens
gcggtcagagcggacaccgaggccgaggaggcgctgagagcgagcgagggctgctagcacattgtcacctctcaataagccactcagtctatggtaatttgtttttgcagctcgaagtaaaacaagttgtttcagtattaattcttttttaattgtcataggaaacccaaatctaaacagaaagttacagcttaggctgggtgcggtggcttatgcctgtaatcctagcattttgggaggccaaggtgggcagatcacctgaggtcaggagtttgagaccagcctggccaacatagtgaaaccccatctctactaaaaatacaaaaattagcctggccaacatggcgaaaccccgtctctactaaaaatac

SEQ ID NO: 236283 - DNA, 493 bp, Homo sapiens
atttaatattctgttgtgtgcataccatggtttatttaactagttttctggtcatttaggtagtttccgcttttacaaatagcactatgatgtcaaatctatttgtagggtaaattcccagaaatggaattactggactgattttgatagatgttgtcagctattgtatttctctcattgtgagtgaaggggaataccttttttttgtttaagagccttttggctgggcacggtggctcacgcctgtaaccccagcactttgggaggccgaggcgggtggatcacgaggtcaggagtttgagaccagcctgaccaacatggtgaaaccccatttctactaaaaatacaaaattagctgggcggggtggcacatgcctgtaatcccagctacttgggaggctgaggcaggagaattgcttgaggcggaggttgtggtgagccaagatggcgccattgcactgcagcctgggcaacaagagcaaaactttgtctc

SEQ ID NO: 236284 - DNA, 231 bp, Homo sapiens
ggatttcaacatgttggccaggctggtcttgaactcctggcctcaagtgatccacccacttcagcctcccgaagtgctgggattacagatgtgagccaccatgcccagccatttcctcatttcttgaaagtaatgatggatattatatgccctaccttcctcacagtttgcttgctgctcaagtgaaataatggttgtgaaacttcccctaagaaggcttgagagcttaat

SEQ ID NO: 236285 - DNA, 532 bp, Homo sapiens
aagggttcaccacttcctgtgagagggaaacggaccagctgggctctgagctccccacccagcctcagccagggtccattttatattgtgggcttcagacatgcctttgtttgaaagcagttctgctgctttaaaatgtttgataaccattgaactaatctacccacctccctttttaaaaaaaaaaggaaaacttttttttaagctgttttttttgttttttgtttttttttaaactgtaaaaacaatacttaggtctggctcagtgtgcctgtaattccaacactgagaggctgaggtaggaggattgcttgaggctagaatttcgagactagcctctgggcaacatagacagacctcatctctacaaaaaattttaaaaattatccgggtgtggtacgtgtctgtagttccagctatgaaggactgagacgggaggattgcttgagccaaggaattcgaagttagagtgagctatgtttatgcctctgtactctaggttgggtaacagagtaggaccctgtctctaaaa

SEQ ID NO: 236286 - DNA, 543 bp, Homo sapiens
accacatgtgaagacgccgcacagccttcctggaggctgtgtgccccagccctgccatcagctgcctgctcccgctcacgtctccccagttcacctgcctccagtgctggtttatagaacatttgtgtgacttcttcagatgatctgtaaacagaggcagtctaggtggtgttttgttttctaatttcctttatggaaaggagagtttgcatttcccttgtgattttgacacacattgtattatgaaatattttcagtgtttgtcaaactcggtgtggggtaagcgcatcccaccaagataggcgcttacaggcagccaaggaacccaccgtgtggtttccttttaggttggatttcctgtcttacagcctcatgttcctagttggaaattaaggttgagactgtagccaggtgtgcatttattcatccgccagctctggagaggtctgctttagaggccctgcggccccagaagtcatgcctctgagtccgtggttcttagctgagggtggctttgcagtgtccggagatgattctggttgt

SEQ ID NO: 236287 - DNA, 482 bp, Homo sapiens
aaaccagcatagtagagacccaactgctgaaatttatttcatatgagcatttggagttattctttctatattttatgaaagtaaaaagttatttatctctctccttcttttccccccatgaaatacttccatcctatcaataccaatgcccaaactacagaacaagtaaacaaaaactcctaaaatctagaaaattaaaatgaaattcaggtagttgtactctgctatgtctgctaccattttctggctgaataatctttacttatataatattccgtataatgtagcttcttcatctccatttaccctgattgaacttcctgaaatgaagatatgccaaaaatccttttcaaaaaggctcatttaaataaagatttgtttagatgaaaagaaatgtctcttcaaacactgagatatactctggcactgcatgtcaacgatcacatgttgtgcattaaaaagaaaaattaactatgcaagta

SEQ ID NO: 236288 - DNA, 463 bp, Homo sapiens
ctccctgggaagcagcgctgagtcagggttacctggctccactgtgcccctagcgaggtgaaagttcgcacaatgacatgggctctctgttgaggataaggaggctacagcccaaggagcttgtgcaccgcaggcagagccactcaggtcatcttccagagcgggatgtctgactccagagcccgccagcccacactgctctcctgaggactgggtttctctggcctgagtctgcctgagtctacaggaagaaccctgctggcaccccagtaagcccctctagaccttggagctctaactgctctcagagctcacttttcagttagcctgtaaggcaggggtgtccaatcttttggcttcccttggccacattggaaggagaattggcttgtgtcacacataaaatacactaacactaacgatagctgatgagctaaaaacaattaaaaatcacaaactcata

SEQ ID NO: 236289 - DNA, 456 bp, Homo sapiens
acatgtcttatacaaattttctgtatattagttgtttatagatttgccaaaatcgatttggctgcttctctggggaaggggaggagggggtgttgcatgtgtaaatctggctatcttgctgggaatggttctaggtaatgtagatcgtgcaaattaaaatgctttctttcatttattccttcgacattgagtgcctagtctgttccaggtgttaatactattctgggcactgggggatacagcagtgagcaaaatggccaaagtccctgccttcattaagctttcattctagtaaatgagatagacaataaaaaagataaagtactttgggccaggcacgatggctaacacctgtgatctcaacacttggggagtccagcgttggtggattgcttgaacccaggagtttgagaccagcctaggcaatatagtgagaccttgtctctactaaataga

SEQ ID NO: 236290 - DNA, 544 bp, Homo sapiens
caggctggcacgggctctagcgctaaagcaccctagagaaactgtcagagaatgtcccctttgctaattcgtctctgaaagacgcctgccgctgccgccaactgcgaactgggcgcagggactgcgacagcagtgaaagagaacacctgatgcgttcatctgcgctacggaaggacacgtctgaattcctccacggagcacactctgcactcggtttatgtatcagaaaaaggaaatgccctcgtgccctgactcctggccttcttggagcccggaacagaccaagaggaaggggcatcacacattgcctgacagtggtgtgcgtccacacagcacaagctgaacgggaaatgacacagtcattagacagaggagacagtactcaagctggaaccgcagccaacactgagatgataaaaggaagtcttcctttgtttcccctgagtcaggaacgtggaaagagaaatctcaggggaggggttaggtttttttgttttgttttgttttttaaagaacagtttcacaaattatcgataaatatttg

SEQ ID NO: 236291 - DNA, 402 bp, Homo sapiens
tcttatgacactataatcaagactacattactggattccaccctaccaggcctttgtatctaaattatttcaatacaaattctgttattttagtgcattgccactttattaaggaggtagctggaaagcttatgcatttcagaagaaaacagtagccatgtcccttcagtgaaataatgtaggcaaatcatttacatcacagtcattcaaaaaacattagttccctttcttccacattctgtattctattcaagtttaacttataaaatgatccaagtagtattaataataagaaaaaatatttgaccttctagaaaggtaaggaagtatcttaactcacctaatattttttaatctactgttggatgttataataaacacacgcgcacacacacacacaca

SEQ ID NO: 236292 - DNA, 693 bp, Homo sapiens
tgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacgtgagtatagaatgagattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacaca

SEQ ID NO: 236293 - DNA, 476 bp, Homo sapiens
tgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacgtgagtatagaatgaggtaaaggacactgggtcctgatcatgtaggggtttagggtgttccatcagctattaagcaaacaaacaataaaacccacaacacttt

SEQ ID NO: 236294 - DNA, 856 bp, Homo sapiens
cggctacccattacaacagctccagttacaacagccccagttacaacagctccagttacaacagctccagttacaacagctccagttacaacagctccagttacaacagctccagttacaacagccccagttacaacagctccagttacaacagctccagttacaacagctgaaaagagacaaactaatgcacaattacagctagggattaatttaacatccctccttagtaacagaactagtatatacacattaatcagtaagaatatagaactgaaaatcataagccgactggattaaattgacatttatagaacacaccaccccaaactagcagaatgtatctcctgaagtacacatggaacattcagcatgatcatatctttgctcataaacacacctgatttaaattgacaaacttggatctagtatgataaactgatggctatagacaaaatcagcaccttatttatccccaaagatgttaagtcacttaaccttgatgtgaatacggtggccaaattagaagcggacaattagaatataaaagaaaatgctcaagaattaaatggtggccaggcacagtaactcctgcctgcaatcccagtactttgggaggctcgcttgagctcagggttttgagtccagcctgggcaacacacagggagaccctgtctccacaaaatgttagccagacatggtggtgtgcacctgtagtcctcgctacttggaaggcttaggtggcaggatggattgagcccaggaggttgaaactgcagtgagctgattgtgcccagcctgggcaacaaagcaagaccccatctcaagaaaaataaattaaaaaaaactaaaaaaa

SEQ ID NO: 236295 - DNA, 434 bp, Homo sapiens
agaaaatatatctttgaatcaggtgataatagtgtagaaggaatttgattaaatgcatacaaccaatatgatttctagcattaaattgcaatgtatattgtgttagtgaaaaaatcattagtaaaaatatagtccagtggtgtatcctgcttgaatagagcatgctgggattacaggcgtgaaccaccacatccactcccttgttttattaaagcgagaaaaatagactcaaaacataataactgaagtatgtctgatgtttttgctactacctcatcttgctattgaagccactgttacctggccaggcatggtggctcacgcctataatcccagcactttaggaagtcaaggcaggagaagcgtttgagctcgggagtttgagttcagcctggacaacatagcaaggccctgtctctagtcccaaaaaaaaa

SEQ ID NO: 236296 - DNA, 358 bp, Homo sapiens
aaagtaatttttttttttgtaaaaagagtttatgggcaatgctggagtttagcctcttgggaaatgatttaaatactggcaatgttttactagatgctaaagtcaagaaaattttattattgagggtgaaatggcatgataatataaaggtaacaagttatccttatggtaattaaactgtattgcctagaaattccaatgaaatgcttaatgagataatgcccaaaataaattcatgtttgaaagagtgtattatagcaacacaaggcagtgttacttgtggtaaggtaggacctatgctaaataaactaatgacctaaacataatgagatgcaggttagctaaaaagctctggctc

SEQ ID NO: 236297 - DNA, 466 bp, Homo sapiens
ctgcctggcgtgctgcagtccttggaagcctggagagggcacgagggcaggccaggagagccgggatggctccaggagcaggtggacctcgagccacgcctcggaggctggtgggaggagcaggggtcagcagggttgggaaaaggctgccccaggtgggaagacccatgggtgaaaagaccgggctccacagacggctcacggagcaggtgcctccatatgtggctggagcccccagcgagggaagaggccgctgtgctgggggtttgtacctgggcacgtgggcacattggcactatttagaagatcatgttagaggcaggtacagtggctcatgtctataatcctagcatttcggggggctgaggcagaaggatcacttcagtgctggaggttgagacaggagtgagccatgattgtgtcacagtagcctgggcaacagagcaagaccccatctctaatcaaa

SEQ ID NO: 236298 - DNA, 287 bp, Homo sapiens
caggcgtggtggctcacgcctggaatcccagcacttgaggccaggagttccagagcagcctgggcaacgcagtgagagaccccatctctacaaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaaaaaa

SEQ ID NO: 236299 - DNA, 1142 bp, Homo sapiens
tggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttga

SEQ ID NO: 236300 - DNA, 652 bp, Homo sapiens
ttaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctg

SEQ ID NO: 236301 - DNA, 3367 bp, Homo sapiens
  misc_feature (488)..(488): n is a, c, g, or t
  misc_feature (491)..(491): n is a, c, g, or t
  misc_feature (962)..(962): n is a, c, g, or t
gcaggtgccctgtgctcatctctgcctgggaatggggaggaacagatcttgggggacattggggagtgggcggacaagcactccagggcatcagtccgggccgctgaccaggcggagggcagtgtcccaattatacaggcgttacctccttttctccatctcagcatctgatccctccctccgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgttgcggccagcgttgccggggcatcccttcntcnttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttccccngcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctcaaaaaa

SEQ ID NO: 236302 - DNA, 2680 bp, Homo sapiens
  misc_feature (488)..(488): n is a, c, g, or t
  misc_feature (491)..(491): n is a, c, g, or t
  misc_feature (962)..(962): n is a, c, g, or t
gcaggtgccctgtgctcatctctgcctgggaatggggaggaacagatcttgggggacattggggagtgggcggacaagcactccagggcatcagtccgggccgctgaccaggcggagggcagtgtcccaattatacaggcgttacctccttttctccatctcagcatctgatccctccctccgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgttgcggccagcgttgccggggcatcccttcntcnttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttccccngcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcaggacggcagaggtggaatcagggatggtgaagagggaggtgatactccccttctggccaactgacccaactgggatgggggtctccacagcatgactttggggcctggatgcccaatgctccatcatccatgaggcagcccccaccccagaccaaggggaccaccaccctgaagacttacctagacaccctccctgaagtgaacatcacttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctcaaaaaa

SEQ ID NO: 236303 - DNA, 964 bp, Homo sapiens
  misc_feature (50)..(50): n is a, c, g, or t
cagccacactttcaatcacacgaacacacatcccgccccgaagactttgngaaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctcaaaaaa

SEQ ID NO: 236304 - DNA, 429 bp, Homo sapiens
tctaaaagaaaaaatcaacgtgagttagatagcatttgtgatgatctgaagaaatatgtgacgtttatcagaattaaacatggctcaaattaaactaacactagagtttgttctcagttacgtgaaacacccacaatccttcaaggttgtccaaaataagcagagtgcttactgtgtgagcgcacccaaagctatttttgtaacataattcatatttatgaagtactttgtatactaaataggaaaatatgtactccttaatatgtatttaatatgcctgacttgttttcctgatcacagtgaatttatcagtaagtataaatgtagacagaaagaaatatactaaactgaaacaagctggtgtgaacagaaatattctggactttgtgatcaggtgtaacttaaaaacaaaaaaattttaaaacaaac

SEQ ID NO: 236305 - DNA, 1168 bp, Homo sapiens
ttattgggaatagtcagcaaggtggtgtgccttgcccggcagacgcaggtgagggtggacaagagttgaatttaacctgcttggggtttggcaggtgcgtacacctatgggttcgagtggcaagggagtttagaccgaataattaaaatgacggagcatggactttatgctgaggaagcagagaaaccgatggcatagggatgggtggggggcagtgaaaaggcgggtaggatcaacggattgttgtgtccctatgggctgtcgaatgctgcggctggagtgctgacttttattttgtagatttcagcatatatacatatacgctgaaattatatattacatgctatatatgttattatatgttatatattatctgcatatatacacacacatattcccagaggaagttaaacttaacctggtctcatatatactacacatataaaatatgtatatacacatatgtatgtatacacacatagacatgtatacacacatatatacatatgtatatataaaaatatatacagatattttaaatttcatatatatttcccgtcccctccaagagccctttctgacccctgacccccttctttagcagaacccaaatggtttccgtgggtggaacatctccctgcgtttctgaggacatcagcgcacgtggtttctttcccggccgccgcagcccacttggtcggtttcctcctagttttggcctggtgccctccccgcggggctctgccgggtctgcgggtcggggccgtccgtcctttcaccctggaggagagaaagcagagatgggaagcttgcgcgctcgggcggggccagtccaccgagcccgacgaggctcggacggccccggaggtgggcgcgcctcggccgttcctccgcggcgggggctgctccggacgccccacgtctcgggcctgggattcagcctgtgagtgggggcggccggggcggcggctgccgggaggggctcattgttctgccggccgctttgacttcattttctgcttttcatcccaggccggacggtttagaatgcaaatgcgggctgcttttgtagctgtgcgtttgtctgggagccgtgcgtttgtctggggtgagatcacagcaaaagggttttgtttggctttttaaattcttctggggagagcaaaag

SEQ ID NO: 236306 - DNA, 653 bp, Homo sapiens
cccaaccccaccccctctacctccacccccagggagtccttttattcttaggcaggttcctgagtgcctcttatacttcccccgaatcccatcaacctcccagcttaaaccctcctctcccaatattccaatgttatagtaaaccatttttctatcaaaatagaatagatggaaatacattcagagtatatctttgcttctctctttcaggatctggcagagctttgcttccacctgtctaggtattgggaattaaactggttcacttttttccattaccagaaatgtactaactttagaccaacataataaaagctctgatttctgacaaaggcccctagataaatgcatgttatgtttaaaaagctgtgtctcaattatacccagactgatttttaaatataaatgatgttcctaagatattacttaaataatttttaaaaatattgataaccagttcttttcatcaatcatgacattctcgattttaaacaagtctttttttgtgtgtttgtttttgagacggagtcttactctgtcacgcaggctggagtgcagtggtgcaatatcagctcactgcaacctccgcctcccggaatcgggcgattcttgcgcgtcaggctccagagcaactaggattacaggcaagtgcc

SEQ ID NO: 236307 - DNA, 599 bp, Homo sapiens
cccaaccccaccccctctacctccacccccagggagtccttttattcttaggcaggttcctgagtgcctcttatacttcccccgaatcccatcaacctcccagcttaaaccctcctctcccaatattccaatgttatagtaaaccatttttctatcaaaatagaatagatggaaatacattcagagtatatctttgcttctctctttcaggatctgttccattaccagaaatgtactaactttagaccaacataataaaagctctgatttctgacaaaggcccctagataaatgcatgttatgtttaaaaagctgtgtctcaattatacccagactgatttttaaatataaatgatgttcctaagatattacttaaataatttttaaaaatattgataaccagttcttttcatcaatcatgacattctcgattttaaacaagtctttttttgtgtgtttgtttttgagacggagtcttactctgtcacgcaggctggagtgcagtggtgcaatatcagctcactgcaacctccgcctcccggaatcgggcgattcttgcgcgtcaggctccagagcaactaggattacaggcaagtgcc

SEQ ID NO: 236308 - DNA, 492 bp, Homo sapiens
tcttctgctaatcccatccagtgtattttcaatctcacatgctacagtttccatctctagaaggccagttgggtcttttatattgtccttgtctcccgtctagctttttgcacacagaatatagttattccgtatgttttaatgtttgtatctaccaattatctgtgccagttctgggttagttttgattgattttcccccttcatttttggtcatatttttattactgtattttgtctcgttgcattggatatttttgtattccttaaaaacttcccatgctttattctgggatacagttaagttacttggaaacagttttatcttttgtggtcttgaatttattatttgttaggcagccctacaattcacagtctaggactaattattccatgcttttgaggcaagatgtctcctgtactcaacagtgtcccatgaattgagagtttcaaccttgccttgtgggaacaggcacattccctggccttgtgt

SEQ ID NO: 236309 - DNA, 206 bp, Homo sapiens
ctgtctccagagctccatgtgattactagaatggccatgtcattgagggggaaggagaaatgtgctgctccttggagttccataacagagccaagctgaggcctctgctagttacttgtcatgtgatcctggagaaactccttacatttttttatgtctcagttccttgatctgtgcaataaccgtatgtcccatatatccaaaat

SEQ ID NO: 236310 - DNA, 444 bp, Homo sapiens
atgacaatttcaattatactttcagttgaaagatttttaaaagtaaaacgttagcattggatctggagaattttgctaactgagataattaatagctgggctggtggtgatagggtttgtgtgtttttgagagagagagagagagagagaggaagagacagacagagatggaaatataaagatcattcttccactgttatatgtgttttttcccctttaaaggaataggcatttgaatttcctctctgttgtcaggtgttctgacttgggtacatcagctcttactgagtgcttgaatgttcaggatttctatgacatatctcaatctaatgaaaatctgactgtgaaatgtctatatatctccccaggcttcgttttcttggttaaatgagaaaagtgctcttatttcaaatgttggaaagtagctctacctttttctggaaa

SEQ ID NO: 236311 - DNA, 515 bp, Homo sapiens
tctccatcgactgagctgtctgtgtcaaaacaattaaagtgcacttttccactagaattacctaatttttttcctagaattaccagacaaggaaggcaggttggagacagttatgaagtagaagtcatcgtttttctcttaccctgcttctagcatgaggtgagagtccacttactcagatagtctgaagtcgttcttcccttttgtttaggagtggggaaggaatggagatctgcaaagttaagatttttgctttggacggagcatctagctgaagaataaaggatgcaatattagctttctatggctgtggaaacaaatgaccctgaacagtttaaaacagcacagattggtgatgccatcgtgaaggaggccaggtgtccggccaggcccaaatccaggagctgtcagggctgcctgccttagcggcagtcacaggggagtctgttcgttgcttttggggttgttggtagaatttcattccatgggattacgggactgagttccattttctt

SEQ ID NO: 236312 - DNA, 565 bp, Homo sapiens
  misc_feature (6)..(6): n is a, c, g, or t
  misc_feature (18)..(18): n is a, c, g, or t
ggcccnggaaagtgtgtngccgggggatagaccccaagctgtagtactacacccagcgtaagacaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236313 - DNA, 6833 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236314 - DNA, 6850 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236315 - DNA, 6404 bp, Homo sapiens
  misc_feature (33)..(33): n is a, c, g, or t
  misc_feature (35)..(35): n is a, c, g, or t
atttaaaaattaatttaatgcttggctaaatcntngttacatataactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236316 - DNA, 5817 bp, Homo sapiens
gcggccgccccctcgcccgtcacgcacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236317 - DNA, 6531 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttca

SEQ ID NO: 236318 - DNA, 2785 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttatagga

SEQ ID NO: 236319 - DNA, 4927 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctcca

SEQ ID NO: 236320 - DNA, 4205 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccggatcaccccggagtcttccgggatcctct

SEQ ID NO: 236321 - DNA, 3933 bp, Homo sapiens
ggatttgctggtgcagtacaactaggcttaatagggacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236322 - DNA, 3107 bp, Homo sapiens
tccgcaaaagataaaaatttttctcaaagcaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236323 - DNA, 3063 bp, Homo sapiens
ggtctagaggatcccacagaggctgaagggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236324 - DNA, 2478 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgatagaggagtgcacggatcctcctagaatcaacccggccacgatcac

SEQ ID NO: 236325 - DNA, 2831 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaaggtaaattgtgtccttatcagtttacatatgttgatattaaagtctgtaaatctcaatttatgaaggcagtcatgtctccaagaaaattcagggtagtaagttaaaattctttcatttatccaatacacggttaatttctctctgtaatgacctaagcccctgtattatcacaaattgtcacatgctgtcatgtattactttctccttttctgtaatgacctaagccctccatattgtcatgtattgtcacggattagcagtgcttattctgaccacgtagcagtgtgtttggtgcatgtgtctaatcaagatttagttaaattattatactttcatatgttgacttgtattttcatgggactgatggtttttaagggttggtagtatctgaaaaatcaaggttaattatgatgctctacctgaacttggacagatttgactatagttagttcttcagtatttcttcagcggtcaccagagttataattgagtttgataattcttaagattttaggaaagctgaaattattcttcctactactacccttttgaataaacttgttctctaatctaaaagtgtcagtattccagacaggaatatgcctaaagtcactctaaagtgtgaattgtttagaagatgcaagcacaaataagtgaggcagtaataaaaattagtgtactttttaaggcgataggaacttaactagtggcaaattattgcaagtttttattcaacacatttttcttcaatacccactgtacatttctaggtactataaaagcaaattatttaagtcactttttttggccgggcatgatggcttacacctgtaatctcaacactctgggaggcctagatgggagtactgcttgaggccacgagttccagaccaacctgggcaacatggctagacactgtctctacaaaaagtaaaaaaaatatatactgaatctggt

SEQ ID NO: 236326 - DNA, 3032 bp, Homo sapiens
  misc_feature (939)..(939): n is a, c, g, or t
  misc_feature (977)..(977): n is a, c, g, or t
  misc_feature (2913)..(2913): n is a, c, g, or t
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtggtaaatacacttttgttcttagtttcacatttatgcttattttagtaggttattgataactctaggcttctgcctcttataaaaaaataaggcctaaaagtagttaaatttcatataatttgtaaactaggatgagtataatgttttaaagtatgagttttatntctttaaaatcatacttagtaaatgtgtcatttgaacnttataaattaagctctacaaaaaatatattgaaagctcttcatgctttcagtgctactaatagaggttttatatttatagagttaaagataaattatacttttattatgttacttaaaatactgaatgtgctggttaaagagaaaatgtgtttgggtgtgtgtatatccatacagccttaagaagctgatacattatctttttttttaatctttgggaattacagttaattcaagccaactccatttgtgtgctggccattttccattcttgcattccagttgtgtgaattgacagtgtcaaagtttgtataataacgtatcactctggtggagggtttgtgtgcagatttgaccatttggccctgcttactggccttatttccctgacaagatcaatttagtagtttaacctgttagccgctttcataattcttaatgaatcttttagacttatgggctttaattcttcagtagatggtggtgagggagagaggaaataagttttttctaaatgctggagtttggaaaccatgaagaatcagctgctagctgctggctttttaacttctagctgattcatttgttgtcaaaagcagtttcctgtctgggggtggggagagaaagaaggcaaataggaagtgaagtagagaaaccagctgtttgttaaatattagtaaatgactattacattttgatttttttaaaattgagtcaaacattaatcttttctgcctttttctataaaaataaggccttgtgtttttttcttttgaaatcttattacaaaagagttttcaaactcagtataattctacacaataatataatcctagagaaatgggcttcaggtgaattaaaggtgcaaacaagcaagaataaatgcaaattcatttaaattgatgatgtagtgtattatttttattctttcattaaatacttaaaatattaaaaattttaaactactgttgactaagatgattggtaataagttaacttataaaataattctgtagtaaaattgaaaaataaaaacagaagttaaaatagttaaacatctatattcaaagggattggaaatttttcgttaactaaagtttcctcagttggtgtgtttggggtttaaaaaaaaaatacccaagtacattttattgagcagttctgcataaatttttgcttctgactgaatgagctaaaataaaaacagttagatggccaaaagaagaattaaggttgctttcccattgggcaagttagcactacttgtgtgttgacaataaagaacttgcctgtggactggtttaaaatgtgtgtgatttcttggaggttgtttaagcttcgcccaaattatatctgtaatttagtagtaaaaaatttaataggcttacttcctatttttttcttatttgtttatagtaatttgagagttctgtattggatttcgattatgactatctcattagaaaccttcattagaggcagcatgtaaactgaagaaaggtagttatagataataaggaggaatcctttctttttacagcctgttcagtctgtagaacattctaggatctaataaaagatgaagattaaatctctggctgagcctcatgccatcaaactgtttaggtatttataaaaagaaaagggttccaacttttatctcactttaagcattgatgaatcaattgcttttaaagattaatttcagcattttttgaagttgctcttcacctctctaattgtgtttaaatttacttttctcatccatcccatctccagaagaagagaatctaatataagcttaaatttgtaataatatcttagaagacaactattagggtttctttaaacgtaattattttaattgtatacccagacacatttgatggcttagtctagactaaaattgtactttattttttaagcctgaatgttttnattgacccaatccactctctctacagcctgggtgattgagtgagactctgtcaaaaaagaaaaaagaaagaaaggaagagagaaagagagaaggaaaggaaggaaggacgaaaaaaaaa

SEQ ID NO: 236327 - DNA, 1460 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggtaagaggaaaacttccctatattcctgaaacagccctaacattttacaaaattttagttttcttttttagagtcttatcctgtagcctatataacagttcatgtctgatttagcatttgttcacgagtaaagctggaacaatgaaaattgaaaattatgagaaatttctgtatgtttacttagtaaccataccttgagaactgaagttgggaagccagtttttcgttatctataggtttggttacttgttttctgtgtctgacaatttaactatgtcccaaattatttactgcactccagcttgggcgacagggtcaaagctccgtctcaaaaaaaaaaa

SEQ ID NO: 236328 - DNA, 1096 bp, Homo sapiens
  misc_feature (1023)..(1023): n is a, c, g, or t
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctattaccaccntcaggatgcttccccctcgggccgaatcttgggcttgagggccaaatccctattgggggcggtttaaatcgga

SEQ ID NO: 236329 - DNA, 1355 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagagtaagagtcttaattttttatgttgctgtgttttctcttagattacaaatggatacagtgatcaattaggaagacagatggggaatatctggacatacttttattgagtgcttagaagagggagaatccagtttttcagactctgtcatggagtctaagaagctaacctcaggagtcagtgaaagggcactggttccagagcagcccttctttcatttgtattatgtgatgatgttcccccttaagattttgtttgggggaaaagtactgtgttaagaga

SEQ ID NO: 236330 - DNA, 687 bp, Homo sapiens
ggtaatctccttgactcctgggaaggggtaagagtgcaatgcctttggtgcttgagtgatggaaagactgttctggcatcagatacacaccagcgaattcggggctataacttcgaggaccttacagataggaacatgtaactattttttgtttccattaaacaacaattacctgatttatattcaaatgtgtagtggaacttgccttttcacagtttttatgtttttcgttttggtttgcgtggtaatttggattgaaggtcacatggtacttagtaatcagtaactcagattcttctcaattgaagtatagtatgtaatagtgattgcaggcaaaattgtcatacttaagctagcacatcttatgtattgataatttgaatgtcttgactgttaatatgttgtttttgacaaattattttctggttccagagtacaagaagatcatcctattatgtcttttactatttcaaaaaatggccgattagctttgttaaatgtagcaactcaggtatgtttattagtataattttctgaaaaatttggcttagtacaagttttattttaactgttattttcagtgtatttatattaacaaaattttctacttacccttaaatttgattgcatgtgattgatccttaaatgtgtataatcaaccataaatttgtcagaatgttggtattt

SEQ ID NO: 236331 - DNA, 415 bp, Homo sapiens
cagtacatttggcggacagtagacaggtccctgaagaggagcaataagagatgaagccaaaaagaaagactgaaagcaacctgtggtgagcaagacagaatttggattttattctgtaggtaatgtggtgttactgaaggttcctcagtgtgtagagtggtatttcagaattgttcatctgcacatagacctgaaacttggctttagaaagacctaaagacccagagttcagataacagattctcaagctgtgttttagtacagagaaaaatgttctgtaagggactttataaattcagaattctaacacgagcagtgttggttacctaaaaattagaaaaactggaatatagagtttagatagcaatggaatccaatttatttttcatcattttacttttgttaatgaagtgtg

SEQ ID NO: 236332 - DNA, 274 bp, Homo sapiens
gagcaggcctctcccctccgtcctcgtcgtcctcgtcctcctcctcctcctcctcctccgtggtggtagtggtgggacttcccccggctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaa

SEQ ID NO: 236333 - DNA, 6785 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236334 - DNA, 6898 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236335 - DNA, 6656 bp, Homo sapiens
agcgggagtggaagtcaggaaaggctcccctgaggaggtttgaaatgagctgagtcttgaaagactgactggcatcagacaggtgaagaaaagacgggagagtgtagtcaaagactctcaaggagaaatgagccagtacatttggcggacagtagacaggtccctgaagaggagcaataagagatgaagccaaaaagaaagactgaaagcaacctgtggaaaactacttcagagaaagactttaaatttctgagaaaatctttatacatattgagtatagatgctatcaaccacatacatgaaaataattgtttggggataatgcacaccatttgccaatgattaagattcagcccagtctttgttgctgcatttctacattcacataaattgccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236336 - DNA, 6798 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaagcagaaaatgacctgaatgaactaaagcctttagtgcattctcctcatgctattgtggtaagaggcgcacttgaaatctctcaaacgttgttgggaataattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctatggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataaaaattg

SEQ ID NO: 236337 - DNA, 1689 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaacggcacccagaactgagccagtctcatgcagacacgccagacaactgtggccccgcaatccacatcgccagccgctgcagactgagaacacacggtgcacagtcccaacccactgatccctcccaacttggatatctacttgaaatacctgggaaagccgctaaaagctgcacaagccatagtgcaatgaataattgcaaagcctctactacgacaaatacgaacacacccgacaagcgcctctacactctatgatactccaacaagtcactctact

SEQ ID NO: 236338 - DNA, 1242 bp, Homo sapiens
agatggtggtgagggagagaggaaataagttttttctaaatgctggagtctggaacccatgaagaatcagctgctagctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagagtaagagtcttaattttttatgttgctgtgttttctcttagattacaaatggatacagtgatcaattaggaagacagatggggaatatctggacatacttttattgagtgcttagaagagggagaatccagtttttcagactctgtcatggagtctaagaagctaacctcaggagtcagtgaaagggcactggttccagagcagcccttctttcatttgtattatgtgatgatgttcccccttaagattttgtttgggggaaaagtactgtgttaagaga

SEQ ID NO: 236339 - DNA, 480 bp, Homo sapiens
agccacaggttgtcttatgtatgtatcttattgcaatataagaaatgatagtctatacttacattgatggaacaatttgagaaacagttgcatctttaggttaaatagaaactagataaaagtactacataataaactgagggccacagacatctccaactgattttctcatttggaagaaaacataaactttatttcctttagaagtacaggctttttcaattaaaaaattcaaaagttctcctgaagcaaatgtttaaactgaaacctaaaggataagtagatagacaaaggaggtcatttggcccaggatttgaaaggcaactagtggcagaagcataaatcctgagtctaagctgggcatggtggctcaggcctgtaattccagctcttggggaggctgagctgaagaggatcacttgaggccaggaattagaaaacagcctaggcaacgtaactgagacctcccccgtctcaaaa

SEQ ID NO: 236340 - DNA, 1246 bp, Homo sapiens
  misc_feature (622)..(622): n is a, c, g, or t
  misc_feature (853)..(853): n is a, c, g, or t
tgcagctgagctggctccaaagtgggatcggaggccagaaggcatccacagccttctcaggtccgggaacttaccagcccaattctatggtaaccctggcaggcccagctggcagcagtggggatggcaagagcaaagccctgggggccagtcctgccaagagggggaaaggtcaggccagggctggagcccaggcaggcaaccagctctcactacattttttatgcggttggaggcaaaccaggagatgatattactgtagcaaccaaggccagcaggaatgtcaaggcagggagaggatgtgaccacactgaggatagtgcagagacaggaacccagaggggccttccagtgcacctggttggaagagaggtctggagggcatgcaggggagaggagaaggaatagctgcttcaagttcagagaaaagagatggaagagggaggaacatgagagctgaagaaagttttttgagaaccagtgtgatttggcatgctggaggctctagggaaagccaagagttagtcatcagaagagcaagaagactaagattatgtccagtgacttagagtacatagaagaaaatggggtcctcagaagacacgcaaagtgagataaaggnaaaatgagttgttccttacatcttccagttggaggtgagttcgtccagctaaagtgtgccatgtcaccacgcatatttggtggtaacctagtgaatcagaatctgcacgtatctgagtgtttcaacaacttccccactgttcccaatgcccagccagtttggagaactggtccagaagatatggagcaggtaccctgattcagggaggggtttggttttcttgctgctgtnggcagcagagaagcatggaggaaaacaggaaagtagagcatgggccattgtggaaccaaggtcacgagctgtatgatacaacaaggaaagaaggatttcgaaagtctaccagattggggccgggcgaggtgtctcaggcctataatctcagcactatgggaggccgaggtgggtggatcacgaggtcaggagatcgagaccatcctaacacggtgaaatcccgtctctattaaaaatacaaaaaattagccgggcgtggtggcaggcacctgtagtcccagctactcaggaggctgaggcaggagaagggcgtgaacccgggaggcggagcttgcagtgagccaagatcgcgccactgcactccagcctggcgacagagcaagacttcgtctc

SEQ ID NO: 236341 - DNA, 2208 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccggtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236342 - DNA, 2145 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccggtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236343 - DNA, 3861 bp, Homo sapiens
  misc_feature (1146)..(1146): n is a, c, g, or t
  misc_feature (1235)..(1235): n is a, c, g, or t
  misc_feature (1290)..(1290): n is a, c, g, or t
  misc_feature (1331)..(1331): n is a, c, g, or t
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctgtatcctttctgcctgcccacctttcccacacgacccacttctatcaggactcccttcagccacctgacacaatagtgtctgctgtagccaatccttccagttcaaagatcttcaacgatgtgctaaatcctgctgtttactaggcacttaaaatcccaaaatgagagtaaaatacagtttttggccaggcatgttggctcacgtctgtaatcccagcactgtgggaggcgcaggcaggaggcaacatagtgagaacccaagtctacaaaaataataggaataataaaaaccccaccgtttctttttacaatgaggaggaggtagatacaaatctgtaattcagtgtgataagcactgtgctatagaagtgtgtgaagatagaaagcacaggcagggcgcgatggctcacgcatgtaatcccagcactttgggaggccgaggcaggtggaccacctgaggtcaggagttcgagaccggcctgaccaacatggtgaaacccccgtctctactaaaaatacaaaaattagtcgggcgtggcggcgcactcctgtaatcccagctactcaggagactgaggaaggagaattgcttgaacccgggaggcagaggttgcagtgagctgagatcgtgccactgcactccagccagggcaacagagcaagactctgtcaaaaaacaaacaaaagatataaagcacaatgggaactcagaagaggcaacggaancgagcactgggaactcagaagaggcaaaggagatgaggcacatgggtcagagaattgtggaccaggaggaccaggacactggaggctgnttccagcgcatattaagtcgctgtcagcactcctttgtggcatagcagaaggagngcctactcttacctctcatctgaaggatccaggctggcccncagataaggggtagggtagcctgaggtccgatctgtgcagtcacttctggtctctcctcacatgactgtcctaaaattcagaagtcagagctgctgactctagcccttgaaacatggtgagggagcaagggatgaacctgaatgcagatgccagccccaccactggccttttctgacccatcactgtctgtcgatccaaagactttccttaatctcgtgccttcccaagccattggggctcactgtagtgcatccgtggccctgtccttcttcatattcgagcgttgggagtgcactacgtattggtacatttttgtcttctgcaggtgtggtagcatccaatatttggggatgagggaggaaggttggccctaaacctgaaggtttttcccctacccagccctttcctccatgtgtgagataccagatccactcaacatcctgtaggcttttaaagtttcatcccctaccccccatgccacctgccctacactttcagaggtggggtctctggtttggagatttgggtatttatactgaaagggtttctgaatctaccacttgccttggtagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236344 - DNA, 2492 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236345 - DNA, 2474 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236346 - DNA, 3295 bp, Homo sapiens
  misc_feature (827)..(827): n is a, c, g, or t
  misc_feature (916)..(916): n is a, c, g, or t
  misc_feature (971)..(971): n is a, c, g, or t
  misc_feature (1012)..(1012): n is a, c, g, or t
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctctggaactttgggaaaagagaagcctggactcttcctggaaataaaagcatgctataaaataaaataattagcctgggcgcgatggctcacgcatgtaatcccagcactttgggaggccgaggcaggtggaccacctgaggtcaggagttcgagaccggcctgaccaacatggtgaaacccccgtctctactaaaaatacaaaaattagtcgggcgtggcggcgcactcctgtaatcccagctactcaggagactgaggaaggagaattgcttgaacccgggaggcagaggttgcagtgagctgagatcgtgccactgcactccagccagggcaacagagcaagactctgtcaaaaaacaaacaaaagatataaagcacaatgggaactcagaagaggcaacggaancgagcactgggaactcagaagaggcaaaggagatgaggcacatgggtcagagaattgtggaccaggaggaccaggacactggaggctgnttccagcgcatattaagtcgctgtcagcactcctttgtggcatagcagaaggagngcctactcttacctctcatctgaaggatccaggctggcccncagataaggggtagggtagcctgaggtccgatctgtgcagtcacttctggtctctcctcacatgactgtcctaaaattcagaagtcagagctgctgactctagcccttgaaacatggtgagggagcaagggatgaacctgaatgcagatgccagccccaccactggccttttctgacccatcactgtctgtcgatccaaagactttccttaatctcgtgccttcccaagccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236347 - DNA, 2276 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236348 - DNA, 1167 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgaaaaaaaaaaaaaaaaaaaaaaaaaaaaaaaaaaaaaaaaaaaaaaaaaaaaaaaaacacacaaataagaggcgacgcgcaactcaaacaaaccacctctaggaggacgcaccaccgccacaacacccatcaccgatatcacgagcagacagggcgcaccacaccacaggcgcgcacataatcaacaagcgcgagaacaggcgccgccacaacacagcgccacagagcgaaaccggcgcaacgccgacaccccgcgcaggacaccaccgcacccgcgcggagcacca

SEQ ID NO: 236349 - DNA, 1303 bp, Homo sapiens
cgacacggctgcgagaagacgacagaaggggacgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236350 - DNA, 106 bp, Homo sapiens
ctgagagacccgcagcagccggagaatgtactgctcgcgaggatttccgagaacgcggcgccgagcccgcgtacacggttaccaaggcaactgggcggtgcctgag

SEQ ID NO: 236351 - DNA, 2748 bp, Homo sapiens
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggtaagacccacggctgcactcaatccgtccccattcccatctctgagtggtcctagtcctaccctgccccctcccagtgtcttaccctcttgggttttcttgtttcccgccgcccccaggcctgccctgcagcctgcccctttttcacttctcttcctgtgccctgctcccaggacagcaacatacaggcctgcctgcctctcacgttcacccccgaggagtatgacaagcaggacattcagtgagctcttgggacggggtggccagaacgaagaggtggtgggagtggaggggtcttagaataagtccaaaggcctgggccagtccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctcactgcagcctcaaactcccaggctcagatgatcctcctgcatcagcctcccaagtagctgggactacaggtgagcaccaccacacctggttgttttaaaatttttctatagagacagggtctcactgtgttgcccaagctggtcccaaactcctgggctcaagccgtcctccccactaggcctctaggcctcctaaagtgctaggatacaggcatgagccaccgcgtttctcccactcccctcttttgcacttttttctcccttagttttgaaacagtggttcacctggtttgcctactattatactgttctggttgttccttcttacattaattcaataaatacttattgagtacctgcagtgtgtcagttactggggacataatactgggttgtctcttctgcttgccccgtaagtgctggtgatcactgctcttcgggtgacttcatccatctcttgttttcttttcttttctttt

SEQ ID NO: 236352 - DNA, 2908 bp, Homo sapiens
  misc_feature (1146)..(1146): n is a, c, g, or t
  misc_feature (1235)..(1235): n is a, c, g, or t
  misc_feature (1290)..(1290): n is a, c, g, or t
  misc_feature (1331)..(1331): n is a, c, g, or t
  misc_feature (2866)..(2866): n is a, c, g, or t
  misc_feature (2905)..(2905): n is a, c, g, or t
tctcgggaagcgcgcctgtgtttgtaccgggaatcggccattctggcggtggagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctgtatcctttctgcctgcccacctttcccacacgacccacttctatcaggactcccttcagccacctgacacaatagtgtctgctgtagccaatccttccagttcaaagatcttcaacgatgtgctaaatcctgctgtttactaggcacttaaaatcccaaaatgagagtaaaatacagtttttggccaggcatgttggctcacgtctgtaatcccagcactgtgggaggcgcaggcaggaggcaacatagtgagaacccaagtctacaaaaataataggaataataaaaaccccaccgtttctttttacaatgaggaggaggtagatacaaatctgtaattcagtgtgataagcactgtgctatagaagtgtgtgaagatagaaagcacaggcagggcgcgatggctcacgcatgtaatcccagcactttgggaggccgaggcaggtggaccacctgaggtcaggagttcgagaccggcctgaccaacatggtgaaacccccgtctctactaaaaatacaaaaattagtcgggcgtggcggcgcactcctgtaatcccagctactcaggagactgaggaaggagaattgcttgaacccgggaggcagaggttgcagtgagctgagatcgtgccactgcactccagccagggcaacagagcaagactctgtcaaaaaacaaacaaaagatataaagcacaatgggaactcagaagaggcaacggaancgagcactgggaactcagaagaggcaaaggagatgaggcacatgggtcagagaattgtggaccaggaggaccaggacactggaggctgnttccagcgcatattaagtcgctgtcagcactcctttgtggcatagcagaaggagngcctactcttacctctcatctgaaggatccaggctggcccncagataaggggtagggtagcctgaggtccgatctgtgcagtcacttctggtctctcctcacatgactgtcctaaaattcagaagtcagagctgctgactctagcccttgaaacatggtgagggagcaagggatgaacctgaatgcagatgccagccccaccactggccttttctgacccatcactgtctgtcgatccaaagactttccttaatctcgtgccttcccaagccattggggctcactgtagtgcatccgtggccctgtccttcttcatattcgagcgttgggagtgcactacgtattggtacatttttgtcttctgcaggtgtggtagcatccaatatttggggatgagggaggaaggttggccctaaacctgaaggtttttcccctacccagccctttcctccatgtgtgagataccagatccactcaacatcctgtaggcttttaaagtttcatcccctaccccccatgccacctgccctacactttcagaggtggggtctctggtttggagatttgggtatttatactgaaagggtttctgaatctaccacttgccttggtagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctatttgcagtcttgctnttgtttggtctgtggattgggttttggtgcttctggttnggc

SEQ ID NO: 236353 - DNA, 1081 bp, Homo sapiens
atcaaaatagcattcaaatggatattagaaaacgttagaactaaacaattatgaaaaattctatatatcaaaacatggaatacagataaaatagtgcagagagaagtttatagactttcagaagggatgaaaattaataaagtaatcatcaatgatttagaataatattgaaaaaataaatccagaaagcagaaaaagaagataacaaaaataaaagcaaaaattaacaaaacataagaatatggaaaattaatgaaactacctctgttctttgaagcagttaaaatctagatgtctctgacaaattaagaaaaaagggatagatacaatatcggcaaatcacaagaaaacaacttcagaaggactagaatgatagcagaatgttatagacaacttttaattataatgacaacttggataaaatgggcacatttctagaaagttatattttgcaaaaattgacttatgaaagaattagaaaacctgtgcagtcctgaatcattgaaattagttaaacattgaagttaaactatcttttcacataaaactgaagtccacagttttataataaattctgctaaatatatttaatgagcaaatattccaatttaacataaactcttccagaaaataaaaaaaaaaaagacacgttcctctttaagttgtttaatgaggccatgattgttatcttgattccaaaatccaatacaaaatattagcaatctaaatgtagcaatgcattaaacacacacacaaattactaaattgactttatccaaaaaataaaaggctaattagcatcaaaactattaacataaattaacaaaataatgacaacttataaaatcatctctttttgcagatgaaagtcaatattcattcacattagaaactctcagtgaacgtggaatagaaggaaattctcataactggcaaaagagtaaatacaaaattctcaaaggagatatcatattcattggagaggtggtaaaatcattttctttaaaggaaggaacaaaagaaggatgcccactattaccatgcatattcaacattgaactaaggatggcagaaaccacat

SEQ ID NO: 236354 - DNA, 1035 bp, Homo sapiens
aaaaatttggtctggaaattccaagagcattacacttagaagataaatctccagaaagattgaagctcagtggatgggccaaaggggaatgaactcagtttacatggcagctcattcacattcctccttttgaaggggtgtattttcttactggagatgaaaagaaaaaaaaatctttatatcatgattccgccatgtgtacttccttctggaagaaattccatactatgatcaggcacttctttcagaagtcctatatttactcagaacatgctttctagcagtagtttgcagaagaaaaatgcaacttctacaattggaataaactgcctataggaacccagaaaaaatataaagtatattcagtagtaacgactgaaaaacacttgaaatagcttcttcaacacatatattgtatagctatttaaaacccaaatacaaatgttatatgaagactttcaaaaggccgcaggataattccaatggatctatttgttcagtcattcagaagctatatcgggaacccatcatggatgagctctgctctaggcatggggagaaaggatgaggaagacaaatatggccctagttcttgtggatcttatgttctagtggtggtgactattactttttgaattgtgtatttgccacaggggagattggattactcttcagaaattttataagcatctagagatgacctgcattattgccttgggcaggaaaataacagggttgaaaaaaatctgaacaaagaaatcaccatttgatggatatacacaggataatcttttctgaagttactaaaatggcgaagttcccaaaaaatgtaatgcgaattaaatttcactttgcctctgagaaaaagttaaaagaatttattattactctcgctacatgtattatcaaaaatgaagggttgatatttttaaggaaagaagagttggccagtcactttagtgaagttttattttttcgtaaatatagtttgcctttgcttccatgaaaaaatagctcataaaccttgaccctgat

SEQ ID NO: 236355 - DNA, 671 bp, Homo sapiens
ttttggtttctatttctttacatagtcggagtcacaaataccgttcatgttgtttttttcccccacatattttataattttctttgttttatatagatgttatattaacattcactttaaaaaataattacttattatttcatggaaccacatatcatggtttaagctcttttctatagagaaattaatgagtttccattattttaaataattgtacaatgcacacctttgggcaagcaaaggctctttcaggatttaggaatatgttctttgaactcctagaagcacaataactatgtaaaaactaaaagtaattttaagattcataatataaatttcaagttgcttcccaaaatgaaaaaatactatttccattatctgtgctaattatgtaaatctagttttctaggtaactgtatgtgaatgtaaatttccaaggctgaatatctgataacaatctctacttccagttcagagcttctgccttcatcagtgctacttccttatcttctcctttctgacctctgacccatagatcatctacctcaagcgaattagtcttcatttttattccaagtacactgtgtgtgttctcgtttattgcattttcttattgcccctggggtttcttctgctttccttcctctgacccaagtttcatttgtcttgaa

SEQ ID NO: 236356 - DNA, 310 bp, Homo sapiens
tattatatatacttacatatataaaggtatattttatatatacttacacgtacagtgtgtacatcaggaagtatgtataaaacatgcaagtgatgcttatgtggaaggtcactgctggtggccaccagggacagtctgtagcacaaacgtccatgtggacccgtgttccctgtccactgtggattgctcagagctgcctgttttctctgcagcttcagtactcggaggaagactgtgctttcgaggaggagatccgcccagatggctacaatgtgtaccgatccgagaagcaccgcctcccggtctccct

SEQ ID NO: 236357 - DNA, 2443 bp, Homo sapiens
ctgagactgtcggaactgccggggaaaattctacgggacggctttgacgtcagatgtgcggggctgcgaaagtcgggggagggagtgcgagtgggcttttaaggggaagggcactaaggccgaggtgaggcttttcccgacagagggtgaagggggcaaaactcggtgccccccaacctctggccccggggttcctgaccccgcccccgctagtgccccacgccgagtgcatccactgggagcctgaggcctgggggaagggccccagttgtcgattgctttacaaagtcaaactctcccagccaagaacctcggggccgctgcgcggtggggaggagttccccgaaacccggccgctaagcgaggcctcctcctcccgcagatccgaacggcctgggcggggtcaccccggctgggacaagaagccgccgcctgcctgcccgggcccggggagggggctggggctggggccggaggcggggtgtgagtgggtgtgtgcggggggcggaggcttgatgcaatcccgataagaaatgctcgggtgtcttgggcacctacccgtggggcccgtaaggcgctactatataaggctgccggcccggagccgccgcgccgtcagagcaggagcgctgcgtccaggatctagggccacgaccatcccaacccggcactcacagccccgcagcgcatcccggtcgccgcccagcctcccgcacccccatcgccggagctgcgccgagagccccagggaggtgccatgcggagcgggtgtgtggtggtccacgtatggatcctggccggcctctggctggccgtggccgggcgccccctcgccttctcggacgcggggccccacgtgcactacggctggggcgaccccatccgcctgcggcacctgtacacctccggcccccacgggctctccagctgcttcctgcgcatccgtgccgacggcgtcgtggactgcgcgcggggccagagcgcgcacagtttgctggagatcaaggcagtcgctctgcggaccgtggccatcaagggcgtgcacagcgtgcggtacctctgcatgggcgccgacggcaagatgcaggggctgcttcagtactcggaggaagactgtgctttcgaggaggagatccgcccagatggctacaatgtgtaccgatccgagaagcaccgcctcccggtctccctgagcagtgccaaacagcggcagctgtacaagaacagaggctttcttccactctctcatttcctgcccatgctgcccatggtcccagaggagcctgaggacctcaggggccacttggaatctgacatgttctcttcgcccctggagaccgacagcatggacccatttgggcttgtcaccggactggaggccgtgaggagtcccagctttgagaagtaactgagaccatgcccgggcctcttcactgctgccaggggctgtggtacctgcagcgtgggggacgtgcttctacaagaacagtcctgagtccacgttctgtttagctttaggaagaaacatctagaagttgtacatattcagagttttccattggcagtgccagtttctagccaatagacttgtctgatcataacattgtaagcctgtagcttgcccagctgctgcctgggcccccattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgtaaaaaaggtgca

SEQ ID NO: 236358 - DNA, 9191 bp, Homo sapiens
  misc_feature (9116)..(9116): n is a, c, g, or t
  misc_feature (9119)..(9119): n is a, c, g, or t
  misc_feature (9121)..(9121): n is a, c, g, or t
  misc_feature (9132)..(9132): n is a, c, g, or t
  misc_feature (9140)..(9140): n is a, c, g, or t
tacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggcttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaatttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggcttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagatttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatggtgggttcctctcccttcacctgtccacagagaagataaaggctgactcttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaatgaaaaacagaaacaggagagttcttactacaacatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacatttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaattggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaatacttctgtaacttttttgatatatactgtcattctaagtacatatactccttgtgacttgggaagtattgtcttgaggcaagtatttaccacccacactaaaataatgctggaaaaaataaaatactaaactgaaggcacagtattattagaaagtgtaacattttcattttctcttttactctacattttaaagatacgagggttattgtcttgaaataattacctatattaattatcatagaatgtgtctataaacctttgacgaaaaatgttggttttcctccagaataatgtgaagtccatactcagaaattaactagaaaggtntgncnttcttataatnttccctgnttggtgcggcccggaggggggataaaccaccacagcggggggggccaaaag

SEQ ID NO: 236359 - DNA, 9065 bp, Homo sapiens
  misc_feature (8990)..(8990): n is a, c, g, or t
  misc_feature (8993)..(8993): n is a, c, g, or t
  misc_feature (8995)..(8995): n is a, c, g, or t
  misc_feature (9006)..(9006): n is a, c, g, or t
  misc_feature (9014)..(9014): n is a, c, g, or t
tacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggcttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaatttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggcttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagatttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgaaaaaaatggtgggttcctctcccttcacctgtccacagagaagataaaggctgactcttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaatgaaaaacagaaacaggagagttcttactacaacatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacatttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaattggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaatacttctgtaacttttttgatatatactgtcattctaagtacatatactccttgtgacttgggaagtattgtcttgaggcaagtatttaccacccacactaaaataatgctggaaaaaataaaatactaaactgaaggcacagtattattagaaagtgtaacattttcattttctcttttactctacattttaaagatacgagggttattgtcttgaaataattacctatattaattatcatagaatgtgtctataaacctttgacgaaaaatgttggttttcctccagaataatgtgaagtccatactcagaaattaactagaaaggtntgncnttcttataatnttccctgnttggtgcggcccggaggggggataaaccaccacagcggggggggccaaaag

SEQ ID NO: 236360 - DNA, 8180 bp, Homo sapiens
  misc_feature (8105)..(8105): n is a, c, g, or t
  misc_feature (8108)..(8108): n is a, c, g, or t
  misc_feature (8110)..(8110): n is a, c, g, or t
  misc_feature (8121)..(8121): n is a, c, g, or t
  misc_feature (8129)..(8129): n is a, c, g, or t
tacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggcttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaatttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggcttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagatttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatggtgggttcctctcccttcacctgtccacagagaagataaaggctgactcttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaatgaaaaacagaaacaggagagttcttactacaacatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggatttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaattggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaatacttctgtaacttttttgatatatactgtcattctaagtacatatactccttgtgacttgggaagtattgtcttgaggcaagtatttaccacccacactaaaataatgctggaaaaaataaaatactaaactgaaggcacagtattattagaaagtgtaacattttcattttctcttttactctacattttaaagatacgagggttattgtcttgaaataattacctatattaattatcatagaatgtgtctataaacctttgacgaaaaatgttggttttcctccagaataatgtgaagtccatactcagaaattaactagaaaggtntgncnttcttataatnttccctgnttggtgcggcccggaggggggataaaccaccacagcggggggggccaaaag

SEQ ID NO: 236361 - DNA, 7336 bp, Homo sapiens
tacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggcttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaatttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggcttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagatttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatggtgggttcctctcccttcacctgtccacagagaagataaaggctgactcttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaatgaaaaacagaaacaggagagttcttactacaacatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacatttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccatgacacggaccgtgattaccgaaaagaaagggattctcataggcacagagaggccagtcatcgagattcccatgggaagaggcatgaacaggaagataaaccaggggc

SEQ ID NO: 236362 - DNA, 324 bp, Homo sapiens
aacacactgcaacagtaaactaatttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttggcccttcactgtgaccagaatctaaatgtgcattacgatctccaggtacaagggtgttttctgcaatatttttacacatatttggttcttcatga

SEQ ID NO: 236363 - DNA, 7736 bp, Homo sapiens
  misc_feature (7661)..(7661): n is a, c, g, or t
  misc_feature (7664)..(7664): n is a, c, g, or t
  misc_feature (7666)..(7666): n is a, c, g, or t
  misc_feature (7677)..(7677): n is a, c, g, or t
  misc_feature (7685)..(7685): n is a, c, g, or t
tacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggcttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaatttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggcttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagatttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacatttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaattggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaatacttctgtaacttttttgatatatactgtcattctaagtacatatactccttgtgacttgggaagtattgtcttgaggcaagtatttaccacccacactaaaataatgctggaaaaaataaaatactaaactgaaggcacagtattattagaaagtgtaacattttcattttctcttttactctacattttaaagatacgagggttattgtcttgaaataattacctatattaattatcatagaatgtgtctataaacctttgacgaaaaatgttggttttcctccagaataatgtgaagtccatactcagaaattaactagaaaggtntgncnttcttataatnttccctgnttggtgcggcccggaggggggataaaccaccacagcggggggggccaaaag

SEQ ID NO: 236364 - DNA, 382 bp, Homo sapiens
atttctcttttaggagaaaaaaagaacacttctagttggatcaaagattttattatctagctgattttttttttttaaatcaacttacatcctgtttgtttctgaatgactgggtcatttccaacctggctgatagtgaaaggaaattgtttctgtcctatgggtcctgagaggctaatataaaatgagccagtggtgtgtctcccatgtataatgggaatacaggagtcctttatagccaacttcattggctgtgtcgtctcagtgaagggtttctctgacagggagtgctacattttgtccttaaaaaatattatattttagtagattatagtgtatgcgaagagttataatttgtactcttaccctgtgtcttaaaaag

SEQ ID NO: 236365 - DNA, 544 bp, Homo sapiens
aagcagaatcccatccacctccacctaatcatacagagaaaggagacaggagctgagggagggcagtgctatgtccaagctctcagcaagcagtaggcagagcccaggcccctgctttcccatgcccaccccttcccagttcagggcaaggccacctctccagggcctttccctcccctagagaggaaactccccaagttcctctgaccagacaggagagtgaacgagagaagaaaattccacttcagcacacacacctggagcctgaggctgaaagctggaatcccagactttgacactcaagaaggcatctccacactttttcagcacctccacctgggacattcatgagcacctggcttccctcccaggggagaggggtgtcccagagacactggggcccttagaaggcactatgagttggcagtgactgcagcagcgtggtgggattgtgggtggtgtaggaagcaggggaagcagatcacagcactcaggatggccagagctgaaggcatcagagtcccctgtccttgttctgcaaaaa

SEQ ID NO: 236366 - DNA, 399 bp, Homo sapiens
tttctgttcctcagcatatgttttaaggacctatgtgcttacctgtgcttgggatgagagttcgtggtaattttttttttttaattcttgtcttggccgagcgcagtggctcacacctgtaataccagcactttgggaggccatggcaggtggatcatctgaggtcaggagtttgagacaagcctgaccaacatgtgaaaccctgtctctatttaaaaatacgaaaattagccaggtgtggtgttgtgtgcctgtaatcccagctacttgggaggctgaggcagaagaatcacttgaacctgggaggcagaggttgcagtgagctgagatcgcgccactgcactccagcctgggtgacagagcgagactctgtctcaaaaataaaaatatacataaaaa

SEQ ID NO: 236367 - DNA, 634 bp, Homo sapiens
ctgaaagaaatgaagatttaacttagctagtctgcacgaacatcagtgcctccaccacatcaggaaatatgttctcaaaaggtcatgtgcacacacatccactgcaaagaagaaaaacagttgttctgggtttcttgacaaatcagaacaaccagtctataataacagcaactgctggcgggcatctgtagctcaacaaaccggactttgtgcacctggcctcccacagaagttccacaaggggacctcgaaatggtgtcagcggaaggactgggcagccacggcagggggaacccaggccccaggctcctcttctatctcccagggccgaggctaaggcaaagcctcattctctctgggttttggtatctttgtgataaactgagaggattggtctgattttggtccgattctacaaaacatttaaaaaaaagatatacatcatgaataataccatgtgggagatagtatttcccttttttacttttttagaaataattaaggtggctcattaaatattaatatatcatgaagcacccccagttgaaacatgaagcttaaataagtattaaaaataactatctattaggctgggcacagtggctcatgcctgtaatcccagccctttgggagg

SEQ ID NO: 236368 - DNA, 408 bp, Homo sapiens
actgctgttaaagttgcaggtgttatgtcttggatccaccaccatcggctaacaccatcagctcgggacaggtaaaccagccagcaagacccagatatccaacccggctaatcctgagatgagaccaagctgctgctgaggacaacagccctgctctggttactctggaggctgaccagtctatgtacggctgaagcttgaagaaacaataagccctgcattagtcatacaccagaagctgagtagtctaagcatggctgaagcttgaggacttgtcaagcaaataatgtagttagaaatcttaggactagtggttttcctgtatactaactgttttactattgttctgtcactgtgctcaatctttttctcaggtaaggacctcttttgtccttgctggatataaat

SEQ ID NO: 236369 - DNA, 1449 bp, Homo sapiens
  misc_feature (778)..(778): n is a, c, g, or t
  misc_feature (794)..(794): n is a, c, g, or t
  misc_feature (798)..(799): n is a, c, g, or t
  misc_feature (806)..(807): n is a, c, g, or t
  misc_feature (810)..(810): n is a, c, g, or t
  misc_feature (834)..(834): n is a, c, g, or t
  misc_feature (847)..(848): n is a, c, g, or t
  misc_feature (1365)..(1365): n is a, c, g, or t
atagactaaaagcaaagacatggaaacagatatttaatgtaaatggaaaacaaaagagagcaggagtggcaatatttataacagacaaaatagatcttaagtaaaaaaactgtaaaaatggataaaaattgtcattatatagtgataaaggggtcaagtaatcaaaaggatatgacaactttatttcagacatttagagagaaggatgtaacaactgtaaatatatacacccccaacactggagctcctaaatatatgaagcaaatattaacagatctgaagagaaagacagattgcaatatgataatagcaggagaatttcaaaccctattttcaataatgaacagatcatccagacaaaaaatcaataaggaaacattggacttgaactacacattagaccatgggtgtccaatcttttggcttccttgggcaacattggaagaagaagaattgtcttgagccacatataaaatacactaacaatagctgataagctaaaagaaaaaaaaatctcataatgttttgagaaagtttacgaatttgtgttgggtcacattcaaagccatcctgggccgcatgtagcccatgggccatgggttggacaagcttgttttagaccaaatggacctgaatgacatatataggacaatatatccaaccccactaaaatacacattcctctcaagtatacacacagaacatattccagaatagatatgttaggccacaaaacaagtctttaaaaatgtagtccaggggcagtggctcatgcctntaattccagcactctnggannctgaggnnggntcctgacctcaagtgatctgcccncgtcggcctcccnnagtgctgggattacaggcgtgagccactgcacccagtcaaatattgctatatttctagcaaacagaatttagaagcataccaaaggatcattcaccattatctaagtgggatttatctctgggatgcaaaaatggttcaatatatgcaaatcaataactgttatatgaaagacaataattatatgatcatctcaatagatgaagaaaaaacataacaaaattcaataccttttcatgataaaaacgtttaacaaattaagtataaaaggaatgtacctcactacaataaaagccatcatactcaatgatgaaaagttgaaagcttttcctctatgaaaagaaacaagacaaggatatccacactttccacctctattcaaaacagtattagaagttctagccagagtaattagccaagaaaaagaaataaaaggcacgcaaaacagaaagaaaggagccagccacagtggctcctactgtaatcccagctactcaggaggctgaggcatgagagtcncttgaacctgggaggtgaaggttgcagtgagccaagatcatgccactgcattccagcctggatgacagagggagactctgtctc

SEQ ID NO: 236370 - DNA, 903 bp, Homo sapiens
acggacgtggacgagatgacaggcaagttcagaacaagcacgcccattttattttttccttttctccaagaaggtagcaggcagccaccatgtgaggaacatcagctttggtgcagcccagatacatcccccacaaaatctgggggtgctggtgaaagccccctgacagtgtcgtcaatagccttttccatgaagaagcatggaaggctgtacccaaaggcactgggataagaggaagctgccttccttctgagaagtgggtctcttccctaggaagatccccaggaggaggatgggaagtgagtgatgaagagctgggaaaaccagcatccatctgtacaaaggagaccccaggaaacaggttgaccaactctccaaagatgtctcattctcttaaagctcatttccattttaaatgagtgtttggataagagcaccaaacctggtgttagtgagcactgactcaccaaagaaggaaaaccccacaggaaaagcctggtggctttactacctggaggaaaagactcaggaggatgccagaagccaaatgctgaaggaaccactgcagtgagggaaagggttggggaaaaatcccctccctccaagaatgcagggaccagttggctgtgccaccccacacctggggagatggctctgtgctgctgcctttcaagttgggccaacctcagaaatccttggggatgccagaaggctggaccacaatgctgcctggagtgtgagtgtcctgagcttcttttagcagacatggggactctgtgcctgaccagcaaccgggatagaagaaggcctagagtgcacattgccatgaggggctcaaatgaagatggctcttcaggcgggtcagtggcaccagccagacagcctcatggtccattcctctgg

SEQ ID NO: 236371 - DNA, 486 bp, Homo sapiens
gtccacggtccctctacgtccaggcccgggctccctccttcctcttcccctcacgttgccctgtgcttcttcctactttcccccgtccaggtcggctgggccccacccagccccaggggtgcctcccctcccccctttcgggtttctgccctggagggtgtggttttctctcccacctcggtgcctgccagtagactggagcttccccgccacgctgtcggtcccatctcatcacctttccgctttcacgcccgtagctagtcttgggactggccctgttatagccccaacttatgcgctctctaacctttcctggcttacccggagtcacagttcagttctacttcttttcaattctgtagggcattggtctcaattgggactcagttttcctccacacccgccgttcctgtagtctggttatatcacagttcattatttaatgtaggtttttgagcgctttgtaaacggcaaagctctctctgt

SEQ ID NO: 236372 - DNA, 481 bp, Homo sapiens
attatagtacagaagagccatgatcgcccttttgcttatagcaagatatttaacctcactttgtttcctcatctgcaaaatggagattctaatccctgcctcttcttacagggatgttgtggggatcaagtgagataatgtgtaagaaggtgctttgtaacttgttgagtgctttacaaatataaggtatgctattgttaaattccggattttacaatacagtgtgattataatgccatcattgggatccatgctgtgaaagcatgttaaaaggaggcccgttgggtatatgtagtaaccgcttattacgagtaaaaacagacttgtgttatatgaaataaccatgttgtaaagagttctgttgtggtggggcatccgtggatcgttaaagactgagggcttcaaaatagttgtttgaagtggtaatagaatgtcaaattgatgccttaacccacccattttagaggatacataggccaga

SEQ ID NO: 236373 - DNA, 464 bp, Homo sapiens
gaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgaga

SEQ ID NO: 236374 - DNA, 374 bp, Homo sapiens
gtgactctgtctcaaaagaaaaagtgtagggtactgaagaaattgaaacattaagaataccatatgagtaaattaaacactttggctcttttcggaaaaaaacagatgagctcttatattttaaagtttggttttgacagaaaaaaattcctagattttttggttaataaaaactttattagatagattaaattgtgatgtatggagataaagttctgaaagaagaatagaaagctttttaaaaatagtattctcagcctaggcaacatggtgaaaccctgtctatgctgaggttgaggtgggaggatcacttgagcccatgaggcagaggttgcagtgagccgagattgtgcctctgtactccagcctgggtg

SEQ ID NO: 236375 - DNA, 476 bp, Homo sapiens
tgagatggagtctctctctgttgccaggctacagtgcagtagtgtgatcttggctcactgcaacctctgcctcctgggttcaagcgattctcctgcctcagcctctggagtagctgggattacagatgcgtgccaccatgactggttatttaaaacatttttttgtatttttagtagagacggggtttcaccacattggtcaggctggtctcgaactcctgacctcgtgacctgcccacctcggcctcccgaagtgctgggattacaggtgtgagccacagcacctggactatttctcgtaaatgtcaaggaacaattttatagtgttaatacatttactttaagcatctactctatttagctgagactatgctttttctgctacggtgacaaaagtccatccaaattgctatgcttaatacattctttattaccaaagtcccaataaaagtagtaattcaaaaaaactaaaactc

SEQ ID NO: 236376 - DNA, 201 bp, Homo sapiens
agagacggggtttcaccatgttcaccatgctggtctcgaattcccgaccttgtgatctgcccgacttggcctcccaaagtgctgggattacaggcgtgagccacctctcccggccctaaaatttgttttaatgaagacaaaataaaattgtttcagacaaataaaactcactctttcgccagcaaactctccctataggaa

SEQ ID NO: 236377 - DNA, 1391 bp, Homo sapiens
  misc_feature (1192)..(1192): n is a, c, g, or t
aacattatagaagattagaggatgtttagactcttagatggctgagcatagatcactcataccttagataatgcaaagaatatcttgcttactaatcacctgttaatttttattgatagtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaanatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagc

SEQ ID NO: 236378 - DNA, 1563 bp, Homo sapiens
  misc_feature (1364)..(1364): n is a, c, g, or t
aatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaanatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagc

SEQ ID NO: 236379 - DNA, 343 bp, Homo sapiens
cataaatattacctattactatacctatgtcaaaattataaattattgacatttagctggctctgaaggtcccaattatagttgacaatgcctgggaagaggttggaagaaggtgcagaaaaatgcaaaatgcagctgagctaaatttcctcatcctatctggacacagtttaaagctgtcatctcattcttgactttgaatcttagagaaacaagggttacagcagccttttcagaagaacttcaaggctcaacttaaatcgaatgtagacttaatagcaggatgcctaccttcaaatcagcaggtaagataaaagcaaatttaacagactctacagagcaa

SEQ ID NO: 236380 - DNA, 346 bp, Homo sapiens
atattaagtacttcaaagctgcaaaggaaaatacagatagaacccttttagaatattctatatttgtgtaggtacacacttaggtgctattaggccagcactttgggagactgaggtgggcggatcacctgaggtggggagttcgagaccagcttgaccaacatggagaaaccctgtctctactaaaaatacaaaattagccggatgtggtggttcatgcctgtaatctcagctacttgggagactgaggcaggagaattgcttgaacctgggaggcagaggttgtggtgagcggagattgtgccgttgcactccagcctgggcaaaaggagtgaaactccttctc

SEQ ID NO: 236381 - DNA, 358 bp, Homo sapiens
aagatctaaacattttggatctgagcaagcatttccctgccgtgtgattcactgtgctgccctgtggttgctatcatcgtcaaacagaaggctgactgacaaagaggcctctaaatcaaggggagaaaatcctccagaggatacactaattataggttaaatatcagagcacacagtattctgccttggaagaaaatttccattctgcaagacaagactatgacaaacaggcattttctcaaaatgactaatgcctcaaaagaaggcagaatgagaaacttgatgctgtgtatggtatttctgtgaaacatcacccccctgtttggtggaatatttaactgcatttcagttttcctga

SEQ ID NO: 236382 - DNA, 471 bp, Homo sapiens
ttcctctttcattcatagagaaaagtcctcaaaatgatttagtgtggtacctgccattgctttcaacaaggccaaatacagctagttcagccattgcacaagcgagaatttaaaccatttcattgcgtgttgacttctggtggaatactggggtgtaaaggatcagcttattgtgatcaacagcatgtatcaggccctttgtttgagttccaaggcaacaaacaacagaggaacactgactagctgccagatctttgagaatgactttaagattactaaaaacaaagtaacattttcttaataaaaaagatcttaaatattataaagaaaggaccagcagcccaagaaataatggaccaagaagacgaccacaaaatgtttaaataatcactgattatacaatattcaaagaaatttgaacaaaagaaacaataatatatctaaagattggtccattttatacatttggta

SEQ ID NO: 236383 - DNA, 195 bp, Homo sapiens
cgggagcagtcaacaaattccttattcctattttcctcagtacaaacaaatgagaatgagaaggctcccaaagcacagcatgaaatggcctggtctggagaaatcatacaaactgaacagaaggaaacccacaagcaaagaaagctttgtgttcccctgtcttaagaaaatggcagttccactatttggtaatat

SEQ ID NO: 236384 - DNA, 335 bp, Homo sapiens
ttaagcattggctagaaagtacagtgttactgataaaattcttttataagaaatgttatggagcatccaatttttttcttactctattggaatttggataaaatggatgcactgttgaaattacattcctaaactgaaaggtactcatgcaaagggcagcttttgaatcgtagatgagcaagtgagttctgtagaaacacagagtagagagttcgtgatcacctgaactcccttttctccaagtttttaatcttttagcttaggggagaggtgcttttctcttgccctttgtacatggcaaacagcactgtgacccatacttttttggtcatttc

SEQ ID NO: 236385 - DNA, 1226 bp, Homo sapiens
gtaataagtatatcacatcagtggaaggaaattaaaatatatcttttatatatagaaataatgctgttatctatattgaagacataagctaagtttcgagtttattttccaatatttattttagtttatttttaagctttctttttttttttttttgaaacggagtctcactctgtcaccaggctggagtgaaatggcagagtcttggctcactgcaacctccgactccctggttcgagtgattttcctgcctcagcctcttgagtagctgggattacaggcacatgccaccaggcccagctaatttttgtatttttaatagagatggagtttcaccatgttggccaggatggtctcgatcttctgaccttgtgatccacctgccttggcctcccaaagtgctgggattataggcgtgagccactgcgcctggcccatttttaagtttttgtagacaggggtctcgctatgttgcccaggctggtctccagctcctagcttcaagcgatcgtcccatttcagccttccaaagcattgggattacaggcacgagccactgtgtctggccaccagtatttgtaatcagttgctttttgcttgtatttttaaggggcatagtttacgagtggagaaaaatgttcgttgtgtttttaaaaccaacttttctaaacattgatcaagcgcttgtaactggcttcattgagttctttttatgttgacttctcaagctataacagtgaaagattggaagttattttaaaagattgcatactatatatgtactttaaaattttcagagtacttaatgtatacaaataattcttacagatgattagtgacaggcttaaagttggtgtattgaacccatgtataatttatttttacctcctccccaaactccaataaaatgcaatgaattagaaagggttatgtactcacaaggacaaaaatgaagagcagagaagagacagcatctaaatttggtaatttagaacgtttagaaagttgaatggttaactaacctagcagaatgattctaagctttatcagcttggaaatctgagaaacaagctgggttataatggagaatctgtgaaaggctcagaaattgatggcacaagcaactggaagtgaggatgaaagtgaggctaaaaacagaaagactggttaaagtctgttttaagaaggaactggaacacacaagatcgccttccctactctgttcc

SEQ ID NO: 236386 - DNA, 689 bp, Homo sapiens
tttcccttggtttatgatattcaatttggctcctgctgtaatgtacactgaaacctcaggctgctgagctatcttgatggttttaagaagacaatctggtgcctttacctgctagagaagtcacctagaatcctgttgtttaagcagaagattgtgtttccccaccacccccacaccaaacccagggaaaagataagctaacaggcagatcttcctgtcaccaaacacacagatctaccttcaacttcatcctcccaatccaatgaagacttcatctaatgtctcttcggtatgagtgcacacttcctccctggagccttcatatagaactacttaacaatatacatactgatccattgtggaattattaaggaaaatacattgaaataggtggcattcttgtcaaagatatatatggacggctagatggatagataggtgaaaatcatgttccatggaagaagagttagctcagcctgcaactcaaacaagtacagatattcttccatggaatgaccatcatacttggattgtaataaaaatgctttaggcaaacttctcatttcatccttggcatattaaaaatatgtatgtatgtttaaggcttgaaacttaacactgtattttaatgtttcagtaaggtaattcttcttaaataaaattggcatttttaaaaaagccctctctca

SEQ ID NO: 236387 - DNA, 934 bp, Homo sapiens
gtgccctgcccgcagaggtggagcctacagaggcaggcaggcctccttgagctgtggtgggctccacccagttcgagcttctgggctgctttgtttacctaatcaagcctgggcaatggcgggcgcccctcccccagcctcactgcagccttgcagtttgatctcagactgctgtgctagcaatcagcgagactccgtgggcgtaggaccttccgagccaggtgttggttataatttcgtggtgcgccgttttttaagcccgtcggaaaagcgcagtattcgggtgggagtgacccgattttccaggtgctgtccgtcacccctttctttgactcggaaagggaactccctgaccccttgcgcttcccaaagtgaggcaatgcctcgccctgctttggctcgcgcacggtgcgcgcacccactgacctgcgcccgctgtctggcactccctagtgagatgaaccctgtacctcagatggaaatgcagaaatcacccgtcttctgcgtcgctcatgctgggagctgcagaccggagctgttcctattcggccatcttggttcctccctccaagaactacttaacaatatacatactgatccattgtggaattattaaggaaaatacattgaaataggtggcattcttgtcaaagatatatatggacggctagatggatagataggtgaaaatcatgttccatggaagaagagttagctcagcctgcaactcaaacaagtacagatattcttccatggaatgaccatcatacttggattgtaataaaaatgctttaggcaaacttctcatttcatccttggcatattaaaaatatgtatgtatgtttaaggcttgaaacttaacactgtattttaatgtttcagtaaggtaattcttcttaaataaaattggcatttttaaaaaagccctctctca

SEQ ID NO: 236388 - DNA, 694 bp, Homo sapiens
ttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaa

SEQ ID NO: 236389 - DNA, 650 bp, Homo sapiens
  misc_feature (97)..(97): n is a, c, g, or t
gccatttaacctttgggaacaaggcaactagcgtctggcagcaggaatccaaccagtgccctgagttctgaggcagagaggaggacagaagaaacangaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaac

SEQ ID NO: 236390 - DNA, 274 bp, Homo sapiens
aaaaaaaaaaaaaaagcacaaaaaaagagtgtcattttccacagatatagttctggtttataaatcacccctaaggacggagtggggaccacaaatggcagaagctggaaaatccaaatcgagcaccagccacccaaccccaggaggtcacttctccttccctgcccaacaaccttcacgctcatttcattctccctcctgcacctttttttttttttgccctgaggccccactggcccatgttggtattttccaccccattttgactctggga

SEQ ID NO: 236391 - DNA, 459 bp, Homo sapiens
ttgagatgtagtcttgctctgttgcccaggctggagtgcagtggtgcgatctcagctcactgcaagctccacctcccgggttcacgccattctcctgcctcagcctcccgagtagctgggactacaggcgcccaccaccacgcctggctaattttttgtatttttagtagagacggggtttcactatgttagccaggatggtctccatctcctgacctcatgatccgcccacctcggcctcccaaaagtgctgggattacaggcatgagccaccgcgcccggctgagacaagggaactttatcttggagcactagggagccatgaatggttggagaccaggggagttctgtgctgtaagctagggcagtaactagtctagagctgtgttttctaaggagtgccagtgcttggtggaactagggagagaactggggcatgagatatcctggggagaggta

SEQ ID NO: 236392 - DNA, 421 bp, Homo sapiens
ggctggagtacaatggcgcgatctcggctcactgcaacttctgcctcccgggttcaagcgattctcctgcctcagcctccagagtagctgggactacaggcacacaccaccacgccaggctaatttttgtatttttggtagagacagagtttcaccatattaaccaggatggtcttgaactgacctcaggtgatctgcccttctcggcttcccaaagtgctgggattacaggcgtgagccactgcacccagccatttttaaacctgcttttctaacttacatttttttctaacttgatttgtttttctcttcttaatccttggactgccgcttctcctcagctttctccccagccctccctgccttctttcctttctccctcttcttcctcctcacctcttattttctccttttccttcac

SEQ ID NO: 236393 - DNA, 1713 bp, Homo sapiens
  misc_feature (4)..(4): n is a, c, g, or t
  misc_feature (39)..(39): n is a, c, g, or t
  misc_feature (60)..(60): n is a, c, g, or t
  misc_feature (62)..(62): n is a, c, g, or t
  misc_feature (100)..(100): n is a, c, g, or t
  misc_feature (116)..(116): n is a, c, g, or t
  misc_feature (146)..(146): n is a, c, g, or t
  misc_feature (161)..(161): n is a, c, g, or t
  misc_feature (235)..(235): n is a, c, g, or t
  misc_feature (250)..(250): n is a, c, g, or t
  misc_feature (259)..(259): n is a, c, g, or t
  misc_feature (263)..(263): n is a, c, g, or t
  misc_feature (267)..(267): n is a, c, g, or t
  misc_feature (311)..(311): n is a, c, g, or t
  misc_feature (337)..(337): n is a, c, g, or t
  misc_feature (388)..(388): n is a, c, g, or t
  misc_feature (424)..(424): n is a, c, g, or t
  misc_feature (434)..(434): n is a, c, g, or t
  misc_feature (452)..(452): n is a, c, g, or t
  misc_feature (547)..(547): n is a, c, g, or t
  misc_feature (555)..(555): n is a, c, g, or t
  misc_feature (647)..(647): n is a, c, g, or t
  misc_feature (683)..(683): n is a, c, g, or t
  misc_feature (800)..(800): n is a, c, g, or t
  misc_feature (955)..(955): n is a, c, g, or t
  misc_feature (1250)..(1250): n is a, c, g, or t
  misc_feature (1441)..(1441): n is a, c, g, or t
attngctgcatggccatggacaagttgttttaactctcngagccaacatttcctcttctntnaaatgggaatattaataatacttagcccttggagacantgttagaatttgaagnacaatgaataatttttaagagagcttgacncatgagaaaaataancttaaatgcatgaatatatatatcaagcatgaatttacctagtgcatatgcattatacactgggtgcataatantttataaaataatcnttgttttanaaantagngtttcattatttggggagaggcattaccgtcatttcctttctgntgacttcccctcttcagagttttctnctcttcccctcccatcccaccaccttgctttgtcacaaaacaaagccaatnggatcaccaacagtttaagactggtttactcaaaangaattcattnttttacatagctgaacanagaaatgataaataatgttctataaatatttgttggttgacagctttggaacaatgtcctctagaaaaagctgaacgtagccacccaccttgtangagagccncaaagaatagccatgtgcctgaatatgtgtcagccgctgtgtgactggaggggctgaggaaggggcgtagagggtgttgtgaggtcccttcngacaagcagtcaagaacgcatagaaatacattacangcagaagttacagacagctgagatgacgtgactgcactccagcctgggcgctagagcaaaatcctgtctcaaaaactaaataataataataacaaaatacaaataaaaaacaatgcngtataacaatgatttacatttacatttattaacagcacttacattgtttaggtattctaagtaatctggagatgaaagtatacgggaggatgtgcataggttatgggcaaataatatgctattttatatcagagatttgtgcatctgtagatttnggaagccatgggaattcctagaaacaatcccctgtggatatcaagagatggctctatacgataagtgtgtaaaatatatatattcagaaggaatcagaaaatcaaaattaatgtctctcagggaagatgggcttgatgggacttgatggaggatggtctgggagactatccccttctacggaaacattccctactaggagaccagcacagctgcagggaaataatttcttcaggcagtgttagcagcttctaaatctcgggaccctatgtccctgggctcctcaaggagatgttngttatttacagtgactcctgattcatttccttagggggtcctctcttccttcagctagggacttgaaggggaaaagtgccagcatttaccaagctccttaaagcgccaggtgctatactgctatgagtttcatatatagtcttttttaatccttgcaaaatctcaggtatggtggcatgtgcctgtagtcncagctacatgggaggctgaggcaggaagattgcttgagcccaggagttctgggctacagtgcactatgccaattggtgtccacactaagctcggcattaacattgtgatctcctggtagcaggggactaccaggttgccttaagaggggtgatccggcccaggtcagaaatggagcaggtcaaaactcgcatgctgattagtagtgggatcgtgcctgtgaatagccaccgcatttccacctgggaaacatagtgagaccctgtctctgggg

SEQ ID NO: 236394 - DNA, 1683 bp, Homo sapiens
  misc_feature (1004)..(1004): n is a, c, g, or t
tattacaatgatgcttctgtcctaagaagcttgagacaccgtcatctttgttactactatgactgtttatgttagtgcctcaccttttggtttccttgtgtgcccaaagctgctctccagagaacgtcatctcagtttcctgatcacaagcaggcttttccctgagatagatccaggcattgaatgcccagagcacatttagtatgtgcacgaatcctctagcttcctctcgcatttgtaaaagaatctgattcaccaggatgtttttggttcttttatgtaattttccatttcctgattgtggcaggtttttttttccattttctattcatctgtaactgctttggctcagccctttgtctccctactttctgccctgcagctaacttcatgagaaagtcccgtgttccctgggtctggaaacttgtcttgtcccaggagacatactctagttttcaagagacgtgaaagagcttcagcaacctcagaatgttctggtggcagcatcaaaatcatgaccatgcatgaataaggggtattgtcatgtgtgtgctgatagagcccggggaccactgaattctagccccatctctgaaatatgtgcccaccagggcagagcattttcttttaagttccgcccagcttctctgcaaagtgggccactttagttctagatttcagagatctctgtataaaccagattacgattttagggtcttgaaggagaaaaaaaaaaatgtcataaatcttattaatactaatggcttttgttttaccagcaagaaataagtaaattgctctcattgggataagataaaccttttaataaccatttcttataggcactgagtagtttgtaggtgggcatcgaatttccaatgtggaaattatgctgaaaaaactgtctcccagcaggggtatttattttcttttctaagccccacaacatcatcaaatgacaagagtcagcattctcatatgcatgtgtgtcctttgtatgaacnttatctgcccagtagtgcccagaaatcaaatgaatataaactaagactttgttttcgatgtgctttttacttttggcatttataaactctctgagtcatccctgggagtggaggccacagcggtgggaccagtacttatgtgaatatacagtcataggttttattgtcttgctgtctcttaaaaaaaaaaaaaaggaagttctacaagtctcatggaaatactggaattggagatacatatttaacatgctaactttattagatcatgatttctacctaatttggttgtgtttcagtaaactacaatccccagtcatgtgacaaacacctgtttttaatagaatccatcatcttcagagaaattggttgtattcatgagctaaaacatgaatatatgggctgggtgcagtggctcacgcctgtaatcccagcactttgggaggccaaggcgggcagatcacctgaggtcgggagttcgagaccagcctgaccaacatggaaaaatcccatctctactacaaatacgaaattagctgggtgtggtggcacgcgcccgtagtcccagctactcgggaggctgaggcaggagaatcgcttgaacccaggaggcggaggttgcagtgagccgagatcacgccattgcactccagcctgggcaagaggagtgaaactccgtctc

SEQ ID NO: 236395 - DNA, 591 bp, Homo sapiens
gtcatgtggtcacccaggctggagtgcagtggcatgatcacagctcactgcagcatcgaaaccctgggctcaagccatcctcctgccccagcatcctgagtagctgagactacaggtgcacaacaccattcccagctaattaaaaacaattttttttttttttagaacaaggggtcttgccatgttgcccaggctggtcttgaactcctggcctcaagtgatcctcctgcctcagcttcccgagcagctaggcttacagatgagcctcaccatgcctggctctctagttttcttgcatttctctactcccactatcttacctaaatcttaaaagacagacaaaggttcttatagttagccctttctcaaaaaccttgaccctgaaatttgaacttcccacaattattcctggtttctttctagttccacaaactttctcctagttcttggatcatggtttgttcctctttcccttcatagataacactggagataacattcatctcagaagttagattcctttaaaaacaaatgctctagttcctggggcactagagagaaaagatttgccaacaaaagggtccagcttgc

SEQ ID NO: 236396 - DNA, 463 bp, Homo sapiens
cattaggcagaagaagactctcttattctggggagggtcagccttttgttctattcagaccttcagctgattgtccacccatgttagggaggacagtctgctttactcagtctacatatttaaatgttcatctcatcccaaaacacctgcacagaaacacccagaataatgtttgactaaatatctgggcacatctatggctcagtcaagttgacacataaaattaacaatcatatgggttaatgggaaaggtggtaactgggggtgctattttaaaagggttttcagaggaggcatctttagggagaggccataagaacagtaatctaaacgaagtaaaagccagaagctgtgaaagaggatctttcccggggaagggcatagcaggtatgaaaccctatatctgacacgagtttaggatatccaaactactgtaagaaactgctaagggtggatcacaaag

SEQ ID NO: 236397 - DNA, 557 bp, Homo sapiens
gactgttccccaaacacagggagaatttgcagaaaataagcccaaaaatcttgccattctttgcaataaaaccccacattacaaactgctgaaaacaggattttagcctgaataggttgttcctctatttgaaagcctttacaatttcggagggaagtttccaaatcaatcagtaagtaccccccactccaggtttatccttatgtaaagtgccccctttgcacatgcaagattgaataaaccttgaaaatattatgctaagtgaaagaagccggtcacaaaggaccacatggtatgtaattccatttaaataaaatgtccaaaatagaccaacacatagaaacagaaagtagatttgtggtggcccaggattaggggagttggggggaaatggagggatatggtgtttacttcagggtaatgaaaatgatctaaaatttattgtggtgatgtttgcataacagtgcaaatatactgaaaaccactgaattttacactttaaatcagtggcttctgtggtatgttatcaatatttctcaataaaacttcaaaaaaat

SEQ ID NO: 236398 - DNA, 444 bp, Homo sapiens
tcttttaacagatattgagctgttaatttgcaccagcactgtgctaagggctccacgtatagtcttatttcatatgcacaacagatgtgcaatataggtgttctaagtatccccatgttacaatgaagaaaattgagactgagaaatgttagggaacatccccaaggccacacaaccaatgtacgcccagggtctttcctgactcaggggtctccctgactcagatgccttacaaacagcacttaaccaacaggctggatgacttcgctagttcacgtcttctcactgcgtgttgttgaaacagatactgtagtggagtgcgttttcttcatgcagtgtgttgttgacactcatctgaattaatgcatacagtgaaaaggcgttaagaatagttgaaaagtactatggtacaaatgatgatatggcataaatacaatgaaacgg

SEQ ID NO: 236399 - DNA, 183 bp, Homo sapiens
aattagtgggatgctgctaagctttactcagggaaatttctagcactaaatatctatgttaaaatatatttaaaaagaagaaaggtctgagtttctaccttaaaaactagaaaaacaagagcaaattaaatacaaagtaagcaggagaaaggaaatagctatcaaaacaaatcagttaaatag

SEQ ID NO: 236400 - DNA, 482 bp, Homo sapiens
atgaacaccagtgccagcaagaaagcaagcagcagagcaagtaagaacgggattttgaaaattcttatggaaaaaagtctgcagcatttccagaaactttcttaattagaagaaaacatgaaaataaccgttgcaaatcaattgtatataaaaatgaatggtcttctattaaaatgtagagggagattttttgccaaagtgttgggattacaggcgtgagccactgcacctggccagttgagctttttaaagataacagaaaggactgctgagaatgagtaaacctatgtccgtaaagagaattgcatgatttactgcaagtattcctgggagtgaagcatcacgtacacactgctggtctcgtgtcctcctgaagatagcccctcacacttcacagtggttggagaaggttctttttctctcctgtcttccctctgggtcccacctggtctagcattttcatctgtgttgaaatttgtttt

SEQ ID NO: 236401 - DNA, 165 bp, Homo sapiens
gatctcagcccaaagaatgggggtgctcccatttcacttgattccctggcatctgatgccagagcgcactttcccagcaagaactcacaggactctgagttggccatgccctgcactgcctctgtctctgccacggttgaccctccataactggaaaccatgatc

SEQ ID NO: 236402 - DNA, 548 bp, Homo sapiens
gcattagaggagcagcaccaggggtctgaacttgatgatttattgtgattcctgattctcctgctgtttgagactgtctgaaaagatgaagaccctgtcacagcagacagcacttggcgggagggctctgtcttacaaagaactaactactataataagcctgggagaatgcaggcccttttgtgcatttttttaaaagcatttcctgaaatttctctaaaagaaactaatatatccaagtacatctgcaaacaacaaaaaaagtgggtggggggaagaaattaatatccaaaattagaatgtgtatttggacatcaacttcaagactgtttcaggtttataaaaggcacaattagctaatgttcctggcttatagtgtcttgttttagaaattgagttgttgtcatgaacaggacagtttttattagtgtgccccagcggctcctgaatttttggagggacttagggcaatcttctgttaggacggtgcaccttgtcctgtgtggaagctgcgtttgtatagcaagcaccctgtttttacttggaga

SEQ ID NO: 236403 - DNA, 607 bp, Homo sapiens
gctggagtgcaggggcgtgattttgttttattgcaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctgccatttccgggatcagccacccccccaagaaatacctgatttatcgattgtagaaaccctagtgcttgctaactaaaaagaaaacacagttttacctgccctcggattatgaaaaaatgcgtgcccaacagtggtctgattttattgaactaaatttttagtaggagaacaccgggagaaaatgtgtactcccacgatccactcaatttttgttggtaaacggagttatgtttctttcct

SEQ ID NO: 236404 - DNA, 673 bp, Homo sapiens
gctggagtgcaggggcgtgattttgttttattgcaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcc

SEQ ID NO: 236405 - DNA, 390 bp, Homo sapiens
cagtaattttcatattaatacatttcagcacttcaatactaagtcattctttaaattgtggcctttaataaataaacaaataaaatgaataaactaatatgttgaaagggaaaagatggccaggcacggtggctcatgtctataatctaaccactttgggaggccgaggtggatggatcacttgaggccagagtttgagaccagcctgggcatgatggtgaaacctcatctctacaaaaaatagcttggcattgtggcttatacctgtggtcccaagttaccctagtggctgaggtgggaggatcacttaagcccaggaagttgaggctgcagtgagccaagattgcgccactgtactccagcctgggtgacagagtaagaccctgtctc

SEQ ID NO: 236406 - DNA, 512 bp, Homo sapiens
ctggcactaatctcccccacactaggtgcagcccactccctaccatccctttggctccacaccctttacagtaacaatggcagcttagtcaaacagagaactgaggtttggtagagcaccaagtttcattgtttttgtcaggccagattttggatgtgaaagagttatcagactaagagaaaacaaaggatagtgacagttcagagtagctggagttgcttacactatataacagctaagagttgtttatctaccactttagcattttggtgatacatataaaaatccttagctcctatgtatttccttcacatttatcaacatctataatgtcctccctttcagtggcgtatcatgtcaggtttgcttcaaataaagaaatgtgatcataatgaatattttcactgtgatgtatttaatggagaggctaggtggtggttttgatagttcaattcaaggctaatcagggggtctgcaatgctagtaaccttcatcctaacctggaaaaaaaa

SEQ ID NO: 236407 - DNA, 200 bp, Homo sapiens
gacataagtttacctatataacaaatttgcacatgtaattatgtccatgtccttgtgtagtttaggggaatcatttactatcatgtaataaatccctgcttctccttaccggtgggtctgaaaacagtcttgcccaaatgtgaagcaactcagtgcggatcaatacatgatattcacctgaggtacagccgggagtccca

SEQ ID NO: 236408 - DNA, 596 bp, Homo sapiens
atttttttgtattttagtacagacggggtttcactttgttgcccaggctggtcttgaactcctgagcaatccacccaccttggcctccgaaaaatgttaggattacaggcgtgagccaccatgcccggcccgaccatgttttatatattcgtcactgaattctagaactgaccactgtttctgacatataatagtggttctccttaacactaactttatgcttggaccaaatcaggtttcccgtcagtattatattctacagtatatctttcatagtaatactgtgttcaactttaaaagcttgttaattgtgatcatactcttactaggattatactaaaggttctacttgtgtttgtgaacatacatgacaaaaacacacatattaaaattatttgtttccgagttttatactatctaatgacacaactgtgtaagcatggtattttactgtttaaaattgtaaagtatcctgttaaactttacttttaaatttttcttaagacttcttaagttgcagtaactgtctatcataaattgaccttaacaacatctcctgttaggtagaatgacaaaattaaaatggagcttagttg

SEQ ID NO: 236409 - DNA, 359 bp, Homo sapiens
aaagacagtctcactctgtcacccaggctggagtgcagtgcacaatctcaggtcactgcagcctccccctcctgggttcaagcaattctcctgcctcagcctcccaagtagctgggattacaggttcctgccaccacacccagcaaatttttgtatttttagtagagatggggttccccatgttggtcaggctggtcttgaactcctaacctcaagcagtccatccgcctcggcctcccaaaatgctgggattacaggcatgagccactgcacccggcctattgttgtacgtcataaatctacatgttcaaactaaaacttaatgcagcctcctacccttcctgttccgtaattggctc

SEQ ID NO: 236410 - DNA, 575 bp, Homo sapiens
gcagtttcagaattgtaacagggagctcccggaggggaggaggagagcacaatgggcctagaacccaggctttctgatatgtactccccaaggctttttctgccccagtatgctgccttttgaaaggccctccctgcctcttttaacattttttaatgaatgagcttatctgtttcagcaccataggcaaggaggaatggggtaattacagaagtacacctccctcttatttcttgggtggcagcagttacactagttggaattaagccaagtgtggcttaagagatcgagggaccatttcttttatttagaaaggtagtgggaggaaaaaaactgccccaacgtgttaattttaaagttgacttcctgagaaaagttgacttgcatcatagttaaatttcagtctaagtttgtttagtctctaaacagactatttttaacagttcaatttgattttaccctatcagttgtaagttccaaaaatatttgtaaatattctaatttcagaagaataatacgtatagaaaagtgattattgttgggctctactagagaaatttgcagaatatctttgt

SEQ ID NO: 236411 - DNA, 713 bp, Homo sapiens
agtgacctccagcatcaggtggaggacgtggtgctatgggatggggcatgctgcacctccagaggctccgggcctcagatatcctccatgctggaaaggtgggagctctgagtggtctgttttgagccagcttcctcctgcccctccagcttccccagggtgcatctgcacacacaggtacacacacacacgtccacatacatgcacacgccctgctctcctgtgcactcccaacgagtccgagtaaatgcctttgcttctcttgcttgctctttggctcaggccaggaaccccttttggggtcacaagggaccattacagctcatttggtcaaaaagcccccatccagtgcccccaaccagcacctcgaagacccttcataaatctcaagtgaggccgggcacggtggctgacacctgtaatcccagcagtttgggaggctgaggcaggtggatcatgaggtcaggagttcgagaccagcctgactaacatggtgaaacccccatctctactaaaaatacaaaaattagctgggcatggtagcgcacgcctgtagtcccagctgctcgggaggctgagcaagagaatcgcttgaacctggaaggcggagtttgcagtgagccgagatcgcaccactgcactctagcctgggcgacagagcgagactccatctcaaaaaaaaaaaatctcaagtgaatgacgaatacctcttg

SEQ ID NO: 236412 - DNA, 507 bp, Homo sapiens
acatcctagttcaaacttactctccaaagaaccaagcacagagccaggcatgtcatagaccttcaattgttcgaggcaagtgtgcctttactcacctcagggcttatttccagaacacatttcttctaccatgattaccacccactcccacctccctcctccctcttccaaaccctgattgaaaatataaacaagtacgagttacataaattgatagataaaaagaacgggttatcaatagaagcctgcagtgtcagaggtgcacctgcatcttctgggtactgtaggacttgcattcctttccagaaatgtgccttttaagcctctgcaagctgaaccctgttctctctctggccacctcccagtggctttacttctgcccttcatcagcttagctgttgtcatacagattgcagagacattcttgctgcacagaagccaaatgtagttgtaagaataatttatggatggttccatccatccacattaaaaaatagttccttatca

SEQ ID NO: 236413 - DNA, 720 bp, Homo sapiens
gagtaaacattcgtctcccctctccctcacgcccctgcgatgtattgttttgatgcggatgtatgaacagttaatgtcaggggacgtactttaaaaaaaagtctaattgcaagttagatgtggttaaatgccctcaaaaaccacacatactggtagtttgaactttgttttatagaattaaatgcagccgggatcacaacactaaaaacctactatttgacacagtttgatccaatcttttttgaaaagtatagagattaacattatgctaatttttaaatacttgatttctagaccaggatgtaatcaataaaaacggatattaatatttagcaccaattatttaattatgctagttattttacattgactgcaagccacgtaaaacagttaggccgggcgcgctggctcacgcctgtaatcccagcactttgggaggccgaggcggacggatcaaaaggtcaggagtttgagaccagcctggccaatatggtgaagcccgtctctactaaaaatagaaaaattagccgggcgtggtagcaggctcctgtagtcccagccacttgggaggcagatgcaggagaatcgtttgaaccctggaggcggaggttgcagtgagctgagatcgggtccctaaactctagcctgggtgacagagcgagactccgtctcaaaaaaaagaaaacaccaaaaaaaaagaaaaacaatttgttatttttt

SEQ ID NO: 236414 - DNA, 297 bp, Homo sapiens
cagggactgcagggactgcattgctcttgcagcaccacccgcctccgtggacaccttcagcagtgagacaatgcaggctctgctacaagaggtgcttactgggctctgctctggtgaggagaggcctcgcctggcagccagacagagtcccagcagggcaagatgaaaattcggggccctcgttcaaacagcaagagaaggctctttccttccttccagcgcccctccctgcacctgtgatggtgtttttatttgttatttaacgtcatgtgctcttgggcaaggggaggggaaact

SEQ ID NO: 236415 - DNA, 460 bp, Homo sapiens
tatttcttggctcctctcagctctcagattcagactcccttttttagaaggatgttaggtgtgggactttctctagaaagcagctatcacttattttggaggtgtaatgactgggaacagaaagggggagaaacagatccgaggcacaagagagctcctgaaaaagctgctgaaacgtgcctgggccatctcctgagagaagcctagatgggcggcctccaaggagtccttgtgctgtttgggaccttgagtagctgcctctccatggggccctgtttcccagttcataaaacgggtgatgcagctgagttgtgatagtcaggatgccttcaattgtagacaacaaaaaccaaactagggctgggcacggtgacacatgcctacagtgccaactatttggaaggctgaaataggaggattgcttgagctcagaagttctagaccaagcctaacaatatcc

SEQ ID NO: 236416 - DNA, 402 bp, Homo sapiens
ctctaaagctggaagtggttgcagctactgtaacttggtcgttaaaggtaaatgttactaactgctgtttatggcaatatggtggattagattccctaaccttaccattgctgaatagggaagaaagtaaagaatcatctgatgccaaaagcaaagtgagaataagactcctggaaggtaaacaagtacaaaaggcagcttgtagccagaaaataactgctgattcctgggaaccttgagtttccattttgatgactaggcaataatgatagaaaatcagcttaggggctacaaatggaaagtctaataggagatccttgcatgaaccggaaccccaaagaacaattcaaaagagagttgaaaaaataaaaagggtaagatagaataagtgaaactaatagg

SEQ ID NO: 236417 - DNA, 457 bp, Homo sapiens
caggcaagattagccactaaaaaaggaaaatggcagggtttgcttcagtgtttgttgttttgttcaccagcctgatttttgccagcacctttgtgtgtcagtggctccaaactgtgaaagtactccaagataaaaagaagcagctgcctctattttctttactgccttctatatatctctgaattcctttttgtaaatttgtttggttctgtgcacaggagtcccacaaaaatattagagtcaaagaagggccagatgaagaaagtctatatcacatcctgagctatagaaagaaacaggggcttgaggctcctgagaggtggtagagtcaaattatcgcagcgtgaggagaagaaatgtatggtgaacaaaggttgccttgttatgcagacaaaactctcttaggtaataaaagttgtctgggagcagctcgcttcctgttacagatatccttact

SEQ ID NO: 236418 - DNA, 454 bp, Homo sapiens
cgggcgtcctcccctgaacgaatgtcctggcggggcgtgcccagccaccatccagcttcagaggcaatggccgggcgtcgtgagaaggggagggagaaggaagcggaagagagagagttggaaagactagaggaagaggtggccacgtcttttgccatcccagctttaaactgcagtgtttaaggcctcgtctgccctgctaaggtcaccgaactttttactttatgtgaaaagtgcttcccaagggaggcacagggactccggttctgaaaccgattaatggtcttagagcccccagtaagccgttaccaaagtgtccgggtcacagttgcagaggaagtgagaagcgtgttcgacctcatttgaaacggcttcacagagggtaaacctcaagttgattttgtaaaaaggaaagcctgtggtttggccgagaagaataaataatatattctag

SEQ ID NO: 236419 - DNA, 2864 bp, Homo sapiens
gtgctgacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcggctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaagaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgggccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcgacctcccaaagttgctgggattacagatgttagccaccgatcctggccccccccccaaaagtttctgatataaagctggcaggaagtcagtgacaattattaagtcttggaagaaaaatttctaagtttctcctgagaagaaatttctgaagaaacatcttgtagataatgtagtttcacagtaaagtttttttatttttatttttttaatttgaggcagagccttgttctgtcacccaggctggagtgcagtggtgtgatctcagctcactgcagcctccgcctcccaggttcaagtgattctcatgcctcagcctcccaagtagctgggattacgggcatgtgccaccacacttggctaattttttttttttttttttggagacagagtcttgctctatcaccaatgcactccagccagggtgagagtgagagactgtctcaaaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagt

SEQ ID NO: 236420 - DNA, 450 bp, Homo sapiens
tgttggtgccagggactggtttcatcagagacagttttccaacggactggggtgggtagggggatggtttcgggataaaattgttccacctcagatcatcaggcattagattctcataaggagtgcacaatctagatcccttgtatgcacagttcacaatagggttcatgctcttatgagaatctaatgctgccactgatctgacaggaggtggagctcaggcaggaatgcttgtccacctgctgctcacctcctgctgtgtggcctggttcctaacaggccacagactggtactggcccaccacctggggttgggaaccccggctatagggcaaatgtagaccaggcttcaggcaggtgactcaggtttgcctagagatggacagtaggactgggaggtgggaaatcacctgtcctgcattcaggcagcccccacccgcccccccccca

SEQ ID NO: 236421 - DNA, 700 bp, Homo sapiens
gagtatggattgaataaaccaaaaattatgtagatgatgtaattactataattaaatcaaaacagattgtgtatgctggaacttattgtattactcacaacataattttgtataacttttttttaaacctgtctcttttcctttctggtctgtgggtttctgaaggacaaacctcttttggcagttgggcctgaagccccagaacttatgctggtcctggcaccaatgaggacagaaatgattgagcacatgaatttggtggaaattgatttttacttctctgcagctaagtatgtggcagtcttggccacatggtgactcagcagaggagcctatgtactggctgtcctgatgctcttcctgattcaactgattctctacacttgatcttagccaaaaggccgagaagcaatgattcaactgattctcaaaaggacaccgctgcaggaataaacccacttctaaatatggtacacttggaaagttgtccagctcgcaatgtcagagtcacagacttcatgcacactcatctcaagtcaatgttatctaacacatttccactaattattggatgacactagcaagaaactctgatatttttcacctaacctttgctaatttaaatgtggccagcccaccctcatactgcattgtgatggggatataaaagccaatgaaagatatcattaattgttaacaa

SEQ ID NO: 236422 - DNA, 668 bp, Homo sapiens
gagtatggattgaataaaccaaaaattatgtagatgatgtaattactataattaaatcaaaacagattgtgtatgctggaacttattgtattactcacaacataattttgtataacttttttttaaacctgtctcttttcctttctggtctgtgggtttctgaaggacaaacctcttttggcagttgggcctgaagccccagaacttatgctggtcctggcaccaatgaggacagaaatgattgagcacatgaatttggtattgagtttgacattattgtgcttcattttttgtgggcctgggatgttttctacgtaattcgtttatcatttattgtttaaggtgtctgcatactcaaaatatctttttaatgtcctccgcctatacatgacataaatactttattaactttgtttaaaaaatcttatcacagtgccatccaacaggaatataatgtgagccatgtgtaatttaagatttactaatagccatattaaaaaaggaagaagaaactggtgaaattaatttttaataatgttttatttagctatattcaaaacattatcattttaacatgcaaatataaatttattaatatctcttacattattttttctagtaactttttaaaatctagttggtattttatatttaatgcacattttaat

SEQ ID NO: 236423 - DNA, 400 bp, Homo sapiens
tcaagaagagtttggttcactatgttggatgctgctgatcaaatgcaataggaaaataattgattattgattttggcaacattgtaagtaatttggtaagagcaatttccacaaatagttgggttgaaagttcaactggaaagtccaacacacaattcatttgtgtgttgaggaatagaagaaaaatgtgaagagagcgactcttaaaaacaacacctgttcaagaagttgtgccatgaagatctcagtaaaaaggtgttacagccagtggagtgaagagtttgtttttgttgtgttgtcttaaactggactactcctttattgatccttagcaccttgtacagagcaaatgttcaaacattgttgagtgtttgactaaataaagtgtttatgtctcata

SEQ ID NO: 236424 - DNA, 376 bp, Homo sapiens
agcccctacctgctgacccaccgcctccgggcgcacgggaagaggactgagagccctgaaaccccagcggggcaggagccagcattctgagcatgtgcgagccagccagggggctagggcggatttggggggtcgactttaggtcgtcgccctaagcgcaaagcgaaagagcggtgagagcaggggcgggcgacactccccggagcggtgcccctgcgcccagggcgcagcgactgcgccctgccctgcgggtgtgggcgagttggccgcgtgtgtgcctcgctgtttgacgcgaagacgagccaatcagggcgggcggcccgagctgccatgtgacgggcaaggcggcccctttccccagcgcggccagagggag

SEQ ID NO: 236425 - DNA, 503 bp, Homo sapiens
cagaagggcttatgcagagccgggatattttttacacaaaatcagaggagggcgaccttcaaactattatttgtttttctcctttggcctggaactaatcagcttagcatggatgcctgggtgtcccggtgagatagcgaacccatctcatttgggtgtttaccttttataaaagaaaaaaaaatccatttcttatgagtacattgttatttattctagaacttccctcataaaccgtcagttcatgctatgtaatcctataaagtagtttatttttaaaaatcgttgaaaggataagcagaagatcgcctcttcctggcatgtgtcaaattgctttatatgtagctattctagagcaaaaatgctgactgtccgttgaatattgtcacttgccaagcagagagctgcgcacccctttcacccatctgtgggtcagtatgcagtgtatttggggatatgacacagtttcttatcgcttcccatcacctgtcctgtgtgaattg

SEQ ID NO: 236426 - DNA, 384 bp, Homo sapiens
gccctatgttattgtcatgaattatatgggaagatactcctccccctccactaagcaccaagtttaagatcatttttatggagaaagtatttttctcctctcttttcaggtccttgctttgtgtaagggtctcctgttttaagagttcctaccttagtggtgggtggggtaggtgtatctcttaaggctaacactacttggatgttctctttggattccttccttcgatgttgtgtctgcagacacttcgctttcttaccagctcaagaaggcttcctaggaaatactagccaatactttgactgttgtttaggttctcctttttatcattgaaataaaaagacctgtttaccttcagaaatttcaaaaaatatctagtttgca

SEQ ID NO: 236427 - DNA, 268 bp, Homo sapiens
gggaacaatcattcggcagccccaggagcctggctctgactggccatatggatgatgatgacaacctccaggtggaagaaggaagttcctgcagggaaaagatgataggctaaaaacaatcacaaaagcattaacagatgtcctttataaaaatagatgttttgtgtgcaaaataaggtatgatttgaaaaataagagaaaatttgaagaaaacttagcaaatggtgtttccagtaaaatggagatagtaaaattaattaactgttga

SEQ ID NO: 236428 - DNA, 1730 bp, Homo sapiens
  misc_feature (466)..(466): n is a, c, g, or t
gacaggaaaggggttctatccatgatcttacaattcctaaacagcaacagcatcatggacgtatttgttcctggcgtcataagcctgcatacggtaggcattcagttaataggtactgattggtctaacagaggaagctgggcttgattataaaataaactaggctatgaaatcatgcctcctaaaagctcattaaaggcagcaacacgggatggggactgtaaggaagttgtctcccacctgcctccctcctcagacacacatcattccgcagatgtgaaaacgacccagactctgcccgcatgtggcctcccggaccgggcagtagggccttgcccctaccctcatgaagactgtcggctgtgttacagaactgctgctctgtctctgactcccctcactcccatgctttgttggaaactcaagttgtgaaaccacaaaacacagaaaggaagtggtcaactantgcacatactcaagctatgtagtctcagtttattccattcttgcaggatcattgtaggaaggcataagagtcctgcttactggtgagccactgaacacaaactcccttctcacctctgccttggatcccgccatgcctgaggtctagggctagaagcgttgtttcatccacattaattccggtcttgggcaacgtggctattttctgacctgtctgtcttcccaccctagtggtgaattctctttctgggatctcaactccttctcctgtcacccagctttttccgagcaaccccagtccatctggcatatcattagaatgttaaacctaaaacggtaagccattctgtgaatacctttaagtaacaggatattaaaatgagacttttcctgttttctcagtgctagctgacatctttgagctgagaaaaaaaaatattgttaaaaatgctcatctattctcaggagatgtcatctgctaaggagtgaccaaaaaaatggtccaataaccctgaaaccatcgctcaaatcttagctacgcaaggggagacttgtaaattaatgaggacggcaaggatttcatgagacagagctttcaggctgctaaaatgcttcctcctcccttctcatgtgttttcccctcatcttacgcaaataagagggggccttcagagaattacttggagagctgacctaggacccctaggctttggggaacatagaatgtattagtgtctattgctgctgaaacaaattagcacacatttaacagcttaaaaatagcaaaattactacctcacagttctgtaggttagaagtccagtgggcgcggctggtgtgtgggcttcaagcctcacagggctgaaatcaaggtgttggccaggctgtactccctcctagaggctctaatgaagcatctgtttccaggcctctgcgccttgttggcggaattcagttcaatttgcctgatggactgaggtccctgcttccctgcgggctgtcggcgggaactgccactggctccttgcagcctctctctgattcttgcacaagggcacctacatctcagagccagcgagagtgtgagtgtgtggaatccttctcacgaggcctcatctctctgactttcgtcgggaaatgttctctgcttttaaaggatcatgtaattattttgagcctacccgataatccaggataatcccctcatctaaaaatctgttaccttaaccacatctgcaaagtccctgttgccgtgtaaagagagc

SEQ ID NO: 236429 - DNA, 160 bp, Homo sapiens
  misc_feature (127)..(127): n is a, c, g, or t
cctcaaatcagcctctcctcaaattcggagtctaaggaattttttggggggggtttgtttttgagacagtgtcttgctttgttgtccaggctggaggttgcagtgaacggagattgcgtcactgcantccagcctgcacaacagaacgagacttcacctc

SEQ ID NO: 236430 - DNA, 545 bp, Homo sapiens
ttaaaatccagtaaggttgaggaacttgacattttaaaactgcagttttatttttaactacataagaggctggtcatgtgaaatgtgcactgctatgttggaatggatatgtatgtgacaattaacctcattaaagctctgttgctgtggtaggcattcagttattcctaatagtttattttaggtactatactgctatcctatttgctgaaattataaatactagcaatgtacaataattctcattctttggctgaataaaaacagaaatttaaaggtgctgtgtcacataaacagttaatgcctcagtactaaagttttgaaaaatattcctaaaaacttcacaggcatgaatttttgaaaagaagaagaaaccacatatacacatagaggaatttttaaagactggcattttaaagtatagctggtaaaaatggtatgtatccttatgtgtagaatttaaacttcttgaaaataatctaagctgcaacaatctatgtaactgctcttccacagttttacataaagataagaatttgtcttac

SEQ ID NO: 236431 - DNA, 84 bp, Homo sapiens
agcgtgtggtctcttgtactactgtatgcttttggaatagacaacagaggacctgaaattgcttcctcaaagttactttcaggg

SEQ ID NO: 236432 - DNA, 343 bp, Homo sapiens
gtattctagagattttgatatgttttgtttctgttttcaaagaattttttaatctctaccttgacttcattgtttactcgacaggagcaagttgtttaattttcatgctattgtgtggttttgagagatcttgttgatatctatttttatttcactttggtctgagagtatggttggtataaggtaagtgtctttagctcaacttaaaaaatgaggtaaaggaagctcagtaatagtaagttccccaaggtcactcaggtatcaagggctacagcaaggattataaatgagtgtttttcactcctaagcatatgcattttttactaagccacattacctttaa

SEQ ID NO: 236433 - DNA, 451 bp, Homo sapiens
aaggggctgtaaggtgccgcaacgtgtgagtcggtgggttctgatgtgtgacagctcggggcactccccccaccgccagggaacaggaatgaggagccccccactcccagtgtctggcaggtaggaggccgccactggactgtgtgcccaggtgccaccagaccccgagggcccacggatacggcacatgacctttaatgaccaacgcctgtgcagcaggtgctgaggggccccagccccgagcaaggctgggttcctggaaccccccctccggtaggaggatttgcagctgaggaattcttaagaaattttttggtagcaaacaaagcatggggctggacggtggacctatgagtgccctcacatgaatgcggatatagacagaaaagacggcaaacatttgtgaacaaaaggaatggctcctgcgtattgaacttccacttaccggccc

SEQ ID NO: 236434 - DNA, 383 bp, Homo sapiens
ttccaatggacaaaaactgtttcctcttctataatgagttaactaaaacggaacaaatgtcaataatgtcaacaaacctttgtaaaatacaccaagcacccagttatttctaatattctccccttgttaaatttcatttgctgacacagtaaagaactggaacacagaaatatgaccttctactttaacaatgcagtgtcttcatagctaagacaatagagttgattccccttaagatgaaaaatgcaagtgatgttcttctcttgtccaataatttctctagccttttgggtaatcatgttccgaaggccatgaatattttatagttgtgggatctgaactaactttaaagcctatgctccttcttaaacagtaaactattt

SEQ ID NO: 236435 - DNA, 443 bp, Homo sapiens
cttggtctctaacccaggctggagttcattggcacaatctcagctcattacagccttgacctcctggactcaagccatcctcccacctcggccgcccaagtagctgaaaccacagctcacaattctctgatgggcttgcctactcatttagcccttcatgaagtccctgagctgcctttttcatctggagtctccatgcacaacggtgaaaagtgcatcttttatctcacctgagacagtgtcttgctgtatcacaaagccagatccagtgctgggatcacagcttgttgcagcctccaactcctgggctcatggaatcctcttgcctcagcttccctagcagctggaactacagaaaaacagacatttgaaaggagtactttgccatcgtttttatttgttaatgttcagaaattaataaataatacttcataatttaaaaa

SEQ ID NO: 236436 - DNA, 119 bp, Homo sapiens
agcagacacagataacttgggcatctctctggcttcaatcactgctcaatctaatatagttcccaccctgggtgttcagagtctcttatttggagttagacccagctggggcttgaaac

SEQ ID NO: 236437 - DNA, 659 bp, Homo sapiens
tttggagacagagtcttgctctttcgcccaggctggagtgcagtggtgtgatctcggctcactgcaacgtccacctcccgggttcaggcgatttgtgtgtctcagcctcttgagtagctgggattacaggcatgtaccaccacacctggctaattttgtatacggcatctttttttaaagcctctccagtgatctaacctgcagggctgagaaccacggctggacagcacctagggccatacggactactctagaaatctcctccacctggctttggtgtagaagctggaggaatttgtgccctgctctagctttcaccaggttgagggtgacactgggccactcttctgctacttcttggagctgagttggaggcaaaagaccagccccagccatgctgctggtgatgacagttctagatgcctccagcctctggggctggtgccctggcaccatcctgggctgggctcacatgactcaggagcctggctccaccaagcctggctaaatcccgcactgggggctgggcctggagcacagccccatgtcccacgccatctggctcacctcctttcctctccaaaagcctgacaatggcattgaataagaggctgttccacctcaggggaagatagtaactcaggaagcaaaaaatgaat

SEQ ID NO: 236438 - DNA, 301 bp, Homo sapiens
cgaatgcagaaattccaaagctaaacgtaactaggaagagttagttttagtaaaaagaaaaaagtcagttaatgaccagttaatattatgaaaattatctttttccagttggatgcatgtgagtgtcttatcctgcacagttttaaagctggtccaacttgttttatgtttcataaatgctatggttaggactgatcttgctaacctcaactttattttctccccacgatattttcatttgcttccaatagtgtcagaggtgcacagattcttttatcaatacattttatacacgtaccaa

SEQ ID NO: 236439 - DNA, 290 bp, Homo sapiens
gggcagcaaacaggaccagaaataaccaaaagaaggggggagccctaaaaataggcctacacttttgcttactcactatctagttatcctgagtacttttctaaattaatttcaaggaatatatctacaaaaaggtgtcttacagtttgcaagtcaggattattttttgcctaaaagtataaaagtttcactataaaattttcccttatacataagaaagtgttactattagttaactccaaggagaggaagtgagggtccaggataggaagtagatttttcagtgtata

SEQ ID NO: 236440 - DNA, 473 bp, Homo sapiens
cggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgc

SEQ ID NO: 236441 - DNA, 266 bp, Homo sapiens
agtagagatgacgttttgccatgttggccaggctgggccactgtattttaaaaagtaaagcctaacacgttttcttttcatcccagtggaaactatcttccgattcttcaagaaaactttactaccactggggattccaaggtagattcaaggtctatatattatttatttgcatcagttactggggaattatttgactgatcctcaaagccaaatcctgcccatgaagttaaaaagtgagataccaataaaagtacaaaacaggt

SEQ ID NO: 236442 - DNA, 423 bp, Homo sapiens
gaacagagtctgctttgtcaagttaggtaatcagactgactcaggaataaagcatggaagtaaagccactgtattgttttgttgtttttgtttttggtaaagtttctaaactggcttcaaaattagtaaatttcagaagaattcctggccgggctcagtggctcgcgcctgtaatcccagcacttcgggaggccgaggcaggcagatcacgaggtcaggagatcgagaccatcctggctaacacagtgaaaccccgtctctactaaaaatacaaaaaattagctgggcaaggtggcgggtgcctgtagtcccagctactcggcagactgaggcaggagaatggcgtgaaccccgggggcagagcctgcagtgagccgagatcacaccactgcactccagcctgggcgatagcgagactccgtc

SEQ ID NO: 236443 - DNA, 456 bp, Homo sapiens
tggagaacaaaggaggagaccattggccaaagagaggcatttccattttgttggaacctgctgaccaccaacccatagcattttttccctttcttccttgctaatccaatcgcagattcattgaggaggtgagaggtcctgagatccaggctggaagaggagtgattggtctacctggttctcaagggataatgttgccccctagaggacattttggaaattattaaggaaaattaacgactggttttttggttgtcatctggttctcaagggaacagtattgcttccttgggagaatttggaaacttaccttttttcatcgtcacaatggtgaagggtttgttactgggattagaggacaaggaccagacatgccaagatgttctacaatatagcattcctaattaataatcacctaatgaataaagctcagatagcacttaaaaagtggggaaa

SEQ ID NO: 236444 - DNA, 362 bp, Homo sapiens
caccttgacacatatttgcatatggtactaacaatggcaaagaagataaattacttaatgatattcagagtgaattatttaggaagagaataggatggaaaaggggataagatataaatactaaatcaagtagaaataggactttatgatcctttcaagagacttttcccaagtgagttatattttccaagttctgtgtaaaagatattcaggagtaatatgggagagaaggctaaatatattggctattgcactccaaagcagaaaatcctatgaaatatttaagtctgggagcactgaacaccagcagctaactttccaggaatcagaaacagattctttagaggattacttcctgtgca

SEQ ID NO: 236445 - DNA, 166 bp, Homo sapiens
tgttatgattctgtgaatatactaaaaaccacttaattttatacttgaaaaggatgaattttctggtttgtgaattagatctcaataaagctggtaataaaatcttcaaaactaactacctgggattatttctgctttttacaacttggctttaatttttcataaa

SEQ ID NO: 236446 - DNA, 1937 bp, Homo sapiens
agctgcagatgggacacagggcatcaagtccctagactgcacacagtgtgggaggccctgggcctggccaacaaaaccattgttttctcctgaccctttgggcctgtaatggttggggctgctgtgaagatctctcacatgcccttgagacattttctggggagaaattcaagctagctgcagaaattagcataagtaatgaggagctgaatgttaatccccaaaacaatggggaaaatgtctccagggcatgtcagaggtcttgacagcagcccttcccatcacaggcccagaggcctaggaggaaaagatgatttcatgggccaggccctgggctctcctgctctgtgcagactgcagacttggtatcctgcattccagaagctccagccatgcctaaaagaagccaaggtacagcttgggttttggcttcaaagggtggaagtccaaggtattggcagcttccatggggtgttgagcctgcaagggcacagaagtcaactattgaggttggggaacctccacctagatttcaaaagatgtatggaaatgccggatgaccaggcagaagtttgctgcattgggggcccctcatggagaacctctgctagggcagtgtggaagggaaatgtggggttggagcccccacacagagtccctactgtagcactgcctagtggagctgtgagaagagggccactgtcctccagacccctgaatggtagatccactgacagcttgcattgtgcacctgaaaaagctgcagacactcaatgccaacccatgagagcagctgggagggaggctataccctgcaaaaccacaggagcagactgcccaagactatgtgaacctgcctcttgcatcagtttgacctgaatgtaagacatggagtcaaaggtgatcattttggagctttaagagttgactgtcctgctggatttcatacttgcatgggccctgtaatccctttgttttggccaatgtctcccatttggaatggctgcatttaggcaatgtctctgtacctgcattgtatctaggaagtaactaattttctttttattttacagactcataggcagaagggacttgtctcagatgagactttggactgtggactttttgaattaatgctgaaatgagctgagactttgggggactgttgggaaggcatgattggttttgaaatgtgaagatgtgagatttgggaggagccaggggcagaattatatgatctgactctgtgtccccacccaaatctcatcttgtagctcccataatttccacttgttgtgggagagacccagtgggagatgattgaattatgtgggtgggtctttcttgtgctattctcatgatacttaatgggtctcatgagatctgatggttttaaaaatgggagttaccctgcaaaagctctctgcctcctgccatccatataagatgtgacttgctcctccttgccttccaccatgattgtgaggcttcctcatccatgttgaactgtgagttctccattaaccctcttttgtaaattgccaagtttttggtatgtctttatcagcaatgtgaaaatggactaatacagtcaggcatgatgtttcatacctgcagtcccagctatgtgaaagctaaggtggaagatttgctcaaaacctggccaggcactgtggctcacgcctgtaatcccagcactttgggaggccaaggcgggtggatcacaaggtcaggagttcaagatcagtctggccaacatagagaaaccccatctctactgaaaatacaaaaaattagccaggtgtggtggtgtgtgcctgtaatcccagctactcgagaggctaaggcaggagaattgtgtgaactcaggaggtggaggttgcagtgagctgagatggagccattgcactttagcccaggtgacagtgcaacactcc

SEQ ID NO: 236447 - DNA, 349 bp, Homo sapiens
agtggttccttcctttttattgttgaatagtatttctatggtgtggatgtactatggtttatttaatcatttacctgttgaagggcatttatttatatctataaatacagtccacttactgtatttcattatctctgagatggaaacttgaaataaaaataatttttattttccattcttgtttctgtttttctgtttttactccacccagcccccctaaagtttttaacatgattgcttttctgaaatcaggatggctcttagagtccacagtgtgctattcaggccatgacacaggtgaattacctgtgcaggtgtgaacaaccaaatgaccagtgaacacatgtaa

SEQ ID NO: 236448 - DNA, 512 bp, Homo sapiens
ctgcacctggccagttctcctattttaaatttatttttattttattgtggtaagaacacttgatgtgagatttaccattttaacaaagttttaagtgtacaatgcattgtccagtttctttttctcctacatgtaggatttgggtacttactgagtacactgtgcccaatgctaaattaagtgcttggatagagaaaggagatttgaaaagttagaaggcttgacttttaccttcgaaaacttcatatcgaagaaaggacaccatgaagatgtgacatactcagagaacaatcatcattccaatgaattgctggaagatcatttagaccataagaactggtcttcaaattgcacttggatataagccccgtggggcaggaagttttgttcattgctggattccccaatgcctagaacagtgccaggcatagttggcactcattccttcatatttattgaatcagccaataaagtagtgcagtgttgcttttgagggaaggaatatgaaggct

SEQ ID NO: 236449 - DNA, 502 bp, Homo sapiens
caagttttaataggatattgaacttggtgattcacaaactaaacttgattgggttttatccattgctaagattatattaccgtgaagtttttcaatctcagcacgcactgttgatattttgggctggattatattttgtcattgtaggggtgggggctgtcttgtgcattgaaagatactttgcagcatccttggcttctccccactaggtgccgatagcacccccttctcctagttgtgacaaccaaaaatgtctcagacatagtcagatgttcaatgggaggtaagatcatccccagttgataatcactggcagtgattctcacttcttagaacaaattaaaataatgtatagaattttcttaaattttgatttattcttctatacaaattaaaaaaccctttacatatacatatatacacacatatatatgtttaaaatactgtaaaagaacaagtagccaataaaatgagtaggagactgctagtccctgaaatgtac

SEQ ID NO: 236450 - DNA, 441 bp, Homo sapiens
gaggctatttcagtcgttttaaattaaagagaaaattatactgtattagttcattcttacattgctgtaaagaactacctgagactaggtaatttgtaaagataaaaggtttaattgactcacagttctgcaggctgtacaggaagcatgaatgggaggcctcaggaaacttacaatcatagcagaagtcatagaggaagtgagcacatcttcacatgtggaagtgtgagagagagagtgcaaaggggaaagtgcaacacactttcaaaaaccagatcttgtgagaactcactatcacaagaacagcaaggggaaaaccacccccacgatccagtcacctcccaccaggtccctcccctgacattgagtattatgattcaacatgagatttgggtggggacacagtgcgaaaccatatcattcacaaataacaatacatgg

SEQ ID NO: 236451 - DNA, 491 bp, Homo sapiens
tggcttcctagtcctgttctcttgggggaaacaagactcttatctgactttctctgacttctgtccctgcttgggcaactgaaaatgacaagtaggaaatactggcttgctttgagccccctttggttttgctgggaaggtggaaactttggcagacggggaaggacagatgggaaccccaggaggaagggccattgctctgatggtggagcgcttcctcttctgttcttttgtgtgttctaaaacgaggtatgtgccatgggagagttgatttcttttccagtgttgacactgagatgttctcgggctggaatcccctagccaccatgaccagggctgtagggggcgcaggtgcccaggttctctgtatggtgtcagcagcacctcccggccagcattgacccaggaattccacatcagctggtttagtgggggccgctccctggggctgagggtgaggaattgttttactagtgtctccagtggaaatg

SEQ ID NO: 236452 - DNA, 788 bp, Homo sapiens
taaatataattaaatcttgtgatcaaatatatgaataagtagagaaaagatagatctcctatttagagttccaaataatttaagtagtgggtttttatagtgactttttttccaaaaagtaccacatggaagggggagaagagtttctttacagtggagaaatatgacaaagacacctcagccatgtgaccaaaatcaacattattcaaaaagaaactgaatattaaaacaaacctttccttaatagtaaaaaaaaattaaaattaaaattaacatcatcagtgatgtcatgttgatggtatgcattcttggtaggatgaaaatggcacattacccctgtggtcttcctccacacaatccataacctccatctaaccatgagagaaaaaatcaaatgaatcctaattgaggaacattatccaaaatacatgaccattactcctgaaaactctcagggtcatcaaaaacaagtactgtctgagcgactgtcacagccgagaggagcttaaagaggcatgaagactagggccaggcacggtggctcacgtctgtaatcccagcactttgagaggctgaggcgggagtatcacctgaggtcaggagtttaagaccagcctggccaacatggtgaaacccggtctttactaaaaacacaaaaaaattagctgggcatggtggcagctacttgggaggctgaggcaggagaattgcttgaaccagggagacagaggttgcagaaagctgagatcacgccattgcactccagcctgagcagcgagagtgaaact

SEQ ID NO: 236453 - DNA, 343 bp, Homo sapiens
cggttttgcaggttatatggtcagtggcacaactattcagtttggccagtatagcaggaaagcagccacagacacatgtgaacaaatgtgcatggctgggaagtaggcagagggtcagatttggcccacagactatagttcaacagcccttaacttagaggaaaaggatttaaagccctgttatccaaatttctaagccatatggtcacttagattatctagttggtttttataaattattttcaaattgtaaaaggaaagaagaccagcaagccaagcaaaagtaatgtaaaaacaataaaagtttattgagccactgcacccagctgtagtagccatatta

SEQ ID NO: 236454 - DNA, 259 bp, Homo sapiens
ccccattcttggatctccccatcttcaggggcctcagaccctggtgagggcttctttgtatcacaccatcttgctacagatccctcagcagtgtgcgtgtgtgtgtgtgcgtgtgcacgtgtgtgcgcatgtgtgtgtgcatatcatttcttcaacactcataatcattttaagtgctttgtcttacaagcttctttcattttaattctcacaacaatcccatgaggtaactattattacctcctccgtaataatgaga

SEQ ID NO: 236455 - DNA, 621 bp, Homo sapiens
cattcttaataatttgatgggtattcatttcttccctaaatttatatgtctagaactagagctagagtgtatgcctacatacacacacacacacacccatacatatatattcaaacataatatatgtatatccacatgtattcaaacacagaattatgtttagataattatggttatatgctggtatgccagagccagactgcctggcttcggttccaggccctagttggatagctttgggctactcagcctctttatgcctggacttcttcatctttgaaatgggataataataatacttatcccataaagttattgtgagaattaaatgaaataatatatgaaaagcccttagaacaggcattgacacattgtgaaggtaatgtattagctattttgatgattatgcattttgtctgcaacttgatttttatttaacatatgtgggaaagtagacaaacatagccattttcaatgattccataatattccatagcacgagtataccattgtttatcgaaccatttctctcttgagaaacattgcagattttttttgcagtttctacgattacaaataatgctgcaataaacatctttctacatatagtctttataaatt

SEQ ID NO: 236456 - DNA, 471 bp, Homo sapiens
tctacataatttttatacatgtattatccctgaaaaactctacaaagataagcattcgtaagagaaggtatctcatgtgctcatatctaaaatattaaccttctgtctggagcttaatacccaaactgcagagtcaaccaggggaatcccagacttagcaagatacaagaatatttgttaggtaatatactaggattgaaggcctaaaattaagaatagcttcacaaatagaaagaaggggaaattgtaggttaagtaatccaacattattagggtatagttacagtttagagataaatgagagcatataaaacatttcatgaggcaacagcaatagctgtttagaatttgacaaatctagttagatttcccataccaatttcacttccatttattaatatgtgtcttcagtatattaaaaaaagacatttagtaatcagctttttagagacacatataaaattaaaatta

SEQ ID NO: 236457 - DNA, 687 bp, Homo sapiens
gtagagatgggggtttcatcctgttggtcaggctggtcttgaactcctgacctcaagtgatctgcctaccttggcctcccaaaaggctgagattacaggcatgagccactgcgccaggccttctttcttttctttttttctttctttttttttttgagacatcatttagctgtgctgaggggttcttaaataggcagctcagaaaattgttttcctttgtcagccacataaattcagcagaggctcttggagggtccctgctggtgaggggtgaggccagcagtggaactctgatttggtttttgctgagctggtggttgaaaggaatcctactacatcggggttataatagggaagatacattttagaatatgcccagtggagccatcggatgctgcatcgtccccagagagccaagtcatcgtgggccaagctcccatccccatgtctggcctcaactgcaggcccagatgttgacagctgcctctggagggttatgggagcctgtgaatgccaacatccccattgcctgcagcggctgctcccatcctggcttcctggtgggacttttccatgaattggggaatctgctttctgattccaaggcctattaaaatttctgagcattgcccatttcttttgctttatctgtaggacatgggctgtttttaaagaacctcacaaatg

SEQ ID NO: 236458 - DNA, 575 bp, Homo sapiens
tgtgtcattctggatgccatcaggagagagacatcacacagtcagcaggcagggaaagttcaacataagcattttgaagtgtaacagggaattgaagctgtgatgaactggctagtaagaagtaaataaataaataaataaacaaataaaaatctaaagaatataggactagcagagtcttcaggctgagatggagagcccaaggaagaggccctcacctctccactccattcctgtccagggctgagaaccacaccgtgcaggacaggacatggccacaatgaacagtgtacatttagaagtgagaggaaataaaggcaatcagcaataaccagttcgggttccatgcctctcatccaccctataatccaccctgtgcaaacaaactcatttttcaagactcagttcaaataccaccttttccacaaagacttttcctcttctgcgtctatccaggaaaaaactgattcctcttcctttgtgattgtagaatctgccccctccttgacacacatacctataacctcagtcatacttctactggggtacttgtttacccctacctagggttgcca

SEQ ID NO: 236459 - DNA, 266 bp, Homo sapiens
gtggttgtgatgatttgaaaactgtttcttaaccttgctacaccttggttggtactgtatttggaaacaatttattttcgccttgacaacaaaacttaccattatttttagagaaatttcatttgctagaaagcatcatttgtattattttatactcatgctgcctgggtatatggaatgaaattaaatgcctgatgtttgcattacatatttttactaaatgtgtctcacatgcaatagggtgaaatacagcttttattgcatta

SEQ ID NO: 236460 - DNA, 2874 bp, Homo sapiens
  misc_feature (1535)..(1535): n is a, c, g, or t
aaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacatttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtangtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattataactatgttcttc

SEQ ID NO: 236461 - DNA, 668 bp, Homo sapiens
aaaaaaaaaaaaaaggaaaaaaagaaacaggacggctgtgataaaaagttcctctttttacccgaacagttgagactggttagagccacgacaactgacaaaagcagccaaggaaaggaagacagcgggaagttcaccgcccatttccagaagacatgaatattcttcccctcgctgttcacctccagccccttcagtacagaaaccctacatttagcccctgcccgctcacctgttgagaagttgaactgtgggccaagctcctgcttctcagtccgtggtcactgaataaagtcggcttcggtttcatgtatcggcttcgtgacaccaaacagggaaggaccccatcttttgggcaaccggctttctcagtagcatgtggacaagtctgagagctaaggactcccgggaagacccactcacaggaggtctccatgctcttgtgaattttacttcctggaatgctgccaggttctcacagcgaaaatcagagccccctcagggctctagcagagacaggggagaagggaccattttgaaatacgccagagtgctctgccctctttaggttctcagcaaaccaacacaggaacaggaaaccaaacaccccattttctcactcataagtgggagttgacaatgaaagcacatggacacagggaggggaa

SEQ ID NO: 236462 - DNA, 514 bp, Homo sapiens
aaaaaaaaaaaaaaggaaaaaaagaaacaggacggctgtgataaaaagttcctctttttacccgaacagttgagactggttagagccacgacaactgacaaaagcagccaaggaaaggaagacagcgggaagttcaccgcccatttccagaagacatgaatattcttcccctcgctgttcacctccagccccttcagtacagaaaccctacatttagcccctgcccgctcacctgttgagaagttgaactgtgggccaagctcctgcttctcagtccgtggtcactgaataaagtcggcttcggtttcatgtatcggcttcgtgacaccaaacagggaaggaccccatcttttgggcaaccggctttctcagtagcatgtggacaagtctgagagctaaggactcccgggaagacccactcacaggaggtctccatgctcttgtgaattttacttcctggaatgctgccaggttctcacagcgtcagagcgccagagtgctctgccctctttgg

SEQ ID NO: 236463 - DNA, 614 bp, Homo sapiens
aaaaaaaaaaaaaaggaaaaaaagaaacaggacggctgtgataaaaagttcctctttttacccgaacagttgagactggttagagccacgacaactgacacatgaatattcttcccctcgctgttcacctccagccccttcagtacagaaaccctacatttagcccctgcccgctcacctgttgagaagttgaactgtgggccaagctcctgcttctcagtccgtggtcactgaataaagtcggcttcggtttcatgtatcggcttcgtgacaccaaacagggaaggaccccatcttttgggcaaccggctttctcagtagcatgtggacaagtctgagagctaaggactcccgggaagacccactcacaggaggtctccatgctcttgtgaattttacttcctggaatgctgccaggttctcacagcgaaaatcagagccccctcagggctctagcagagacaggggagaagggaccattttgaaatacgccagagtgctctgccctctttaggttctcagcaaaccaacacaggaacaggaaaccaaacaccccattttctcactcataagtgggagttgacaatgaaagcacatggacacagggaggggaa

SEQ ID NO: 236464 - DNA, 177 bp, Homo sapiens
gtatgctaaactttattttgaagtgtagacattggggaacgcaacaaaaattgaagaaattaaggaatgcaacgaactatggtaaaaactgtaaaagaatggttactgttgctcagtttagtgtgagcttcaagctgtggattcactaagttgggagtggaggggcccaccaaggat

SEQ ID NO: 236465 - DNA, 470 bp, Homo sapiens
tgatccatattttcttctttctcgccttagttttatgcccataagctcccacatacaaaggatgggtatcttgctttgactagtgccatgtagtaattggggcttttgttctggtggctgccatacttattggtaagaggaaatatgactaaggtggaattagggtatgattagaacaacactataatgagatgtataatctgctcagtgattgctaacttgcttattctctgacatttttggcatatggctacatagaggatctcgcctgttgaataatacaattctccactcaggtctcacatcctgtccttctttgacttcatagcacctctacacatctgctttttccttttgtcttagaaactgtgctgtgttaatgcaatggaaatttcatttatcatcacaagtgaaaatatatggctatgtagattcatggaaatatttacatgaaataatttaagtgataa

SEQ ID NO: 236466 - DNA, 519 bp, Homo sapiens
atgctatttttgttaagtaagacctatggctttcaagtccaaataaatatacttgtgaagaaaaaagtatctaatgagggattaagtaaatgcggaacttaaaatgaagtttcagtggggcctcactttgctttctgaaatgaaactatttaatttcccataacatggtttatgatataaaaataaggttctggtattatagtagagaaggactgtccataccttatggatgctttactgttgggatttaagtttagctggtgatttctcactgccttttcacttgatgtcctcccctggggaaggccactgctgctttgtaccctgctctgtacagcagggctataaatccctcatacaaatttcccaacgtggcagggcactttcagttgttatttagtggatactgagtgtggcttggaagcaggaaagagaagttacagcctcttccagcccaacaatgtcttcttctttttcttcttttttttttttgagatggagtctcgctctatcacccag

SEQ ID NO: 236467 - DNA, 637 bp, Homo sapiens
gtggcttgtgtctgtaatcccagctacttgggaggctaagtcaggaggactgcttgaggccagtagttcgagaccagactgggcaacataataagactgcatctctaaaaaaattttaaaaattagctgagcgtgggtaatgtgcacgtagtcccagctgcttgggaggttgaggctgaaggattgcttgagcctaggagtttgaggctacagtgaggtgtgatcatgccactgcactccagcctggatgacaaagggagaccctgtctcttaaaagaattttcttattataatagatacatttatctctgatttactcagtactataaccccatttaagtagtttgaagagattagggttaagtcctactgtttttagtatgactacagtagttgccactttaaacaatttttgaaatactttaggcataaaaaaggatatagaacaatataataaattccatatacctactacctaaagtaataaaaatcacagttattgttgaagcttattgggcaccccttccccatcctagtcctctcccttcccagctgtgaccattattctcaatttgatatttattctctccctgcatttttacaaactttttctgtatatatatatgtatccactgaa

SEQ ID NO: 236468 - DNA, 324 bp, Homo sapiens
atgcttgtcactggatttagggttcaccttgataactcagattgttatacataagatttttttactcaattacatctgcaaagacccttttttccaaataagataacattcacaaactccagggattagggtgtgggcatatctttctgggacccactattcaactgaccacaccaccttaaccaagtcatcaaaattaacatcctcactcatcagacacattgacgttatgaatccactgaagtaatgcactgataaggacaatgtcatttctgtgggtttcttgccaaaaatgtataaccattctaatcatgaaaaaatatg

SEQ ID NO: 236469 - DNA, 447 bp, Homo sapiens
acctcctgggagttgttcctgggtcagaggggcttactgtctacccaggagccttgggcaccctgccctctgcatctgtcaccacccagagctccttcctggtcagcaacacccttaggcgtgagagccctcacacgagctgcagacaaggcgagtcccttctggcagagctatggagttcttcctttttgcagcctaccgctcctgggcaagagctccgtgtcaggacaccagagatggggcaggagcagcttcagcttctcaggtgacatctctctctactagcaggagaggggcgtgcctttagttgtcttggctcattgaaacctgtgccagcatttttttattaagctccaaaaatatgcattaatgagatataaagtgctaccatggagaatgtcccaggtacagtgggaaaagcagtcgtctgccgtataccaacataca

SEQ ID NO: 236470 - DNA, 417 bp, Homo sapiens
taacatataaacatatttttagctgttgtttttaagtaatgtttaagcagttgttttaaagtaatcaattactgaaattattgatttatttggattcattaatatcattttttaaaaatctctttgggccgggtgcggtggctcacacctgtaatcccagcactttgggaggccgaggcaggcggatcacgaggtcaggggatcaagaccatcctggccaacatgaggaaactctgttcctattaaaaatacaaaaattacctgggcatggtggcgcatgactgtaatcccagctactcgggaggctgaggcaggagaatcacttgaaccagggagttggaggttgcgatgagctgagatcgcgccaccgtactccagcctgggtgacagagccaggctctgtctcaaaacaaaaaa

SEQ ID NO: 236471 - DNA, 1728 bp, Homo sapiens
gaaaatatgtactaattaaaagagggaaaagagtaactttacagtggatgaagcctggcaatcatcactttaagcaagtggtcagagttaatattatcagtaatggtcaaatcaaaaccatatgcaagaagactctaaaatgcaagaagactcctgaagtacttcttaccaaagatgtagaacttaaattcagtcataacaatacatgagacaaacccaagttagagcacagtctgcaaaataactggcctgtaatcttcaaatgcatcaagatcatgaaagacaaggaaagagtgaagagctgctccagttggaagagacttaaaactaaatgcaatgtatgatcctagattggatctttttgctctaaggacattaatgggccagttagtgatatttgaaggggatccgagggttccattgtagtaatatatcagtgttaatttttaaatttttattaggttgggattattttggaaaataccattattcatagcgaatacaaagtagaatatttggggatgataatgcatgattacaacaaatgtttcaggagaaatatgatctttgtagtggtcttgcaacttttctgtaagtctgaaattgtttatgcataaaaggttaaaaaaaggttaaattttgtttttataactaataatggattagggtcatgtgaaagtactttagaggaaatgagacttttgagaacatcatccctgaagacgttgaaacactgagttacctcatggataatttaatagggtatgcagctgatttttctaccttaatttcttgtttgcagtatctacccatacttagaattgtctggtgttaaaatatgcccactgggactttcatgaaattcttttgattttctagaaaattcagtttcaaaggattttttaaatagatattttaagtttggtgtcaacttagataaaatctgtttggagtcccagtgtaagttttagtaatgtgtccaatctgtttattgaaatagtataactttagaatactttctttggagagatgaagattggtatgttatagttcaattcaaagttgttctttctattatgatctattttataattcataaaatctatcttatgattgtcatcataagtgcaatttgttttttgccccattctacctcagaaactaagtatctgggcatcaataacaattggtagtagtgtttgctgctaagccaagtttcaccagtacagtgtggaattattttattgttttttctgtgaacattgtatctgctgttactaggttattgtgaggtattgggccttcatagaaattgcctggaacccttgttcactaaagcctgttacactttttattctctgtgcgtgtaatcagagacttattgatactgacacattcaaggggcattattgatcatttagattgctctaagacctaaggagtcttggccggatgcggtgcctcacgcctgtaatcccagcactatgggaggccgaggcgggtggatcacctgaggtcaggagttcgagatcagcctggccaacatggtgaaaccccgtctctactaaaaatgcgaaaattagctgggcatggtggcgggcgcctgtgattccagctactcgggaggctgagacaggagaatcgcctgaacccgggaggcagaggttgcagtgagccaagactgtgccattgcattccggcctgggtaacagagcgagactccatctc

SEQ ID NO: 236472 - DNA, 409 bp, Homo sapiens
gagacactgttgatattgtaactaaattctattgtgtcctattcaacatgaacttagacttatcgttatcacttatacattttatttgtatctattaagttaagaatttttgtttaatcctcttaaaaatctttgggtgatgaaaatgtcctggaattaggtagtggtgatagttcataaccttatgaaatactaaaaaccactgaattgtacactttaagaaaaatcttttcttctttaagtttatagaaaaaaaggctttaaaaaatagttgtagtaaaatataaagaccacaaagaagcccaaaaatgctgaactaatcttaaaaaagatggtttcacataatatgaaataaagtaatagctacacttattttcttttccttgacagtgatacttatgattgaacc

SEQ ID NO: 236473 - DNA, 515 bp, Homo sapiens
tgccgcactgtataaatatgccctgaaagtgaccttgtgtgatttctgagactaagactataagaagcgttgctgctttcacttaggccttttggaaagttctctactgacatgcccactctgtgggaagccacttgtcatgaagaagtcatactaccttaagaccacaatgtgttgaaagtgagtctagccaactctcatctgttccagccatcccagcccagggaataaatatgtgagtaaaggagctagctccacaggagacaccatgtggacaaaaacagaggctccatacatagggctttatttaagttgtcccaattgtcttcagccatttgaatcaccccagctgtgactatagacaacatggagcagagctgaggtatccctgctggatcctgcctgaattcctaacccacagaatcacaagcttgataagtgcttagttttgttttgtttttgagacagagtttcactcttgttgccattgcactctgaccctgtctcttaaaaaa

SEQ ID NO: 236474 - DNA, 2348 bp, Homo sapiens
taatagcaacttatattattttactatttacagagagtgtccacatatgttaacttccttgatcctcacaaacaccctatcccttgggtattttctaccagccccatgaggctcagagagatttacatgactttttgagggtttgaacccaactctttggtctcaaaaacatctcattccagtacacctcattgcctcccaagccctgtatccaggaagacctgactcaccagcatgctttctgtgcgaaaggacaccagagctgagaagtaaatcgacaccacccccaatccctgcaacttcctcttctctgtcctgtcattgagaacaccagcctaagggcacgtttttctccttccacgttctattaaagctcagtagtctaactcctactattgaaaatgagagaaacaggaaggaaagtctcaaattccaactttggaaaccacgttgaaagaaggtgctctcatctggacatgatggttcacgcctgtaatcccagcactttgggaggccgaggctggcagatcacgaggtcaagagattgagaccatcctggctaacatggtgaaaccttgtctctactaaaaatacaaaaattagccaggtgtggtggcacgtgcctgtagacccagctacttgggagtctgaggcaggagaattgcttgaatccaggaggcagatgttgcagtgagccaacatcatgccactacacgccagcctggcaacagagcaagactctgtctcaaaaaaaaaaaaaaaaaaaaaaaagaagaagaagaaggtgctctctcatcattcttctgtacattcatttgttcattagacagatatgtatagagaatctgctgtgtcccaagcactgttctaggtgctgcggttatagtggtagacagaaaggtaaagttcctgccctctcgaagctcacatcctactttcagggggtaatgagcaagtagatgatgaacaaatgttttatatagttctagggctataaggagtgtagagaaggctgatgagatgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagttctgagttctaggcagtggactcacagttgaacttggagggaaccaagaattgcttccatcatagccttactaagaaatgaccatggcatggcctgagtgcttcggcatggaggaccagaaggggaagccctaatttgccagttgcagactcttgagccttgtgactctaatgacgacaaaaattaggagattttctaggactccacgtttgcgattttgagagtagtgctgctggggttcctggtttgggttctattgattgtttcattgtttctgtgtgcaagttaccctctctaagcttagtttaattaatattatattaagtgaggtagttagattatatgaaccctaaggctccttttattcttaaccttaaaataaaaacattttgtaaacagtttttctttgtgtgtgtggtggccttttctgtgcctctgctttggatgaggttacagggctgagtgcgagtgagtcattagtggttcctttgatataagacaggtgatactattgaacactgttggtggtagaccagtggttctcaaagtgtggtctctggaccagcaatagctgggcttgggaacttgttagaaactctagctgtcagcctccaccccagacctactgattaaaaaaccgtaggagtgtaaccaaaactctgtgttttaacaaagtctacaaatgattctgatgcatgctaaagtttaggaaccactagagtagagtatgtgctttaagatttgggtctaccggccaggcgtggtgtctcatgcctgtaatcccagcactttaggaggccaaggtgggtggatcccaaggtcaggagtttgagaccagcctggccaacatggtgaaaccccatgtctactaaaaatacaaaaattagctgggcatggtggtacatgcctgtagtcccagatactcgggagggtgaggcaggagaattgcttgaacccaggaggcagaggttgcagtgagccgagattgcgccattgcactccagcctgggcgacagggcaagacttgg

SEQ ID NO: 236475 - DNA, 290 bp, Homo sapiens
tgtcctcagactctcatttgtggaatgagaaccaccctccccaggtagtcatgcaggataaaggaggtcaaatgggaattcccacctccaggaaaccacctggttttattcccctgggtctgtctgaatgccgagccctagggaatgagctgacctttgccctttttgtttggcacccacctagggacaatactctgaatcctggcaataaccttgcaagacaggtgtatccagctcctgtttcagttgagcacactggggctggagcagggtggcagtttgctcagagt

SEQ ID NO: 236476 - DNA, 463 bp, Homo sapiens
tactgtgccaggcattccctccaagcattgatgaagaggggctactattaccccattttgcagataaggaaactgaggctctgagaggtgaagtaacctacctcaaacccccagctgaggatttgaacccagagaggcttcagctccaatgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatgcctcccttgcctgtgggtccctgtgccaacctagggaccatcctcagagcccccacacctgctgctcacagccagaatgtaggacccgcttagctgctctcagaagagtcctgttcagcaagccgtttaaactcactcctcccatccc

SEQ ID NO: 236477 - DNA, 319 bp, Homo sapiens
tttgtcacccaggctggagtgcagtggcacaatcacagctcactgcagcctcaacttcctatgcttaagagatccttccacctcagcctcccaagtagctgggattactggggtgcaccaccatgcctggctaatttttttatttttagtagagatgaggtcttgctacgttggccaggctggtctcaaattcctgggatcaggggatcctcccacctcaacctcccaaagtgctgggattacaggtatgagccactgtatctggcctgctcttaaaacttattcaacactgtactgaaggttttagtgagtacaataa

SEQ ID NO: 236478 - DNA, 414 bp, Homo sapiens
ctgggactgcaggcgtgtgccaccgtgcccagttaatttttgtattttttggtagacatggggttttaccatgttggccaggttggtcttgagctcctgacctcaagtaatctgcccaccttggcctcccaaagtgctgggatcttacaggcctgagccactgtgccaagcctctattttcatattatattctgaatccaaacacattttataaatttcactgctaccattctagttgaggctaccattatctttgcctggattattgtaatagtctcctaattgatctcccttcttgccatatccccctgccatagggggtatgttgtttacatagcagccagagtaggctgggtgtgtctatgttctactttctttgaattgaattcacttttgagtgtacactctcaggag

SEQ ID NO: 236479 - DNA, 449 bp, Homo sapiens
ttgacttttgatataacttctttagtcattatccacatgccataactcatctttttgaactgtcaacacaaaaaattatctatgatcaataatgtatatatcaatacacaacatatattcctgttattttttcttcatataaattttcactagccaaatttagtaccataacaggctctccctcaagatttttcaaacaggtaaaatgcactacaaaaaacaagggtcatggtacagcttttgttttttcaaaaagtatacgcttcctctgtattaacagatttatgaatgcctgacccttctttcctcaatctctttagactgtcatgaagctaagatggtgtaacatctgttttttggtcaacagaacaaagaaatgaattttcaaaaacattacactgcctactactccatcccaaacaggcgtattctttactctgacttgtaca

SEQ ID NO: 236480 - DNA, 208 bp, Homo sapiens
gaaaatgctctatagtattttcctcaaccattgttttaaaagcttaattggattatttgggtataggccacaatctggttaccctattgattcagggaatgttaaacctctgattcagaaatcagaaacttgttttaattctccccctttggttcctttccaatttctctgtatcttttaacccctattgccactgccttgacttagg

SEQ ID NO: 236481 - DNA, 1251 bp, Homo sapiens
agccaagtccttctggctgcagttaaaagggctcaccagcctctccctgaagtcttggcccgggagcctgtgtcctccaggtagctgtgctgtggggagctggagaggactgaagagctgaggaggcgaaatgcagaaatgataatgcctcacaagctggttgtacagattgaataacaatgtgaacagagcaccgagtataatccctgaaacagcaaaccagaggtcccgtctggctggcatgaatggaagggcaaacgctccgaccaaattgctctgggaatgtcattctaattattggatcctgacccagcagcatgctgataagctctgggttggagacgccctatctcagaggagctccaaacctgctcaaggccttttcttgccctctgcaactttcctgccaagcaattagcctccagggaagaagaggaaattggaacacggacacgcacagaggaaagaccaagtgaagatacagtgagaagatggccaacgacaagccgaggaacagggtctcagaggaccccaaccctgctgacaccttgatctcgggctttcagcttccagcactgtggcaaaattcatttctactgtttaggcctcccggtctgtgacatgttgtcacggtggccactgaagactcagacagcttccttctagctctggttcttctacgggtgtgctttcaggtgctccggagggcccggtggcagggaaagccaggtctccaggctcctggcccagggcgtgtttaggaggcagggccttctctgacacaagtatgaggagcagagaggtttctcttcttcagtctccactaggtcctggcctccatggcttctataggcagggacctggccagggcattcaccagagactttgacagggagtccaggcccagaccccataggcagagccaggagccctgtgccagcttcccagggagcaccggggcccaacgtagagtcaagagctggcatcagcacaggtgcaaggtggggttgggaagggcatggcagcttgggggtctgcagtgcacaggtggcctggcatgaggtaggtgggccggcttgaaggtctagaagatggatagacaccagagacttgtagtctatgtctccttcttgctgtcccctggatgtcacctcccctctgcccccagtgctgaactaacccccttcatcttttacttgggactccatcagtgactcatcattgcttttggtgtgacttaccagcggccgc

SEQ ID NO: 236482 - DNA, 772 bp, Homo sapiens
agccaagtccttctggctgcagttaaaagggctcaccagcctctccctgaagtcttggcccgggagcctgtgtcctccaggtagctgtgctgtggggagctggagaggactgaagagctgaggaggcgaaatgcagaaatgataatgcctcacaagctggttgtacagattgaataacaatgtgaacagagcaccgagtataatccctgaaacagcaaaccagaggtcccgtctggctggcatgaatggaagggcaaacgctccgaccaaattgctctgggaatgtcattctaattattggatcctgacccagcagcatgctgataagctctgggttggagacgccctatctcagaggagctccaaacctgctcaaggccttttcttgccctctgcaactttcctgccaagcaattagcctccaggggtatctgagagcgggagactgggaggagcggggtccctcggggttgaagtggggagggctaacgggctggggatgccccctgttgtgtttccagggaaagcctgtccagattgccgttgccttctttaccttcagtgtcagagttggggtccagcctgtattgtggggagtaggaaaagcttttcttgttgagccctgggcttctgttaggggttgaattatgtccctccccacactccacattcatatgttgaagccctaacccctagttcctcagaatgtcactgtatttggagatacagtctttaaagaggtcattacattaaaatgaggtcactggggtgg

SEQ ID NO: 236483 - DNA, 801 bp, Homo sapiens
agtgtgtaggctacttcctgaagttcttagtgagttcctatgagaaaaagacaagcttctatcatctgaaagttaaaaaaaaagaaaaatgtgtctttgataaaagaagtcctttctcttttggtaactgagagccagacaacactgtactttgcagggttggaaaaaatgagttctctgttacatgatgaaactcattccagcaaagacagagacactggaaacagaatagaagatactactaaaattgggaaggagctggagtctgattttgactcctccaggacagatgacaaccatcctcggggttatcaaaagttgtcactgcagagtgaaagcccaagccacaggtgggagaaggtattgcagcgtgtctaactggtaaagtgctcctatctggaatacacaaacaactccagcaaataaatcagtaaatcacaaaaggacagtcagttcaatagaatagtgagaggaagagattgacagggcatttcacaacagatgacaatgaacaggaaaagtgctcagcctcacctgtcatcagggacatgcctggaaacagcaaggagatcccactatacattctaggagaacagctaaaacctaaaaaaacaactgatcatatcagtgttaatgaatatgtggaactgttggaaccctcatcctctgctggtgggagtataaagaggcccacatactttggaaaacagtgtggcattatctattaaaggcaaatgtatgcatatcttactacaaagcaattccactcctaggtctatgtgtgcgtatgtgtaagaaaaa

SEQ ID NO: 236484 - DNA, 423 bp, Homo sapiens
tcatttttctctctcttaggatgctgatattgagtgttatctatgtgccaagcaccattgtagaatctgagatagcagggagcaaagatccctgccttccaatgggaggagataaaaaaacaagtcaaatatgtgttatgatacataggtgataagtgctatagagataataaagcagataaaggataacaaatcagggcaggggcagggatggaggttttaaatagggtggtacaagaaagtcatcactgaaaacccactggagggattggagcagacaagtgatatgacctgactcacttttaaaaggttcactcttgctgttgggagactatattatagattttgagggacaagaaaaagaaagaaggcctattagagaactattgcagtaatccagatggcctcgtgcataattaaaag

SEQ ID NO: 236485 - DNA, 392 bp, Homo sapiens
tgccacagatcacatagttattaatagaataataaggaaatattgtgcataacattatgccaataaattcaacaacttagataaattggacacatttcttgaaaaatacaacatgtaaaaatctgacacaagaagaaacagaaaatctgaatagccctgtctctgttaaagaaatagaacagggaaaactctgtagtgatagaaactaggtcagtggttgcctatgtagaatgtcaactgaaagagaacatgagagaactcttgggaggatacttgagccttgaagtaaaggctgcagtgagctctgattgtaccactgtgctccagcccgtgctggacagagtgagaccctatctctaaaataaaagataataataattagagtctcagta

SEQ ID NO: 236486 - DNA, 390 bp, Homo sapiens
atgtaactaacactgacggaggtttactgcatgctgcgcacatagctgagtgcctcgcatttactgatgattatgatatgtaaagcgtctggccttaagtccatttttgtcatgattccaaaagcggccgggcatggtggctgacacctgtaatcccagcactttgggaggccgaggcgggcagatcatgaggtcaggagattgagaccatcctggctaatgtgatgaaaccccgtctctactaaaaaaatacaaaaaaattagccagacgtggtggcgggcgcctgtagtcccagctactcgggaggctgaggcagaagaatggtgtgaacccgagaggcggaggctgccgtgagccaagatcgtgccactgcactccagcctgggcag

SEQ ID NO: 236487 - DNA, 422 bp, Homo sapiens
gcacccaggagccggtcaggctgacctgcattacaaatcagcagccagtcctctctcacccagattagcttattggcattcagggcctagaagtccaagggcctgacccagcagtggcccagagaggtctctcacctgctctgtgggcacgatgacctcacttaagctaacacatgtgcataaattaccatagtattatgtcccccagatgggctgcatcccttcacctgttcaacaacccctcttctgaagatgctccgggtcccattacaaatgcctggaaacagcagcaacaaaacacaaaaacctctgccctcatggggcttatattctagtggaggaagagagatgttaaacaataaacacatttcagttagttaggaaacaagtataaacaataaacatacttcagtaacaacata

SEQ ID NO: 236488 - DNA, 646 bp, Homo sapiens
acaataaaaatattgtttcctaggtgctcggtaaagagagctagtgagttagtgatctctgttgtgagcttgtgatctctagtgcttaatgtgttatattttttttagtcctcatgcttccttttattgttaattgcatttttatgtatttgtcatgtatttaatgtcgtagtcacttagcagcaaaaccacgcaattcaacattaggcaaatttataaatattgttttgtatgtaatgtattagtgttgtattatgtttgtctgctacatggtagcaagtttaatatgaaatatctcacatttggacttaacatgtaatacgaaagtttatgaaagctttgacaactttcagcttatttattcttatttttttagaggcaggttcttgctctatcgcccaggctggagggcaatggtgcagtcatagatcactgcagcctggaactcctgggctcaagtgattttccacttcacccttccaagtagctaggactacagtcacatgccaccacaccccactaatttttaacaaaaatttttttgtagaggtgaagtcttaactaggttacccaggctggtcttgaactcctggcctcaagcaattctcccaccttggcctatcaaagcgctgggatcacaggcacc

SEQ ID NO: 236489 - DNA, 202 bp, Homo sapiens
ccagaaatgttaagtaacccatccaaggtcatacagctagtaagtgacagacccaggcagtcaggcgttggagtctgcacatctaaccgctgggctgtgatgttcacatgaatgcagggacagcatttaataaacacttccagaatgagatgtgaattttattttaagcacattcagatatccagtgtgactccgggatgta

SEQ ID NO: 236490 - DNA, 672 bp, Homo sapiens
aaactgtaacaaaattattttttattatggtttattaaatacacctgcatctgtaatattctagaaagtattatggaaaatttttacctttaatctctacgatattaaatgccaggtgtcatttagatacataatccagtatatatgcaaaatgtttcagaatgctttcagagctgctgggtgcaaacaatgcaaattaaaatggtgcaaactatacaaaaataaggaggattcaagcctaaaaagtaaaaaaagcaatccacaaggtgggggtgaataagccacagtttcctggaggtaatacattctgaactatacattggagggggatccatgagtgggcaagcagaaggagaggagcattccagtaaggggcagtttagcctagcctgaaagcctgtcaccaaccagaactagaatggaaaataccagtgtttttctatactattagctattggacctggtcttttggtttttgtttaaatctttttttcagatgagatgggtaatgtgcagacgtcgtaagaaggttcgagtgtggcacatctcacgcttgtgtgtgaacacacaatcatcatgctcatgaactactttgtatagcatgttagcatctacaaggcacttttgatttaatttgactcgattaaataggccacggtgaccttgtctatt

SEQ ID NO: 236491 - DNA, 525 bp, Homo sapiens
ttacatgagtacaatttagtatgttttgctattttctttgttatttaatattttctaatacctttagtttttgagatcaatacactcctcaatatattagttttcagccattcattttcacaaatttgtttatggatgtaaattttcctctaaacacttgatttgtagcattgtataggtattgatataacattttttcattatctttcaattaatatattgtctaattctaattgttattgattctttagaccatggattatttataaatgtgttgttaactttcctaataattacggatttcttgttattttcttacccatttctatgtgctttcaggagtagagacagacaattatctgtaagctttttattctttgaaatttgatgagattagatttaggttctagaacctatatatgttctaggattatttggagatatgtttcacatgaatatgaaaagaaattgctatgcacagtgttttataaatggcaattcaataaaaacttttactttttaaaa

SEQ ID NO: 236492 - DNA, 537 bp, Homo sapiens
agatctgcatggcatcggagatctactgccatatgcaaagatgtgagctatcaggtgacctcagggaacagtggcaaatgatagaagggtctaagactgagacgtgggccctagggttcaggcatagaccttcaattgtaaaagtatttgaagttacctgatagagaaacaagaaagtgaattaggctgcttgagagtgagtggagtggctcagaatttaatgattaagaaacagacttgggccgggcatggtggctcacgcctgtaatcccagcactttgggaggccgaggcaggcagatcacctgaggtcgggagttcgagtccagcctgaccaacatggagaaaccccttctctactaaaaatacaaaattagctgggcgtggtggtacaagcctgtaatcccagctacttggacggctgaagcacgagaatcgcttgaacctgggaggcggaagttgcagtaagccgagatcatgccatcgcactccagcctgggtgacaaagagcgaaactccgtctcagaaacagaaagaa

SEQ ID NO: 236493 - DNA, 575 bp, Homo sapiens
aaggttttgctttgggcttctgccagttgtgtctgcctggcccagccttctgtacagttgactaccctggccctatccctgctgcattattcagggcattcaggcagaagaaggccagagaagaaagaaactaggtcaagcatccttattccgagtgtctcacctgaatcgcctgcccagcctctgtggaggcagagcaattagagcatttaccccatgtgggtaaatgggctaaaaagccactgccattagtagggacggtcagggttacagtaggcagactcaattcaagggacatcctctcttccttcaggttggaaggaaaagttgtggactccttctttgtgaaaatcaagggagaaatcatcttctctggtcaacatctcttggaatctgtgcttggtcagtggaattgaatgtgaacataggagccaccctgtcaccagaaggaccatccaggaccctaccctgcatttacttcaggaatcaagaatcactgtatattctgaaaggttctgtggcttccttaatgccaatggtaatataactagaaatgctgcccccagaatattgtt

SEQ ID NO: 236494 - DNA, 393 bp, Homo sapiens
ttaatgtcctggtcctgttgcttagacagagttattagcaaagagaaaaatattcagttgccagtgatgctgtcagataatgttggggttcaggagatttttaacagagttcaagtgtactctttaaataccagtgaaaattatgctggaatgggaccagccatcctgttttttcaaaacttctataacaatttgggttgttagaagaagaaatagtaatttagctgtatgttaaatatgatttcacatatgattaactgtcataaacctatagatacatagaatgttaaggttggaagaagaaagcttagagttcgtttgctgttgtcacctaattttttaaaaaaagacattgaggtggaggtggggcagtgcaaaaaataaaaattaatt

SEQ ID NO: 236495 - DNA, 574 bp, Homo sapiens
catgagccactgtgcccagcccacagttcctacttctcttctccttccactggtcccgttggagtcatagtgcattgagaattagaattagcatacccaattcttaatgccagagctttttctttcctgtttagagattatcagtgctttaggatgaggggggaggtaggtggcaatatcacagtcaatggaaaagagcatttctgtacacacaccacaatcaccccagattctgatgtccgtgggtgtgtatatggagaggggtaatctgcattttgaagaatctctcttggccaggcgcagtggctcacgcctgtaatcctagcactttaggaggccgaggcaagcagatcacctgaggccaggagtttgagactaacctggccaacatggtgaaacccgggctctattaaaaatacaaaaattagctgggtgtggtggcgtgtgcctgtaatcccagctactcgggaggctgaggcaggagaatcgcttgaacctaggaggcgaaggttgtggtgagccaagattgggccactgcactccagcctgggtgacagagtgagactctgtctca

SEQ ID NO: 236496 - DNA, 407 bp, Homo sapiens
atttttggtcaaggttgtaagaaacttgtataaattattctttacctgtttagtagaagtagccagtgaagtcatttggggttatgcttttcttgtggtagttttatgattaataattgatatggtttggctctgtgtccccccccaaatctcaccttaaattgtaataatccccaagtgttaagggcaggaccaggtggagatcattgaatcacagggtagttgcttccatgctgttctcatgacagtgagtgagttctcataagatctgatggtttcataaggggcttccccatttgctctgctctcattctctctcccgccttatgccgtgattgtaagtttcctgaggcctccccagccatgcagaactctgagtcaattaaacctcttttctttacaaatta

SEQ ID NO: 236497 - DNA, 2241 bp, Homo sapiens
  misc_feature (880)..(880): n is a, c, g, or t
  misc_feature (1177)..(1177): n is a, c, g, or t
  misc_feature (1571)..(1571): n is a, c, g, or t
  misc_feature (2106)..(2106): n is a, c, g, or t
tctctaccaaaaaatgtaaaaaattagcctggtgtgtggcacacacctgtaatcccagctactcaggaggtggaagttacaatgagctgagatcgtgccactgcactccaacctgggtgacagagggagcctctgtctcaaaaaaaaaaaaaaaaaggactgagaaaagaaaggatgaaatgggtagaggtatggaaaacctttgatgtctggatggctgtggagttatccatgatatgaaatagcagctgagctgttgcctgttatgaaaggtaaaagttacctgtcgaatttcaaatgatagatccaactccaggagaactgactcactagatcacctggctacttttggccatgctggttacagtgaggagaaaaaagaagtgtagcccaggtaataccttcagtttttgttctctcctcccggaagaaagaaaaaaggcccaaaaattcccaaagatgagctttggttgggccaaaaatgttaaacatttatggcactctttcctcacaagtaggaggaaaaaaggttgaatcagttctcagggctggagcaaagtaaaaaagggcagaggacatccttcagttgttagcctacctgcacgccctcaaccccattccagatagggtctcctccgcaactgtaatattaaaccttttgctaaatttactgcaaggggtcgaatacatctgcagtgaggaaggtgccgggccagggtggggtagcgggggcagttaatggccttgtattttgcagttattacatctatggatatacgatagaagttgatgtaaaatgttttatgcttgtaatgtcgcagatgcgagggggattagctcagtaaggcaatgctgcaaagaagttgttagtgggacgcancttccttgctttttgctgctgtaggatagacggaaatttaaatcgtttgttgaaagcaaaatatgtctcacagccgatgatatttactatgatttttgcccattggagcctctggaaaaaggaagacatacacttctaaacatttttaaagcagtttttaattgcaagtgagctcatataaaatcagatgtctgaccctagaggctggtgattttctagcctgatgtgcataattttgagtgggtcttagaaagcacttaggaaagctttgctttttgcttggccttggaaacatgnctggcccttcagcatctcagctttactgctgccaaagaaaagtctctggcatattttggaatcctgaattcatagatcctagttgcttggacttgacgcttgagctaaaacttgacattgcctcctacacactatttcagtctcagcacaagctgtgttaaactgaaagagatacaggctcagggaagacgacttctatttggggatcaaggcagattcaggatacccctctgtggggctcttcactataaaaaatggatgttgatggaactacgtggattatcacaggtgtccatgggaaccggcttctctggtgggaccatacgaagtcgaactgctgatctgttctgtatttctgatacagggactgattacattcctaacttgtgattantgacaaaagctacatgttgaggggaaagcatatcactaggactgtgacccctgtgcctacccatcttactctctacctcttaggaaagtttcactgtgtttacttgggacttctggactagctgccgtttgcaacagtggacttaccagtttgccactactctgctacctttctactggtgcacacaccttagtaaggcagtttgattactaaatgcagctgtctccagaaatggaatgatgctataggccacttactaaatgaatgatcaggaggaaagcagtgagtggctctctaaaaccattttgaaatattttgaaaattcaggatttaattctgaccagttctgaaaatggcatgtctttctggttacattatataaaaatattttctggccaggtgcggtggctcatgcctgtaatcccaacgctttaggaggcccaggcaggcagatcacgaggtcaagagatcgagaccatcctggccaacaggatgtacaacaggatgtactaaaaatacagaaattagccgggcntggtggcgcggacctgtagtcccagctactcgggaggctgaggcaggagaattccttgaatacaggagggggaggttgcagggagccgagattgtgccactgcactccagcctagcaacagagtgagactgtctc

SEQ ID NO: 236498 - DNA, 1951 bp, Homo sapiens
tattatagaccataatatgcctgtcataagcagactgtttttgttgactttcttgaccttctggggtaggtagtgccacctccttggaagaaagatccttttcgtgatgccagggcaatgattaacacatggaaaattggagcaaatgaaactgcaattaatactgctcaaacagattgcagagtatgatgaagaacttggatgtcattttattgcagcctctcctggggacaccattattttatcacctttgacttttggatgtatagctccatttgacatctcttgtcttttcctgctttctttctttattcttcccagtgggagttagatgaagaatgtctggcttgcagaagccagacttggccattctgggagatgtgcagactttcagattggctttgacagtcttacagagctgttcccaggatatgaagcacagctgcaaagcaggcagttcggctttgccttctcttactttcaagatgtgtgatgggaggcggggaacatacaacccccagctgcttagactcttctttatccagaattccccttcctttatctttggaggcttcagatatcactcagttgactgattaaatatcaggtgataggaatctatctctatggtggaatatatgaggagatagttttgagcagggacgccttcgagttcttgcttgctctagtttagtgcttctcaaaaggtggtccatccacagatgttgtcaatatcatcttggaacttgttagaaatgcgaatgccccacctcagacgtacccagactatccagggggagcccagaatctattttcacaagctctttggataattcttacccatactacattttgctctagccaatacttttctaagcttccttcagcttaaaccctcctgtcctttacttcctagcttatctgctgcaggcagtagaatccattagatgtaagctccatgaagacagtgatcgcatatgtactgttcactgctcttgtcctcatcataaccaggcacagaagagctgatcactaagtagtcattaaataaacaagtgattggcataagcatttgaacaaggtgaagagaccacactgtctgtttacaaagttgaagaagtcaatgctgtcttagtctttcttggccctgaggcagtattgcatgtggccatggacctagacactactagccatttataggctgtcagttactatgtagccaggaggatccccccagtgtcatctcttaccctttaaactacacgaaaaagctttgaaatgaagtccttgagccagaaaaggataccagccccactgttaagtgatgattgtgtgctaaagcagcctaagagttctatcctaacacaagagcctagaaagtaacttcttaggcagtgtccaaagaatgccagtagtccttggggacttttcagaggtgcttggcttgaatcaatttctagatcccaaagcagagtcttcatgcacattttgcggctgtagtgtacagcaaatggctcttggctaggtttagaatgctgcttttaccattctctgtacctgacccagtttgagtctccttatgacacttggcttcctccagatggaaattttgaagcctttttggacttttattgtacttattcttgattgccacgtctcatttggattccccagactctgattagaggcactgccaccaggagagattttatctaaccaatagtacttccaggaagatcctcacccttgtactttcaagaagcacttgtaattaatgttcagcttcctgaacactgagtggtacttgaaaatctctgtggtttatagccttacagaagctactctggaggctgaggcaggagaatcgcttgaacctgggaggcagaggttgcagtgagccgagatcacgccgttgcactccagcctgggcgacagagtgagactccatttc

SEQ ID NO: 236499 - DNA, 396 bp, Homo sapiens
taagaagagctgaaaactcccagtttaatgaaacattaattaaaaacaataatccaggaagctccacaaattccaagcagaataaacacaaagagatccacactgggttgcataatagtaaaaatactacaagacaaaaagagagtattttgagagcatataaataaatatgcctctttgcatacaaggaaactgcaatgaggttaaccggtaacacagaaaaaaatggaggctcaaaggcaccaggaaaataatgttcaaagtgctaaaagaaaaaaaccatcaaccatgagtcttatgtccactaaaactatctttcgaaaatgaaggtgaaaatataggtataaatatttgttattggctgggcagagtggctcacgcctataaccccagcac

SEQ ID NO: 236500 - DNA, 502 bp, Homo sapiens
ctgcccctcgtcaccagtgtgtcaccagtctgtcatggtggaagcagggctaagactcaggtcttctgagccttattccagaagttttgcctttatgcttgctctcctgccgagatatacaatgggagtaatttggtgtttgccctcccctgggaccctgtttttctatctggagcaacttctgagagaagagaatggagtccttggcatgtgccccttccccatagctctgaaagacgctttgtgccaagttccttggacattccacaggctagttctaggcaaatccatctgccagcaggtcacaatcctagccttcaactctgagctgagatattttgtcctttctgctgttaaatgaaccctttgctttcttggaagctaaagcaaagtgagggaggccaggctcagaggacctggggcaaagcgcttgggctgggctggagtgagctggggtggactgccaggggagatgggtctgttttgcagacctggctcgaga

SEQ ID NO: 236501 - DNA, 598 bp, Homo sapiens
acagaaggacgaattagttttgcagcatgaattggcattctataaaattcattcacaaaataattgcttactggggattttcatcattataactgagaaagaggaggcacatctgtgctcttttgcaatatgagacagtcatttttcaaacaaatcatacatgcaacaatagataggaatatggcgggaaaaagattcagtggttctatctgagcccgtgattccaataccagaggcagaattgagattcaagtctataactgtaccaggaaaagtcataataagggtatagggggttgatacatttaacttctgtctatgacagctttctttggataatttggtagaaaaaacaacatgcaataaaaacatctttagaagtcttagattattactaattatttatgggattggtttcagaaatttgataccttaacatcttaaagaaaaaggaaggccaggtacattggctcagacctgtaatcctagcactttgagagagcaaggagtgaagattgcttaaggccaggagttcaagacaagcctgggcaaaagtgtgagacccccaactctacaaaaaacaaaacaaaacaaaaca

SEQ ID NO: 236502 - DNA, 312 bp, Homo sapiens
ctagtctggggtctttttctatgagtcagggtggtatatcattttgcttttattgtttctgactagcagtctgctgtaattcttatcctcgctcctcggtaagatattatgttttttcccccttggctgacttccagattttctttctctttggttttcagcagttttaatatgatatgcctagatgcatgggtttggggaggggctcagtaaatatactaacctaaaaaatgcctctctcagttataaccattatttccttaattttcttaatttgtgttattttctaaattgtgtttttctgttcttatc

SEQ ID NO: 236503 - DNA, 429 bp, Homo sapiens
gacggggggaggtgctacatgcttttaaacactcgtatctcaagggaacatttaccgcaagaacagcaagcaccagggatggttgctaaaccatctgaaactgccgcctgatccaaccacctcccagcaggccccactcccagcaccgggaatcacaatttgacatgagatttgagtggaaacacagatccaaaccatatcttaccaattttgaaaaatactggaagatgggaaatatggaattaaagaaacataagatgaaagaaaagagtttgaagtgatgaaagatggaatgaggcagctggacacatgggttaagaggaggaaaagtaggaaaggaggaggggaaaaatagacatttgatgtggtagaaaaaaaaacagatggaaatggagatgtcataataaaaataaaattcaatgtttcaca

SEQ ID NO: 236504 - DNA, 248 bp, Homo sapiens
aagagagtttgactaacggcatggccttgggcacctgaccggaccgctgcctggtttctcatggctttacctaccttataggggctttgtgagcatctaaagcatttagcacagagcaggggccctattagtatcagctggtactatcattaatgagacagtctcagttccagcaagaactgttctttttcgcaggagacaaatggaagtaattcgtcttgttggaacctgcggtgaggtagctgggt

SEQ ID NO: 236505 - DNA, 495 bp, Homo sapiens
gatgaaagactgcaaacccctccttggtctactagatcacagttaagctatggcaaagaggattacttggtctggagaatgtaaaaaggacttgcttctacctgccagctttatcacagcactatttctccgtcctaacagggatccttgattctaatagtagcatagggttccattttgcagtttttttcaacctgatttccctcacgatggcccatcaaagttccctctgccagccacctagtgccctaccgccttgagtctgaggtttccagatactttcctctaagccacaaagttttagtaatcctaacttctgttcatccttccaatcctaggtgtagaaactgcttcttcagttattgtctctgtgataccgcaatgtccatttttgtttattttgcttttttcccttatagtttctaatgccctggtaaacaagatattttataaaattttctctattaaaataatcttgactgcttttgtggataa

SEQ ID NO: 236506 - DNA, 576 bp, Homo sapiens
tcttgctatgttgcccaggctggtctcgaacacctggctcgagcaatccttccacctcagcctcgggaagggctgagattacaggtgggagccactgcgcccagccagcagtttcagttacattacagagaaaactcatttggcttgtagactaaacagaaggatccagtagggagagaaagaaggaaatgattgattagataaggtcctagggaaggtaggaggtcacaacaacacgaaaagggatatttataatgttatcagattaaaaaagtattctgaataaaaagtaattgagaggcccagtgcggtgactcacgcctgtaatctcagcactttgagaggctgaggcgggtggattgcttaagctcaggagtttgagaccagcctggccaacctagtgagaccctgtctctactaaaaatacaaaaaaaaaagtaggtgtagtggtgcacgtctgtggtcccagctactcgagaggctgaggcgggaggatcatttgagcctgggaggcggtggttgcagttagctaagatcacgctactgcactccagcttgggtaacagagcaagacct

SEQ ID NO: 236507 - DNA, 863 bp, Homo sapiens
cagcctcccaaagtgctgggattacaggcgtgagccaccgcacctggcctgtttattctcttaagagagaaaatgaggggattaatggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggtggtggaaaggaaatccctcacagcaactggcaccataatcaagacagaatgtttgcagaataaatggagttacctgctttcagccccaggttgtagctattgtctgccctgatgatatgtgataataatttgtgatcctattgtcttaaaatggggtcactcatctccagtagaattaagtccacagtgaagttgtccccccatccccaaagagataaacatatatgaatgaactcacatgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactcctgtgtgtagaatgataattgcacaattgatagtgtgaacacctcttgataaatggtaaatctgagcat

SEQ ID NO: 236508 - DNA, 1579 bp, Homo sapiens
  misc_feature (1076)..(1076): n is a, c, g, or t
  misc_feature (1244)..(1244): n is a, c, g, or t
  misc_feature (1394)..(1394): n is a, c, g, or t
ctgtctctggatttgccttctctgaacattttttttttaacttttttttctgggggcagggcaggttgggttaggatggctgccctctggacctgcccctgaacatttataaatgaaataatatagtatgtgttgcctttcgtggtggcctctctcacttggcataatatttttaatgtccatccatgtggtaacatgtatcagtacttcattctgctttatggctaaataatattccattttgtgggtacaaatttaatctatttttttttttttgagatggagtctcactctgttgcccaggctggagtgcggtggcatgatctcggcttactgcaagctccgcctcctgggttcatgccattctcctggctcagcctcctgagtagctgggactacaggcgcccgccaccatgcttggctaattttttgtatttttagtagagacggggtttcaccatgttagccaggatggtcttgatctcttgaccttgtgatccgcctgcctctgcctcccaaagtgctgggattacaggtgtgagccaccgtgcccggcccaaatttaatctatttatcaattgatggacatttgggtttccactcttttggctattatagataatgctgcaatgaactgttgtatgaaaatttttgtgtggtcacatgttttcctttttctttggtatattgctgagttataaactgatttccattttatattccaaccagcagtacatgaagattcaaatttctccacatctttgtcagtatttgtcattgtcttttttttctatttaaagtcaccttatttaattttattgttaattttgttaacattgaactcacaaccaacagcattataattcatgtctgaatgaaacttacctaacacagtattttctctgtaagacacattaaatcgttcttgcacttaggagcactagaccgcacttcagcactacacttggggggcatttttttttttttttttttttgagacggagtcttactctgtcgccaggctggagtgcagtggcgcaatctcagctcattgcaacttctgactccctggttcnagcgattctcctgcctcagcctcccgagtagctgggattacaggcacgtgccaccgcgcccagctaatttttgcatttttagtagagatggggtttcgccatgttggccagaatggtctcaatctcctgaccttgtgagccaccgcgcccggtctgggggggcatttntaaacaacaacatctaggccgggtgcggtggcttacgcctgtaattccagcactttgggaggctgaggcgggtggattactggaggttggaagttcatgaccagcctggccaacctggtgaaaccttgtctctactaaaaatacaaaaanattagccagatgcggtggcgtgcacctgtcattgcagctgctcaggaggctgagacaggatgatcacccgaatccgggaggtggaggatgcagtgagctgatatcatgcccctgcagtccagcctgggcaacagctacactctgtctcaaaaataaaataaaataaaataaaacaacaaaatccc

SEQ ID NO: 236509 - DNA, 868 bp, Homo sapiens
  misc_feature (844)..(844): n is a, c, g, or t
  misc_feature (858)..(858): n is a, c, g, or t
ctgtctctggatttgccttctctgaacattttttttttaacttttttttctgggggcagggcaggttgggttaggatggctgccctctggacctgcccctgaacatttataaatgaaataatatagtatgtgttgcctttcgtggtggcctctctcacttggcataatatttttaatgtccatccatgtggtaacatgtatcagtacttcattctgctttatggctaaataatattccattttgtgggtacaaatttaatctatttttttttttttgagatggagtctcactctgttgcccaggctggagtgcggtggcatgatctcggcttactgcaagctccgcctcctgggttcatgccattctcctggctcagcctcctgagtagctgggactacaggcgcccgccaccatgcttggctaattttttgtatttttagtagagacggggtttcaccatgttagccaggatggtcttgatctcttgaccttgtgatccgcctgcctctgcctcccaaagtgctgggattacaggtgtgagccaccgtgcccggcccaaatttaatctatttatcaattgatggacatttgggtttccactcttttggctattatagataatgctgcaatgaactgttgtatgaaaatttttgtgtggtcacatgttttcctttttctttggtatattgctgagttataaactgatttccattttatattccaaccagcagtacatgaagattcaaatttctccacatctttgtcagtatttgtcattgtcttttttttctatttaaagtcaccttatttaattatggaatttgtacatgactacaccacagntataatctgctgangaactaccaa

SEQ ID NO: 236510 - DNA, 345 bp, Homo sapiens
agtttttcatggctattgctttcactgtattgactgttagactgtttcatataatacataaaacagaaagtcaagtcatttactaatttctgggcttaaattcagaatcttaaaaaatctaagtataaaatgttaataaaactttatagatttctctaaaaatatctactattgttctataaattatatgttgtaactatttaaaactgaatcatactccatgctcataagactgactatatcgctctacctaaaatgtaaggaaaccagctcatttaaaacccagaaatcaaaacatatcgtgtacctaataattatatacaccttctatcacccacaaaaatt

SEQ ID NO: 236511 - DNA, 348 bp, Homo sapiens
caggggagctttggaggagagtggcagtttccaggtagttcagaggcccacccagcttcatatatctgtgtccacagcataccaatcaatgcttagtgcacagcacatttttcactgtgttgttagagtacatttgcttatattttgcacaattttaatttaaccatattgatcaaactgaacactcaataagaccctaggcaccttaggcttattaaaattagtcaacatggagcaagtgagctaaggaagtaatggaaactgtttggagatttaaatacagtggaacccacttaaataaatacctgttaatgaaataaatctattaaatgaatttattttctctga

SEQ ID NO: 236512 - DNA, 270 bp, Homo sapiens
aatataaacaaataaataaaaaaccaagagtccgatccatgtgggtggtgctacatgtcttctgtatccactctccatcctgctctgtgtgtttggagcctgacttaaatgggcaacaccaaaggcttatatacctactagtttcaagctgggtttggccagttgtatacctgggagagaccagaggcagggaggagagtgaggttgggtgcttatgtccccagcttcccttctgcagggtgccttgggttggccactctcctgacctat

SEQ ID NO: 236513 - DNA, 754 bp, Homo sapiens
aaaaaaaggcaagagcaaggaatctggggcagagcaagagcgagaccaaagccctgtgtggggatgaagcttgatgtggaagcttgacggggaggacaaatatgtggcaagagggacagggaagccagttcctgcagctgcttgcaagacaagcagggatgtgtccttccagccatagagcagcaagcgttcactgaaagtatttaatcaggtgacacccaaatggctggctttctacttcaggtcagacttaccttttacaagatttcattccaatgtattaatgagcagttatctcctttcctcccatgcttaatgagaaataaaatactgactttgggcccaggtggtgactgagttggagggtgtccatgattgaagttaaggactaaattagagttggccaagccaccagcagagaggtaccttcatgaacatctgctctcactgtggctacagagggattgtgaatatcggttttctcttctttcattagtggagtatttgtcaatagcattccaagctgtcttttcctttcttggcttgactactagcccctttcccacggtacagtttcacaggcatctgccttatattctgttctgtacttcccttggacattctttgtaaaagagttcttaaggttttctatcttctgccatagaatttaggagaaaatgttttatctctaccccatgatgtctctcttagataaacctgagctctttttctgtttgcctagccaccttataca

SEQ ID NO: 236514 - DNA, 808 bp, Homo sapiens
aaaaaaaggcaagagcaaggaatctggggcagagcaagagcgagaccaaagccctgtgtggggatgaagcttgatgtggaagcttgacggggaggacaaatatgtggcaagagggacagggaagccagttcctgcagctgcttgcaagacaagcagggatgtgtccttccagccatagagcagcaagcgttcactgaaagtatttaatcaggagaatgcatggattaaaaaaactcacgctggctgatccaattaagcttattttgtgacacccaaatggctggctttctacttcaggtcagacttaccttttacaagatttcattccaatgtattaatgagcagttatctcctttcctcccatgcttaatgagaaataaaatactgactttgggcccaggtggtgactgagttggagggtgtccatgattgaagttaaggactaaattagagttggccaagccaccagcagagaggtaccttcatgaacatctgctctcactgtggctacagagggattgtgaatatcggttttctcttctttcattagtggagtatttgtcaatagcattccaagctgtcttttcctttcttggcttgactactagcccctttcccacggtacagtttcacaggcatctgccttatattctgttctgtacttcccttggacattctttgtaaaagagttcttaaggttttctatcttctgccatagaatttaggagaaaatgttttatctctaccccatgatgtctctcttagataaacctgagctctttttctgtttgcctagccaccttataca

SEQ ID NO: 236515 - DNA, 854 bp, Homo sapiens
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagc

SEQ ID NO: 236516 - DNA, 804 bp, Homo sapiens
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagc

SEQ ID NO: 236517 - DNA, 348 bp, Homo sapiens
tgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctgaggcaggagaatcacttgaacccaggaggcagaggttacagtgatccaagattgcgccactgcactccagcctggtgacagagcgagactccgtctaaaataaa

SEQ ID NO: 236518 - DNA, 480 bp, Homo sapiens
atctcaaaataactcctttccagtcggccttggcctgccatgggaggagtgaggcgctggttccccatgcacacgcaaggccaaataaagacctctgagccaaccccaggctctttacaccacgggaatcaaaacaccaccacgggcttccagggctccctcccacttgtgagcttctggggttgaggctgagacctgctcagtggtttgcagcccaggcccaggccgcctcgaggggggtctgggtgacacagagatgaaggcagacggcacggaggcctccctggaccatgtcaggagatccttcaggccatgtctctaagactgaacacctgcagcccacaaaaaggcttccatcagccttgccctctccaaaactgactcaaagcctggggtcctgcgaactgcacctcaaggcctgtacttcccgcagcaggggtgtgggggctgcagagatagatgaagcccacccagatgagg

SEQ ID NO: 236519 - DNA, 583 bp, Homo sapiens
aagaattcggcacgagggagaatgatgaagaagactcacagacacttccaagctcctgccatcaatagatggagtctgtttcttcgctacttgagtctgcgtggccttgtaccctgcttttaccaatagaatgtgtggaagttgctgtaggccagtgctgaacctggtcctctagagcaggggttcccaacccccacactacagactggtactggtcagtggcccattaggaactgggctgcaccgcgggaggtgaacagcagatgggaccgtctagttgcaggaaaataagctcataatgattctacattatggatgattaaactccttaagaacaagcctggctgagcctgctagagaatgagagaccaagtggcaaagtgacaagagtgataccaactaagtctccagagactgagagcccggcccagatgagtaaaactagctaagccacttacctgaacaatggctaaccgccaatgcattaagaacccagccaagacgagaaaacttgcctacctgatcccagtttatactgctgaccttaaatagcatgagctaaataaatggctgtttcaaagca

SEQ ID NO: 236520 - DNA, 304 bp, Homo sapiens
ggcttctccagacatattgctttacatattacataacatttgttaactccaaaatttatattttcagtgctgacttattttcacacctccaaatataagtagccagttgttcataagtcatgttaatttgatgacttgtaaacatctcaggacaatatatccaaaccaaacccttaacaactcctacccaagtatgattcatttctgattttccatattttagtaaatggcaacagcatttttctaattgctcagccaaaacactttaaggttatttctcagctctttaccatcacaaccccta

SEQ ID NO: 236521 - DNA, 367 bp, Homo sapiens
ggaaatctgttttaatgctatagatttccttctaaatattggccactaatgaatactttaaaagtactgcatgccaaacagcccacagacttctagtctgtaaagaaagaagaaaaaaagggcgataggatttgaagttaagaaaaggtaaaaaacatgtggcgtgcctagttcgtgggaaaaaaagctggtttgatgatcctgcctttttattttttctttttagaaaaatttttacaactatattgtctttttaagtttttaaatgatttttttctttcctatcatctccttagcctgataccctgccttatctttaggaaaaaaatgctcctgataataaatacaaaatataataaactcattt

SEQ ID NO: 236522 - DNA, 131 bp, Homo sapiens
gcattttgaacaataagcttatgaaagactaaagtgtgttagaagccatcctaatttgattgttcctgaacaaaccctacaccataacagcctgtctgaatgcgaggggtgctctggatcaggaagtcaca

SEQ ID NO: 236523 - DNA, 1804 bp, Homo sapiens
  misc_feature (145)..(145): n is a, c, g, or t
gatgccatgcggtcatcctctttctgtttccagcaactatagcaggggctgggtcctagcagttgcctacgtaatattgctagaattaatgaatgagaacagagtcttaaaaggcaaattctggccaggcacggtggctcatgcntgtaatcctagcactttgggaggccaggctggtctcaaactcctgacctcaggtgatccacccgcctcggcctcccagagtgttgggattacaggcgtgagccactgctcccggccctgcctccttgtttttgttgctcctctctgtagccctgtcccagcaacttgtatgcttcctttttcacagagccatcatgcatgatgaagaaaatggaatgcatcagtattttatagacattattattgtcagaaatacatgcagatttggacagggacaaatacagagatgaacactattattaaggcaggactttttattttttagctttagtgccttttaatcatattttcataatataaaatcataacataaatatcaggaaagctagtaattattattttgtgtgtggactgcctggctatattataaacagggcaaagcttacattttccttccttcattcatgcagtcagggaaatactaagttgcaaaatgatgacaatgatacaaacaagtcatttggcccagaaggcaccaggagcagctattaataaggaaaacaactttttccagctgaggccgagttgattaacttattttcctggaggagagataaagcttaagctataatttattgaaaattaatgaaaatgaattttggtggcactggctatcaaactagaatgaaaataagaatgtgagtatactgtattaaaccaaattttccttcaggactcccatatttcttcagctcttgtactgtcacagaggttcgaatttgaaagcattaatgttgtcattttttgccagtggttctgatggtaaatatccacagagtcttttatctttaatttcttttgatgtgtgtttttagatcaagcttagttagcaatttttaatgagaacttatacatcttggagctttagtgctttgtttcaaaagcctgaccttgcatttgctttttaaacaaatgtctcagagctcttgttgccaaagactaaaatcttgaaattttggtgtgatcatttataaatttcttgatgtccagttatgagactttgctagggggataacctagtgctgtaaccaatgacatactgatagaaaaaactttactgcctttttggttgaaggatgctcgttgttagatcattttttcccccaggatctcaattttcatgaatgttctttccagcctatctttaaggtttatttttatattgcattgcaaacaatgcagtatcaaatgtttgttgttcacatggatgtggacatcaatatgaggaaggaagagccagacaggcatgtgacggtcctctgaaggaccactgatattacaaatggcctgtgaactgggttcccaggcaggttcctcaaggagagacgttgcatcctggcacccagatccctggacttaaagatcaatggccttgatttgtctgaaattacttcacagagaggattcctgttaatgattacagatccttcccaatacactttatttatgggaccctctcaatgaggggatctctgctgtctctagcaccggaaagatgctttctccagaagatgaattggcatgaaccctaccaggcctgggagggtaggagcttctgtagccttttcaagtaaaagggaaaatccagacttgcattagc

SEQ ID NO: 236524 - DNA, 384 bp, Homo sapiens
taagcatttttacatatctccactaaacctgacaacacacagggtatggggctattatcctcactttacaggtgagaaaacaggggaaccctagagaaattggccataattactaatttgtagcagatccatgaataaaacctggatttcattattcctaagtccaattctctttccacatttctccttgtagtccttgggtggtggaatgcaatatacttgacgtgattgagaatgaaatgtactttgctaagaaatacttgaggctggcctggtgcagtgactcacgcctgtaatcctagcactttgtaaggccaacgttgggggatcactggaccaggcattcgagatcagcctgggcaacaaagagagacctcatctcta

SEQ ID NO: 236525 - DNA, 529 bp, Homo sapiens
ctgtagagaactaaatgatggttgttatgcaaaggtaggatttttaacatcacatatgaatagtcttcggaatatttcctgttgttttcatccagatttgtcattactgctagtttttgaggttaggaaaagagagctgtcaccttcatggggcttaaaaaaatacaatgtggagattttcagtcagttttcagtcagaggaaggaataccggctgtccgtctagtttgaattcttcatgatggtatccttagccatgatccattgctcttgttttgattatttgtattttaaagagcagattgatgcaatgggctagtgagggcattctaccctattttgagagtttgagagcttcacttttttaaactaagaatgatagtgagtttaaaaaatattagttgtatttcaaaattaaccttaggtgtgcttgaaattttcttatgtacttcagtaacaacatactgggattgcaaatattgtacttttgtatactgtaaagggggagttgaaaatacattaaatagtaa

SEQ ID NO: 236526 - DNA, 266 bp, Homo sapiens
ctgcgtactatgtactcagaatgaaaatagaagtacaagattataaacaaaatgcaatcaaacttttcttaagcttacctaaagttattttatctgaaaatttcaagcaactttgatcaacattaaattgacaatctaaactaacaggtcttttgaatttatgtatggtagtaaacattctctctattaattttattacctaaggctaaacctaaaatttttaagcaaaattagaaagtcttcacttatcaaaaaataaagtttgt

SEQ ID NO: 236527 - DNA, 743 bp, Homo sapiens
gactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaagggttttacatttaagtctttaatccatcttgagttaatttttgtataggtataagaaaggggtccagttttaattttctgcgtatggctagccagttctcccagcaccatttattaaatagggaatcctttc

SEQ ID NO: 236528 - DNA, 463 bp, Homo sapiens
gagctgtaagactttctttgttaattttcaaagagccccatgaagtctccaccactggaaggtgcctgagaatcagctgaggtgtccggcagaagcaacgatacccaagagtggccgtgatatgcagccctggccacctccaggtaagaaaggaaaaaaacagcacaaccagaaaacacacacatgtaagccatccactggggactcctattaacacctacgtgccaggacagaattgaaccagagaagctgcatcacatgtacattgctggtacatggtggatgcctcccagaaggactaaatttccaaaggattcaggagccctggacttgggcccatggtgagatgacaagcctttatgtgaagctgagacagagacagtttcacatattggctctgccacctatgttccttgatggctgggatcttggtgtgcacatctggaagatggagaccatgcta

SEQ ID NO: 236529 - DNA, 438 bp, Homo sapiens
tctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgt

SEQ ID NO: 236530 - DNA, 487 bp, Homo sapiens
tgcagtgtcttatggataatgtgagccccctcagtatttctgaaacgttttcattctctgttgaagagagaaaatagtaacatgaagtgggtagagagagaggagaaaagaggaattataagagcatcagtaggggatggatgaaggactgggtgtcatatgacaagtagctaaattggccattacgggtatcgaactccatttggtgtgtaatagtaggtgagcacttggccatatgaaactcatatctatatatcaactttccctaaacaccatctcaactaatgagcactgaatgaggaatggagatttggttgggcagagataacagcagaaaatatgagaaatataagtacaatactgtaattaaaggaaaaccactgtgacttatgacctccatctcaattcctttattctttcttttcctgtcaagcagcataaagcaagaactcttatggaaagtagacagaggaagcaacatttcttt

SEQ ID NO: 236531 - DNA, 345 bp, Homo sapiens
aaactctgtttgacacataggaagcattaataaatgctagttccatgactgtccacttggtctgcagacttcagagggttacagacactcatgtgttcagcaatcattgagcgctctttgaaacatttgttagccagttaattgccttttgcagttcaagtcctctcatctgtaaacctttctaggagactgccgatcagctcaccgcaagcagagtactcttagggctgtggctgcagcagccgagtcacatgatccctgggcctggtaacaccttgcggtcttcataagtctttgcctatacagtagaccatcctggacgaagacccatgactgaatctaata

SEQ ID NO: 236532 - DNA, 545 bp, Homo sapiens
ctttgttcccctctcacagtgaaccctgagctatgtatctactggaaaacccacaccacacacacgtgtctcccctctttgaccatacttctccctcatctcacctctctccacatttgaaagatggcaagctagatggagaactactctacggacactaggattttgttaaaatgctattttattgaagtgtattctagtagtcccccttatccatagttttcctttccaaagtttcagctacacacagggtctacttcatttcaaatatattaaatggaaaactttagaaataaacaattcataagtgttagattgtgcactatcctgagtagtgtgatgaaatctcacaccatcctgctccatcctgcctggtacgtggatcctctctttgtctggcatctccatgctgtagacactccctctccatgagtcacttagaagctacctcactgcaatgagacatgatggtgccactgcactccagcctggacagagcgagaccctgtctctgaaaaacaaacaaacaaacaacaccaccaaga

SEQ ID NO: 236533 - DNA, 630 bp, Homo sapiens
cgacgcccagctaattttttgtatttttagtagagatcaggtctccctgtgttgcccaggctggtctcgaactcctgggctcaagcaatcctcctgccttggcctctgaacatgcagtgattacaggcgtgagagccaccgtgcctgacctgaggtgtgcactttagacataaaatgagagaggccaagttcacattttgttggtgaacagaaatctaggctggcctccttttggttcagaaagagtatttatgatttttacttttttggtttctttttgtcttcttttatttttacccccatgcccctgaattctctcctgtgctcggtcgagaggatcttagcttgcaggattgttagggagctgctgccagccggctgctccttccataaaaggccactctcatgggtctgatatgaggaactctgtcgctggagctcatcagggtggggcggctgcaaaacacacacctcagaaggcgtctgatccaatggagtggatgggtcatttaaggttgactgtgaaaatatcacatccaacttccttttttgaaaagtaaataatggtgagctgtatctttaaataaagttaaatcctcctgcccctgcaatatgctggggccagacctc

SEQ ID NO: 236534 - DNA, 684 bp, Homo sapiens
cgacgcccagctaattttttgtatttttagtagagatcaggtctccctgtgttgcccaggctggtctcgaactcctgggctcaagcaatcctcctgccttggcctctgaacatgcagtgattacaggcgtgagagccaccgtgcctgacctgaggtgtgcactttagacataaaatgagagaggccaagttcacattttgttggtgaacagaaatctaggctggcctccttttggttcagaaagagtatttatgatttttacttttttggtttctttttgtcttcttttatttttacccccaaaaaggactttaaatcttctcaagccctcttattagtaaatgtttgcccctccctgcccctgaattctctcctgtgctcggtcgagaggatcttagcttgcaggattgttagggagctgctgccagccggctgctccttccataaaaggccactctcatgggtctgatatgaggaactctgtcgctggagctcatcagggtggggcggctgcaaaacacacacctcagaaggcgtctgatccaatggagtggatgggtcatttaaggttgactgtgaaaatatcacatccaacttccttttttgaaaagtaaataatggtgagctgtatctttaaataaagttaaatcctcctgcccctgcaatatgctggggccagacctc

SEQ ID NO: 236535 - DNA, 367 bp, Homo sapiens
ctcactttgtgaccatcctgcccctcactggaggtccctagaggcaggtgcctttcagctaagaatatctgggagtctgtggtttgtgaggagcttgctggcacattagtgtaaagggtgtgatccttttaatggccacacttttctgtatgatgtctttgttttcattctctgatgtcagggaggtgaaaagaaggctcaggtgcctcatttctaaatagactgaatgtctgttacctctcctctccttttcaactgagaagcccttggtgtacagcggaaaggggctgtaggggaatgcattttgccactgcagtcatgagctgacccagccttctgtattcttggatgttttcattctaggctg

SEQ ID NO: 236536 - DNA, 295 bp, Homo sapiens
ccgccttggcctctcaaggtgctgggattacaggtgtgagccaccacacctaaccctttttgttattttgtttcttttttactgccttcttttgtgttaaataatattttctattgaaccatttcaattcctttgtggttttttaaattttttttaagttattttcttaggctgggctcagtgactaatgcctataatcccagtactttgggaggccaaggaggaaggatcacttgaggccaggagtttcagaccagtctaggcaacatagcaagaccctatctctttaccaaaa

SEQ ID NO: 236537 - DNA, 228 bp, Homo sapiens
tgatcttagctcactgcaacatctgcctcccaatgccccaaaattgaatccaatccctcaatcactaccagtataaatcaatgtaaatgacagaagtatagtgtgtgctaggacaaaggaaaaacaggtgaagaccttattctacataagctggagagcaacatttcataaataattagaaaatgtacacttaaccatatactactgctaggcttcatccaaagtgac

SEQ ID NO: 236538 - DNA, 2460 bp, Homo sapiens
  misc_feature (1688)..(1688): n is a, c, g, or t
  misc_feature (1817)..(1817): n is a, c, g, or t
gagaattaagtaaaccctatttaaaccctattcaagatggctcccctggtgtcaccaccggacatggtgcttggggctttgtgaatgatcagtggaggacttgcccacgtgaggcaaaatacggaactaattgtcacgggggtctcacatatcagggcggttgcaaattgtggcaaggcaggtgcgaggggacaccttggagtcccttgggcttcccagggcctctgggggcaccgcagcctctacacagacttgcatgtacctgctgagagtccctcccactcccactcactgaccctgtcccacatcttaaagctgtgcctcctgtttcctggccatgctgacaggtgggacaccttctgcttgctgggtggtgactggatcggcacacatgtgtgacccagcggggggtgtggggtgcaggtgccagagccccaggggctgcagagcctgctccctccctgccctggtttcaacttcctcagtctcagcaccacctaacgcaccaccttgccctgcatttccccggctttaacatgtgaagccactctgcagggaaacaacgggtcggagtggggtggagtggggtggggggtgggggtcaagcatgtgcctcttccccacccagcggcagccggaagcagctgggcccacacacctctccatggactccagcgtgccatccaggctgcccaggtgctccggaataggcagcaaggttttgcctttgatcttgccactcatcacaaacatttcattcttcagcctgtggacctgcttcacgatgtcttccgagaccacctggggccatccagccatgttctcactttggtttaacagagaagagaggacctaaaaggaaacacttctgtggttccgccccctgtgccttcaccagctcggcaaccgcacagagccaggtccccggggggttccaaagacccggtgtctggagccctgggaaaactgggtcccgcacagagccaggtccccagggggattccaaagacctggtgtctggagccctgggaaaactggatccttcttccagaaggaggtgtggccggtcatggagtttataccagctgccctgtcctggtggtaccaaagccatccccaagctcttgcacccatagcacacactccttgctaaaagcctaggaggactgtgatgggtcaaactgtgtcccccaaatccatctgctgaagccctaactcccagcaccttagaatgtgactatttggagatagggtctttaaagaggtgagtaagggctgggggcggtagctcatacctgtaaatcctaggacttagggaggccgaggcaggtacatcacctgaggtcaagagtttgagaccagcctggccaacatggtgaaacctcgtctctactgaaaatataaaaattagccaggcatggtggcacctgcctataatcccagctatttgggaggctgaggcaagagaatcatttgaacctgggaggtggaggttgcagtgagctgagatcacaccattgccctccagactggacaacagagcaaaaatactgtcaaaaaaaaaaaaaaagaggtgagtaattaaaatcagattactagggtgggccctagtctgacaggtgtccttacgaggaggggagattagacatgcacagaaggccgaccacatgaggacccagggagaagangtccatctgcaagtcaaggagagaggccttggggaaaaccaaccccgccgacaccttcaacttcaacctctagcctccaggactgtgagaaaatgtctggtgtacaagcgaagcacacaggcccctgtnctgcagatgagaagagtgatgaccaggaaggataaggcacccccattctggaggtccgaatccccaaagtgtgtcccccccacctacacagcacctgccaagggggacagcagagggacacataaaatgacactccattttttcccctttcttaagtcaaagtctcaaaattggagaaacctatctgccagtactcagtccccaccttcccaggccatgggcagcaaccgtacccggcacagcatggcagtctcaatgctgtccagagagaacaaggggatgctcggggcttctcagacttcaagggcacgagcaccacctggaggtcttgttagacagcaggtctgtggccgggcatgatggctcacgcctataatcccaacagtttgggaggttgaggcaggaggatcgcttgagcccaggagtcttgagaccagcctgggcaacaggctattttttggtgagacctcatctcttaccaaaaaatacgaaaattagccaggtgtggtggtgcatgcctgtggtcccagctactcaggaggctgaggctggaggattggttgagcttaggaggttgaggctgcagtgagctgtgctcccaccactgcactccagcctgggaagcagagtgagaccctgtctc

SEQ ID NO: 236539 - DNA, 511 bp, Homo sapiens
tcaattcaatttaatctaataagaatgaaatgagcacccacttcaagcctagatgtgttaaatgtagttggggtacaaagaagtataaatatgattagggtagatcatttcattactcttttgttagggttccttttctaaatgcatttatgttgactttatatgatggcatgaaattgtgttaagccattataaaaattatcattgttttccttttctttctggggaaaaaagtgttctgcaaatatatacattcaaaaaatcatatgaagtatatatagatgtatctcataagtatgtatttattctgatacatgtgtcttattcagaagcatgtatcttatacttttcattctgaagcttgcatcttattttcagaataaatatataatacataaatacatgtgctccttactgataaatatataactctaaggtcatggtaattaatatgttttctattgctgtgtatccaaaacaacttttaggaaaagaagtcgaatagctcaag

SEQ ID NO: 236540 - DNA, 284 bp, Homo sapiens
aatcccaacaacctcctatcaaagcacacttgaagctttgtgtcttttttttcactataaagatttccacttccttacctgacttgagcctctaccaaattcaagtggtggtggctgactcccttgctgtcataagctctgaataagtagcctctgcttgttctaatttgggtggtctttgtttatttctagagattttctggagcttccactgacatatggtctatactgcccagcaccgtggatcccagcctgggtgacagagcgagactccatctcaacca

SEQ ID NO: 236541 - DNA, 464 bp, Homo sapiens
tgggctgcagagtgagaccctgcctcaaaaataaaataaaattacatggctggtttatggctgattccatagttcagtactgttgacaataggcaacacaaagagtggtatttcctaaaggttctagtggactagaatgtaacattttttaataaaattaattcatgtgaaaactggcttggagattgtacccttctaaactgctaatatccaatgttacatcctcctcctctccttaatgggtctggactgcatgcactacagttgcccagtaaaataaaacatcgtcaaatactgcattaggtatcagggaccaggcatttgtctgagctccaacacgtgctttctgggtcttggatttttctctgctcttaaattagaatgattaatttaatcattaaattagatggctgacatgaacgactaatgtcttcgtggagtaccattcttcataaaaattgacc

SEQ ID NO: 236542 - DNA, 399 bp, Homo sapiens
gccgctgccgccgccgctgctcatgatcattattttaccttttaattctttttttttccgctcttgccaaatgctttggctccaagttttctatgtgtatctattgatataaatgtatatatttatttattctagctgtcaggtattgttatgtatttattattattattgttgtctttgagtgaatcggccggtttggggaggcttttgccaccctcccttgtgttgttttggtttttggaaaggaggtggaggagaggaaggaggggaattagggggcggccggagcagagaggacgagacagtgcttggggggtgattcgggctagtctgggggctgtctggccccagaccgcggagaggacgcgcgctcgcgctctcgctctttctgctgctgct

SEQ ID NO: 236543 - DNA, 1937 bp, Homo sapiens
ctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236544 - DNA, 493 bp, Homo sapiens
  misc_feature (21)..(21): n is a, c, g, or t
tttttttattggggtggttangaagggagatagatagataaaaaaaaaaaactcgttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236545 - DNA, 478 bp, Homo sapiens
gaagaacaagtttgtatcagctatatataattcacatctattttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236546 - DNA, 548 bp, Homo sapiens
  misc_feature (40)..(40): n is a, c, g, or t
  misc_feature (42)..(43): n is a, c, g, or t
  misc_feature (46)..(46): n is a, c, g, or t
  misc_feature (49)..(49): n is a, c, g, or t
  misc_feature (65)..(65): n is a, c, g, or t
  misc_feature (522)..(522): n is a, c, g, or t
ccgccactgcactatcccgattttcgcattttttattacnannaanaanattttatgggaaactnttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaaaaaaaaagaacatggcctngttggcctcattggtggagtctttct

SEQ ID NO: 236547 - DNA, 639 bp, Homo sapiens
  misc_feature (550)..(551): n is a, c, g, or t
agttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttagaaaaaaaaannttgcatgcggccgaattcgagctaacttggcaatttggctataggagccgattacaattcactgccggcgtttacacgtcgggactgg

SEQ ID NO: 236548 - DNA, 978 bp, Homo sapiens
agttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttagttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236549 - DNA, 1144 bp, Homo sapiens
  misc_feature (1118)..(1118): n is a, c, g, or t
ctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaaaaaaaaagaacatggcctngttggcctcattggtggagtctttct

SEQ ID NO: 236550 - DNA, 999 bp, Homo sapiens
ggagggggcagacaacccctacggctaggtacgaggcctggttgtcgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtggctgggaatcctacgaagaatcatgctcccttgctctgtcagtatttgggcagtcaacttccatcctctactggagtgcaccaccctgggcctgcgggaggagtggggtcgcaccctgtgcccgcaccacgctctcgccacggcccctacaacactgcgtgacactcgccacaggctctcgcagagcaccc

SEQ ID NO: 236551 - DNA, 1099 bp, Homo sapiens
ctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236552 - DNA, 1020 bp, Homo sapiens
ggagggggcagacaacccctacggctaggtacgaggcctggttgtcgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 236553 - DNA, 1120 bp, Homo sapiens
ctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaagcagaacaacaaacaccacaa

SEQ ID NO: 236554 - DNA, 557 bp, Homo sapiens
atatatgtatatacatatatatttaattgagtgtttatttctacagagacacagtagaagcccagtggttaaacacacaggctctacagatagactacccaggttgatgctccatcctttaggatccatatgaccttgagcaagtgacaacttctctgcattttaatctataaaatgggaacaagaagagtatttacctcataaggctttgtgaggaataaacacataaagcatttagaacaatggctggcacataggcaagctaaacaatattagcgattatttgtttttaagtgtttattatcccttgtaaccttctctgcaaaaagcaggaaccttgtctggttggttcactgctgtatgcagtgaacatgctggatgctatctgtagatcataacctggcatgtagtagggactcaatttgtacttactgaatgaatttgctgaattaataaagaaactaattcagtggtcagctgttcttcagggaagtgttccatgttgtatgataggcctttgccctgttggacacgtttttttcaaagatttgcataaa

SEQ ID NO: 236555 - DNA, 1976 bp, Homo sapiens
  misc_feature (1645)..(1645): n is a, c, g, or t
  misc_feature (1785)..(1785): n is a, c, g, or t
cacagttcatggtaaagcccaagactgtacctgcccatccactgccttttccatgtatcctggaactgagcatagacctcttcccaggcagagctgacagcaagtaaaggagatcataatcaggggaccaaacaactttgtctaaagtgtgaatgtcacctaaggagaagctgtgagatcagaagggtggggcagaggagcagacaccatgagggagagtccttgggggtacatctgccagactgacactgtctggcctgggcagtggaggggctagcaggaaccacaggtactggtggtgtggctactaccgttacaactgcctgtgcttggacatggaccctctgcaatatgcggcagtttcattcattgccccctacattctacaccaagtagaaatggaaggcaattggatacttcacagacaagatctaagtggagaaggaatgcgtcctgtggctgcagagatccttggagcttggaggggagagcttgagccccactgatgatgacctcccacagctcgccaactcagccctccctaagtccccatcgggggccaattctcactctggggttggggggactccaccatagctcatccatcatagggatgttggtatctactgtgggttgggtagggccgatgtgctgaggatggctcccccacaagcaagagatgtggatttggggagcttcccatcttgtgttgaaggaacataactcagaataataagagccaactataacaaacccacagccaacatcatactgaatgggcaaaagctgcaggcattccccttgaaaagtggcacaggataaggaagccctttctcaccactcctattcaatatagtgttgaaagtcctgatcacagcagtcaggcaacagaaataataaagggcatccaaataggaagagaggaagtcaaactatccttgtttgcagacagtatgattctatatctagaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccacaaaaaagaataaaatacccaggaatgcagctaaccaaggaagtaaaggatctctacaatgagaatcacaaacgctgctcaaagaaatcagagatgacacaaacaaatggaaaaactttccatgctcatggctaggaagaatcaatatcattaaagtggccatactacccaaagcaatttatagattcaatgctattcctatcaaactatcaattacatttttcacagaactagaaaaaacttaaaattcatatggaaccaaaaagcctgagtagtcaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggntggccatatgcagaagatcgtaactggaccccttttactatgtacaaaaattaagatggtttaaagagttaaaacccaaaattataaaaatcctgaagataacttaggcaataccattctggacataggaactggcaaanatttcatgatgaagacaccaaaagcaattgtaacaaaagcaaaaatggacaaattggatttaagagctttttcatagcaaaataaacaacagggcagacaatctaccaaatgacagaaaatttttgcaaactatgcatctgacaaggggctaatatctagcatctataaggaatttaaacacagttacagg

SEQ ID NO: 236556 - DNA, 290 bp, Homo sapiens
actcaataattctcagtcacattccctacaaagccaattctacataattccctttcttcaaatcctcctaccaccttgcctcaggtcaagatatagctctttcaacttccccagtttctcctcaaaatatctttaaatttttgtccatttctcttctttccttcccagcacagagaatggttcccgctttccataccttatccatcccattccccttgagcatccctatcagctatcagtccacaggactgttccctttctccttctccactgagtcttccctctcagcc

SEQ ID NO: 236557 - DNA, 2049 bp, Homo sapiens
  misc_feature (772)..(772): n is a, c, g, or t
  misc_feature (834)..(834): n is a, c, g, or t
  misc_feature (1072)..(1072): n is a, c, g, or t
  misc_feature (1875)..(1875): n is a, c, g, or t
cctgttccttccatctaactgtatgttttgaaccattaaccaacctctctccataccccgcctcccagcctctggtgaccatcatatggttctctactccgttagatcaactttttttttttagctaccacatttgagtaaaaacatgcgatatttgcctatctgtaggaccttcttaagactgtgaaactgtacctaggaatccaacttacaagggatgtgaaggacctcttcaaggagaattaaaaaccactgctcaaggaaataagagaggacacaaacaaatggaaaaacattccgtgctcatggataggaagaatcagtatcgtgaaaatggccatactgcccaaagtaatttatagattcaatgctgtccccatcaagctaccatcagctttcttcacagaattagaaaaaactactttaaatttcatatggaaccagaaaagagcctatataacgaagacagtcctaagcaaaaacaacaaagctggaggcatcatgctgacttcaaactatactacaaggctacggtaaccaaaacagcatgattctggtaccaaaacagatacatagaccaatggaacagatcagaggcctcaaaaataacaccacacatctccaaccatcttatctttgacaaacctgacaaaaacaagcaatggggaaaggattccctatttaataaatggtttgggaaaactggctagccatatgcagaatactgaaactggaccccttccttacaccttatacaaaaactaactcaagntggattaaagacttaaacataagacctaaaaccataaaaaccctagaagaaaatctaggcantaccattcaggacatagaattgggcaaagacttcatgactaaaacaacaaaagcaatggcaacaaaagccaaaattgacaaataggatgtaattaaactaaagagcttctgcacagcaaaagaaactaccatcagagtgaacaggcagtctgcagaatgggagaaaatttttgcaatctatccatctgacaaagggctaatatccagaatctacaaataaacaaatttacaagaaacnaacaacaccatccaaaggtgggtgaaggatatgaatagagacttctcaaaagaagacatttatgcggccaacaaacatgaaaagcagctcatcatcactggtcattagagaaatgcaaatcaaaaccacaatgagataccatctcacaccacttagaatgatgatcattaaaaagtcaggaaacaacatgctggagaggatgtggagaaataggaaagcttttacactgttggtgggagtgtaaattagttcaaccattgtggaagacagtgtggtgattcctcaaggatctagaaccagaaatatcatttgacccagcaatcccattacttgggtatatacccaaaggattataaatcattctgctataaagacacatgtacacatatgcatactgcagcactattcacaatagcaaagacttggaaccaacccaaaagcccatcagtgatagacgggataaagaaaatacggcacgtatataccatggaatactatgcagacataaaaaaggatcagttcatgtcctttgcagggaaatggatgaagctggaaactatcattctcagcaaactatcacaaggacagaaaaccaaacaccacatgttctcactcatcagtgggaattgaacagtgagaacacatggacacagggaggggaacatcacacaccagggcctgtcagggaatgggagactaggggagggatagcattaggagaaatacccaatgtagatgacaggtcgatgggtgcagcaaacaaccttagcacatgtatacctatgtaacctgcacgttctgcncatgtattccagaacttaaattataataataataataataatagactgaaactggccaggtggggtggcttatgcttgtaattccagcattttgggaggctgaggcaggagaattgcttgaagccaggagttggagaccagtctgggaagtatagtgagaccttgtccctattt

SEQ ID NO: 236558 - DNA, 534 bp, Homo sapiens
aaataaacggagagcctcatgggtgccaggcatggtggctgcctcctaggcctgcctatttctgaaagcatggttgccaatcatctgcttcaggagcatctggaaggagggtgttagaaatgggaggtgtgccccattccagacccctgaaacagaatctctggaggtagggtccaggaaacttatatttttaatattctcaggggatccttatgcacgcttgtgtgtaaaaagcactacctggggctctgatattgaatgaaagtgtgggatttggagttaggctctgctgcttactgattacgtaattggcccagacatttaatattgctgagcttccccggaggtcgaggctacagtgagccatgattgtaccactgcactcagcctgggtgacagagagagaccttgtctcaaaaaaataaaaaaatattgctgagcttctgcatcttaatttgtaaagtggaaaaaacacttttcggggctggtgtgaaaattaaatgaaataataaaagtgaaaatgtttaaaaagct

SEQ ID NO: 236559 - DNA, 452 bp, Homo sapiens
attaaaaagccttattccacctgtttcggggggtggtgaagggatggaggcaaatttattaatacatctcaaaagcctttaataagaacatcatctctgaccttcatgctccactcccagtttcattcttttaatcaaaatacatatggaaggctacatccttaatttggtgctaggtactcatcagtatataagacatgtcctttccttcacttgctgcatctctaagtgactaacctgttccaatatgagtatgtcaaatatttgaggaagttagacttaaaaacaatatgattcctcctcattcttggcttttcaaaatgtcacccaaacctgaagtaagtgagattatatttcacatgatatgatggacttttaaaaacaacaacaaatggtatctaagatttcttccaaaaataaaatttgaagatgttaatgcaactactagcaca

SEQ ID NO: 236560 - DNA, 345 bp, Homo sapiens
tgagacggagtctcgctctgtctcccaggctgaagcgcaatggcacgatctcggctcactgcaacgtctgtctcttgggttcaagagaatcacttgacctgggagtcagaggttgcagtgatctgaggtcacgccattgcacccagcctaggcaacaagagcgaaactctgtctcaaaaaaaataaataaataaaaagtttgtgctgttagtttaatagggttgggagagtgaacaagttgttttcatcaaataattctagagttttggagtggggtgcttaggaacctcatgttttctgacattgtgacttactcccgttgagctgctcttcccgaagcactga

SEQ ID NO: 236561 - DNA, 258 bp, Homo sapiens
gtgattctcatgcctcagcctcctgagtagctggaatcacaggcatgcaccaccacacctggctaatttttgtatttttagtagagacaggatttcaccatgttggccaggctggtctcaaactcctggcctcaagtgatctatccccctcggcctcccaaaatgccaggattataggcatgagccagcgcacccagcctgttcctgctcttaaggttcctaatgagtaccaccagattacccttctgtcgtcttctc

SEQ ID NO: 236562 - DNA, 418 bp, Homo sapiens
ggtttcaaagctgtggagtgagaagaaagacgtgctttcgttagtcactttttatatgggttacctgttgaaggggcaaccccctgttcctgtagggcctcggctctcacttcctgacttggaccccacccgccaagccctagtgtgcgtgtcctgggcctgtgcttcctgcctggtgggagctggtgcttagccagggctcaatggagagagcagagatgatggcaggggtatgtgtgcacgcgtgtgtatgcgtgctcgtgtgagtggggatttctgcctagggtgtgggaacgtctgagccccgtggggactttgggtcattatttaaatttgggctaagttctactaggtcttctgtcacctgctggagttattttctttctgccacattttagaaaataaaatgcaccgaaca

SEQ ID NO: 236563 - DNA, 480 bp, Homo sapiens
ggctggtctcaaactcctgatctcaggttatccacccgcctcagcctccgaaagtgctgggattacaggcttgagccactgcacccggccaaatttttattcttaaaaagctaactgcataacatcacccatgctggagaatgtgaatatgtaatgagtccagtgcagagaacgctgggttcctgtttccatctactccaaggcagccacatccctcctcgtgctaccacggtattcagtgggcaacaggtattgctgcacgtgcacggtttactgccaacaccaaatctcactgtaaattcagactaaaaaaatacgaggaactctccactggttttttgttctgaatcaatataacggtgtaaaatagttaccagggtacccggcatatacaaagagtccttaatcgttcattacaataatcattactgttcagtggagactttgccatgcagaataaaatttactttgacagtatca

SEQ ID NO: 236564 - DNA, 166 bp, Homo sapiens
tccccggcgccaccgtgagcaccgtccttccctctctgtttggagggtttgttcttgatatgctttgactgcactttttctcctcttgcatctgcctataggatctttctactccacactcccaaacttctctcaaataattacaattatgggaacaggcgaaatt

SEQ ID NO: 236565 - DNA, 468 bp, Homo sapiens
tgtggttttcctatacttaaactgtacttatgtaaaacatcatttattaaactctccgactaggacggtgacaaatataattccttctcaagatgggcagtattagccaccgtagaagctccattcttcttgtctgtcattggttcaataaatatttgttgtcatgtgattccattctggccattaaatgaggttagaattctgttgactagcttctgaagaaatgtgtattgactcataaaaaaattacaagaaaaaaacagtttcttttctcctctggacattgtcctgtctgaatgtggaacctggaatttctgaatcatcttcctatcagcttgtggatgaagtcattccaaagtgttccttcagcattgacagatggaagtgaatgggtggagaggaagaaggcaaagggctggactctagagaacttcaacacctggtaggtggcgtgaaaagaggaatttc

SEQ ID NO: 236566 - DNA, 2504 bp, Homo sapiens
  misc_feature (454)..(454): n is a, c, g, or t
  misc_feature (1285)..(1285): n is a, c, g, or t
  misc_feature (1507)..(1507): n is a, c, g, or t
  misc_feature (1856)..(1856): n is a, c, g, or t
gtattttaatctattaaatgttttctgtatttctaagcagttttcagaattctgtggttgaataatagtacatttggttgaaaaaaattttttatagttatgaactacctaataacgaatgtgattacatggcttttttttcttcgtgactgtattctgaggaagaaatttgaggaatctgagtactgaagaatgatggtagttgcaaaagcagcagccaatttgtattatctcttactttgtgtgggacattgtctttggtgatttatgcctgtgcggtcatctcagcttctcagcaacaactcatgacatacagatgcccattgggatctgtactttacagagaaaaaaaaaagctgtaaacactttaaatttggagccctgatttcttttttggaattccaagtagacctagacactagttttccaattagggttgttgtaaggtctaganttttgtatgttgtggagatgtatcatagctgagtttaggatgacaaaccaccctcccgaataggttacattgtttctttctttttttcttaattatactttaacttctagggtacatgtgaacaacctgcaggtttgttacatatgtatacatgtgtcatgttggtgtgctgcacccattaactcatcacatgtgtcatattggtgtgctgcacccattaactcatcatttacattaggtgtatctcctaatgctatccctccctgctccccaccccacgacaggacccagtgtgtgatgttccccaccctgtgtccaagtgttctcattgttcaattcccacctaagagtgagaacatgcggtgtttggttttctgtccttgcgatagtttgctgagaatgatggtttcccgcttcatccatgccctaccaaggacatgaactcatccttttttatggctgcatagtattccatggtgtatatgtgccacattttcttaattcagtctatcattgatggacatttgggttggttccaagtctttgctattgtgaatagtgccacaataaacatacatgtgcatgtatctttatagcagcatgatttataatcctttgggtatatacccagtaatgggattgctgggtcaaatggtatttctagttctagatccttgaggaatcaccacactgtcttccacaatggttgaactagtttacagtaccaccaacggtttaaaagtgttcctatttctccacatcctccccagcacctgttgtttcctgactttttaatgattgccattctaactggtgtgagatggtatctcnttgtggttttgatttgcatttctctgatggccagtgatgatgaacattttttcatgtgttttttggctgcataaatgtcttttgagaagtgtctgttcatatgcttggcccactttttgatggggttgattttttcctgtaaatttgtttaagttctttgtagattctggatattagccctttgtcagatgggtagattgtaaaaattttctcctattctgnacagcaaaagaaataaccattaaatagacaacctacagaatgagagaaaaaatctgcgaattttgcatctgacaacatacacggaactcaaatcactaagaaaaaacaaataatcccattaaagagtgggcaaaggacatgaatagacagttttcaaaggatgatttgcaaatggccaacaaacatgcagaaatgctcaacatcactaatcatcagggaaatgcaagttaaaacgcaacaagatactactgtaccccagccagaatgaccattattaaaaattcaaataacaatagatgttggcatggacagggtgaaaaaggaacacttatacactgctggttggaangtaaattagtataacttctatagaatacagtatggagatttgatccatgaattccactactgagtatctacccaatggaaaggaaatcaatatataaaaaagacatatttatcacagcacagttcacaattgtaatgatacggaatcaacctaaatacccatcaaccaaagagtagataaagaaaatgtggcatatgtatattgtagaatactactcagccataaaaaagaatgaaataatgtcttttgcagcaactgggatggaactggaggctattattctaagtgaagtaattctggaatcaaaatctaaatccaacatgttctcatttacaggtggtttctaagcttatggatatgcaagggcatacagagtggtataatgtacattggagactcagaaggctggcaagcaggagagaggtgagagatgaaaaagtacctattggatatagtgttcaggtggtgggtgcactaaaattctagacttctccatggtaccgttcatccatgtaaccaaaaaatcactcatacccctaaagctactgaaataaaaaaaaatttttgaagtacattatgtaatgatgaaagggccaattcaccaggaaggtatgacaatgataaatgtacatgtactttacagcagaa

SEQ ID NO: 236567 - DNA, 469 bp, Homo sapiens
tcagtgtccaggaactgggacaatgagataaaagtcaagagacccagcccggggacaaacttagaaggtaaaaatatcaagaaatactgaagcccatgtcccaaaacaacagtcctttaggtggatcacacattctccactacgccaagctctactcagaaactggatgaagcatgagtggaaccagttgtcttggactggctgaaatgagaggtgaggataaaggaacatcagaagctttgagatggtgcatgagatgtatttgatacagtccacctcttgaacagctcagctatgcttttgccttctaagttcaaacaatacacagtctccttcagcgtggtagccaccacaatctctgcaaagacttcatgcaaaggcgttaatgaaccaggttaccatattacttacagctggtcctgaggctgtgattgatattcaataaatttctctttcaccaaccagtcta

SEQ ID NO: 236568 - DNA, 471 bp, Homo sapiens
caaaggttaagattcacagcttcagttagagcagtggttctcaattgagagtgattgtactccccagaggacatttcacattatctggaggtatttttggttgtcggatctggggcatggtaggtgggagcattcatactgttggtgtctagtgggtagaaccagggatggtgttgaccatactgcaatacacaagacagctacctacaagaaataattattcagtctaatgtgtcaatggtgccaagcctgagggatatagcatagtttgagcactgcgaggctcatctaattcccttaacttaaaaatgaggatacttagacccacaggtaggcagtagcaggagtacaatgcttaatttgatatagcaaaatataaaacatatatgctagatgtcatggggcagtgggtgatagtagttttgtaaattcttttttaaaaagcaaaagaaaaaagcacatgacagtaag

SEQ ID NO: 236569 - DNA, 250 bp, Homo sapiens
tgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaac

SEQ ID NO: 236570 - DNA, 348 bp, Homo sapiens
ggaagatatgataacaattctctacaatgtcttccaaaaaatggagacagaatacttcctagttaatcctatgaggctggtataaccctaattctaaaacccaataaagacaggacaagaaaggaaaactacagaccaatatctgtcatgaaaataatgtaaaaatattgaacagaaagatttatataccattatcaagtgagatttattctgtgtatacaaggctggttcaccattcaaaagtcaattaaggtaattcatcacatcaacagcctaaagaagaaaaatcgtatgatcatataagtgaaggtagaaaaagcattagacaaaatccaacacccattcctc

SEQ ID NO: 236571 - DNA, 128 bp, Homo sapiens
ggtagggggaaaaaaaaagtcttaactcctgagcccctgaatgtgtactgaaccttacagagttcctcagagaacccagactcatttagcacaactacctgaagaaagcttatgggattccactggga

SEQ ID NO: 236572 - DNA, 411 bp, Homo sapiens
aacaacctgggtgctttgtcttgtagaatttctcttgtttggattcgactgattatttactgggtgcgttaacatatttttgtgtcccctgtttcctataaattgttctttagcttcagagccttgattaggttccagtttaatgtttttggcaagaatatttcatataagatagtgtgtactttcagctgcatcacattcaggaggcacttgatgtctggttggctctgtgatgttaaaattggtcagtgggttaaggccttgttgcgcttataaattgttcccatcggattttgatgaaagacctaaagattttggcagccattgatgatcattgcctaaattcattatttttgtttctagtaaaaggaccacccctatctgttaaacatgaagcccagaaatatattc

SEQ ID NO: 236573 - DNA, 318 bp, Homo sapiens
cttgccttgctggagaaggggctcaaggcacaggacttgcctcggacttgccaaggaggcttgcaggaggctctttgtctactcctctgtcctcatccaacaaatggttgttccagaaaaaatgcagcaacacctgaactcttctaaagaaaaagaagacaaaatgatctagtgcatctctgccatcctgttgaagatcctatttgaaaaaagggagacacagagaaaggtttttttttttttttaaagtgatagaataatccaaagttaaaaattcaacacaatggaaaatattaattcaatccatgctgcaaacaa

SEQ ID NO: 236574 - DNA, 214 bp, Homo sapiens
caaagtgctgggattacagacgtgagccactgtgccccggccatacacaactcataatggattaaggtccacctaatgacctcacttaaccttaattacctctttaaagaccctgtcagaaaatatagttacatctgaagtacccggggttaggatttcaacatactggaggtgggaggagcacaattcagcgcataacagaagctaacacaga

SEQ ID NO: 236575 - DNA, 445 bp, Homo sapiens
tagttattcccgaaggacacatcatcaactcagcattctcgtagaaaggacaacccaataccaccgtggcctacagggtatttgtgcaaattagaaaaagacacacctctctctcaagacgcttacatctcgggaaattgtctactcaagtggattttattaaaataagtattcccatctgccctaaaactcccagaaggaatgtacagttctgtggtgtcttagctctgagcggcgctccctccaaggcactgccaaccacgacttgcactactgctcggtcccctgcagtggctgtgtgcaggcttggtcccctgcagtggctgggtgcagcctctatcccctgtgatggctgggtgcaggctcagtcccctgcagtggctgggtgcaggctcagtcccctgcagtgactggcagagcccatccgttgttttccataaccccc

SEQ ID NO: 236576 - DNA, 466 bp, Homo sapiens
tctgttgataccgggttcaaggtgttgagtcccagtggtcactctgtgtttgtactttttggatacacactccatgattaactgggtgcagggcattacacagattagaaagggtgatagccttcatccagagatccacaccaaaaagtgaatctcatgccattcataacattgcacacaaacaactcagaaaccagttgaaaagggagacattgaacgaaacattcagtttcaaaatgtgaaaatcaaatttggactttctgggttaaacacatatagggcaagggttgaaagactacctgttgcgctctatgctctctacatgaataacagaatcaatcgttccccaaacctcagcatcacacagtatacccatgtaacaaaactgcacatgtaccccctgaatctaagataaaaatagaaattatttttaaaattgtcaaaaaaaaattaaagatgttatctt

SEQ ID NO: 236577 - DNA, 530 bp, Homo sapiens
cctcgtgatccgccccccctcggcctcccaaagtgttgggattacaagcgtgagccaccatgcccggccaaattttgcttttcttataacatccatatctaattgtaattcatggtcaagatactttaatacttaagtcatctgttgagtgaagggtactaacagtaattaaacagcctgtcatttaggggtttagcatgcacctaaaagtattttagaagtgtgtcaccgaaatgaaagacatttaggtggcactagcttcctgaagactgaaagagtaaccctacccacgggaactgccttgccttgggtagatggtaggtggcagcaacagaccagaaattatggttaactagagcgctagacatgttctttttaatgttattctatcatttttttccaaaataaaataatatagctgcaaaccaagtagatagtaaaaataaataagcatgatgtgactaatttgcataatacaggctacctaagcctttatttattctataatctttcaacagcaatttattttt

SEQ ID NO: 236578 - DNA, 277 bp, Homo sapiens
tctctttccaggaatgtagtaagactgcacgtcactgtcccctttgaagttaggtttgaccatgtgactcactttgactgatgaaatgtgtgcagaagtgacctaagtcctacctgagtgaaagctttaagagccacaatatgctacattctcctttactgctgccttcgagattgtgtgagcagatgtcaagatgggtcttgtcagcatgcttcccccagtgatgctgacgagcagagcaacagagtgcaagcaaaaataaaagatttgctgggtg

SEQ ID NO: 236579 - DNA, 290 bp, Homo sapiens
tgatagtttcttgacaaattttttaaattgtagttttataggaagttatcttttaatgaaaatctgttttcaagcacttagaaaattaaatgtttcagtatcaatttaaaactattttcttagaactaatttagagatacagtttctacttgcattgggaaatgtaccacgttttctttttatgacttgataaagataaattatgtttatttcagatagatagagctttattcttcagtttctggaaataaacttatgaagaattaccttggatgttcttaacagatgtt

SEQ ID NO: 236580 - DNA, 365 bp, Homo sapiens
catttagtttcaactccattccaattaagttttacttccttttataagtaggttgactccagtcatgagaagtccacaggcattttggtataataaattgtattggttacctttagtctttctagagggaataaaagagtaaagacgttagacaaaccagttagaaaactgataatagacccatgcacataccctcagttggatttgtttttattgtaccagggaacattatacagaaatttatctagagctgggcaaggtggctcttgactgtaatctcagctgctctggagcctgagatgggaagattacttaagaccagaagttcaataccagccagggcaacataccaagacccagtctac

SEQ ID NO: 236581 - DNA, 150 bp, Homo sapiens
tatggagcagagacatgagaattcttattgtacagaagcaataacaaagctttattataagttacacagaagacagagggcccttggtttatttcactccagtcctgaagcaggtgggatactccctgctgcctacagttgactctcctc

SEQ ID NO: 236582 - DNA, 455 bp, Homo sapiens
gcctcccaagtagctgagattacaggttcaagccactatgcccagcagtcaggctacaagtaatagaacacagtactaagagagatttaaacaacaggagatttgtttttttcacttaacaagaaatcccaaggttccagggttgattcagtgcctcaagaggtttttggcgctgggcgcagtggcttacgctgtaatcccaacactttgggaggccgaggcatgtagatcacatgaggccaagagttcaagaccagcctggccaacatggcagaaccccgaatctattaaaaatataaaaattagccagacgtgagtggtacacactgacaatcccagctactaggtaggatgaggcacaagaatcacttgaacctgggaagcagaggttgcagtgagctgtgatcgtgccactgcactcctgcctgggtgacagggtgagactctgtctcaaa

SEQ ID NO: 236583 - DNA, 239 bp, Homo sapiens
agaaacttagccacatcctggtttgtgttttgcctaacagaggggtttcactttcctctttggtaagatgaatatgcttgataatagaatagcattaaggttggcttttttctccctcaaatgattaaactgtagtttcatatgtaaatgccagtaaattagaatcattctagtagggaagataaagtaaataagtaaaaatatagtatgttagtaggaaatcgtgctagagagagaga

SEQ ID NO: 236584 - DNA, 619 bp, Homo sapiens
ccataatgaatgggtttgtgtatatgtatcatgccatgtatgagtatttctgtaggagaaattcttagaagagtaaccgctgggtcagggtgtatatgcattttgaattttgatagatttgtccaaattgccttcccaaaagcctgtactaatttacactctttaatgttgtgcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttac

SEQ ID NO: 236585 - DNA, 421 bp, Homo sapiens
tgatgtgtgttatgacccattttaagcctcccacgatcacagtttttaaaataaaattaaggactggtccttttctaggtgacacaagtaaggtaatagctagaacagaagaaagaggggcccccaaaaatgtaaccttaaaatttgacacttgtgctgctattgatagtaagcagcatggaataagatgccgttctgtaaactaaaaaaaagttaaacagttaaaaaaaaaaagtatatctgtcaaaaatcatatttatgtgagatgtgtcaatactggtcttgtgtcatttaggctacttgaaaagaggattaaaaaaagatcttgtttggctctgcaaaggaaaaggcagcccctcctgcatgagtgggagctgcaaccctttaaaattagtaatcacaaacccctcagacccaaaat

SEQ ID NO: 236586 - DNA, 464 bp, Homo sapiens
cgcaaatgtctgtacaatctacagtcctccgctctaccagctgagctatcgaagggtgcacgctgcaagagctggatcactggactttccgcaaatggaggaagccaagtccttggaacgctggagtcaacacacttagagttgattggaacccgccttagaagagaaccttgcgctggttgccaccgcgcacctctcagggtggagcaaatcctccgagtgtggtttcctcgcgtcccagagcgctgatagccacaatccaggacgggaggctctcgcctgtggccttcctccacctgtgcatctctgtttttacaagtgaggatgacagccctcagcgaaagaaaacaagagggtgagagggctcggtcagagggatgggctaggtggatgggtggatcctgtgggacaggggttgcaggaggaggaaagaagaactcggaaagcttctgggtgggcggccg

SEQ ID NO: 236587 - DNA, 549 bp, Homo sapiens
ttgccagcaaaaccagcagcagtgccagccccctcccaaatgtcctcccaagtgtaccccaaaatgtccacctaagtgtccccccaaatgcccaccacagtgcccagctccatgttcccctgcagtctcttcctgctgtggtcccagctctgggagctgctgtggtcccagctctgggggctgctgcagctctgggggtggtggctgctgcctgagccaccacaggccccgtctcttccaccggcgccggcaccagagccccgattgctgtgagagtgaaccttctggggcctctggctgctgccacagctctgggggctgctgctgacctgggctgcagaagagctctggtactgaatggtcaaaaacctgctacagcctgatgcttaactatttccccttcctttcattccactcatgggtggacagggaccacaaagactcatggggcttccccagaactttgtgcttgatggagcaccccagatggaagccttctttttctcctttacctcatattgtaataaagctctgatttctgactcttta

SEQ ID NO: 236588 - DNA, 457 bp, Homo sapiens
acatttgtcattgaaaataatgtctataattttaatgagaatattatttagctaacaggagcaaaggtaaaattatatacacaattaacataaattttactgttagtttctttgttgtacaacaatctcagtaaaatattagaatttctaaaaagatttagaatgtgatcatttcagatatttcaaataaagaaaagtagatgtttacaggctgaatactgtcaatgactaacaattacactgcgtggaaactgctccgttgctctacattatgtaaagttctccaaaaaagcccattccctaagagatatatataattcaaatggcaaaagctgttacaaactactttcaataataaatgtattaataagtttctataattattttaataaaatgtattgctggtaatgttacatattatttgcttattaaatgtcttagacaattgatatttaca

SEQ ID NO: 236589 - DNA, 2376 bp, Homo sapiens
gcggggaatgtaggcggggcttaaaggccggggtaccggggtggggcgcggcgcgtgggcggggctcagggcccgggatataggggcggggcgcagggcgtggacggggttcagggcccggggcccagatgggcgggggagcggccggacgcgggcggggcgggcgcctggacgcgagcctagggcgcctcggtgcccagacggcggcggcgtggccgcacgcgcggcccggcttctgtcctcgcggcgctccggctcctggccccccacgccatgcagccgtccccgccgcccaccgagctggtgccgtcggagcgcgccgtggtgctgctgtcgtgcgcactctccgcgctcggctcgggcctgctggtggccacgcacgccctgtggccggacctgcgcagccgggcacggcgcctgctgctcttcctgtcgctggccgacctgctctcggccgcctcctacttctacggagtgctgcaggacttcgcgggcccgtcgtgggactgcgtgctgcagggcgcgctgtccaccttcgccaacaccagctccttcttctggaccgtggccattgcgctctacttgtacctcagcatcgtccgcgccgcgcgcgggcctcgcacagatcgcctgctttgggccttccatgtcgtcaggtgggtggcggtggcgctgcttttccaggagcccccgacacaggccgacccctcccggtcttgccctcccagaggccgcgtctaggttggacaccccctacccacagcaagcagtgcctgctggcgcccccgaggctgtcctgggccagcgggaggaggccagccttgcccgagattcgctccctcccgaaggagccccgctgtgcctgccccagggcacagccccttggggtagtggggacagagttcgcccccagagccgggccctgtttccttggacggggctggggaggacactctgagccccttgtgacctgcttcactgtgtcctggctgtctctgctgcccatggggaaacaggctgggagacgagttaggtaactgtcccgggctggagagccggcaactgccagtcccacgccaccaccccaccccaagccacagtgagcttggtgcactccgccactcccgagctgccgtgtctctgctgtacagtttacaaaggactgtgctttttattctgtctttggtcgtttctagcctcaggccccagccccttgtatttctgttctagatgatcttgactttccagagttcagcaattctgagattgagggcaggggcggagggctggtctgggagtctcggagtcctcctggagtctctctgagagtggggaaaagccaagaccttactttgcgattcaagcgtctttcaagtaagcctcgctgaagagggtcggcccttccctggggaatgtcaggttttgaaaatctcatggcgtcctgtgctgtgctgaactgagggcaggaatcctaggggctgttttccttttctccttctcccagatcagagcatcagatactgccctaattataggtcctttctattaaaaacttaagtgcattccaaggactgcgagcacagtcagcactttggcagagacaggtcacctgggtgtcacacggcaaggctacagggctgtaagagtcgcttgaccttcagttgtgcactgaggccggctggtccttgagaaactaagtgacctgcttctcagctgtacaagtaaaaaatctttgcaacacatcatccaaaccgaggctcagatgctgcagatggaatagggccctgccttgccttgccttcccggcagcatcccatctgaccctgtctgggtcccgtgatggctggctgggtgtgggccccgagtacacgggagatcgtgtgtacttggaaggagtcgaggctgtacctctctttgcaagaacctgttctctttcccttcttgtctttaaaaatattgaatacagtatttttttaatggtaacagaacctggtccagcttctgtggaaaagaaggattgcccagcaaacctgagttgggggtttttctgttcggttctcattacggaccctctaggggggtttctgtgttgttcaggaagggcttctttgataaagaagtaggcccagtgtggtggcttgtacccgtaatcccagcactttgggaggccgaggcgggagcatcgcttgagcccaggagttcaactggccaacacggtgaggctttgtctctactaaaaatttaaaaattggctgggcatggtggcgcatgcctgtagttccagctacttgtgaggctgaggtgggaggatcgcttgagcctgggaggtcgaggctgtagtgagctatgactgcagacagagcaacaccctctctc

SEQ ID NO: 236590 - DNA, 514 bp, Homo sapiens
ctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgc

SEQ ID NO: 236591 - DNA, 588 bp, Homo sapiens
tgcctcatccccgtaagctaaaactgttaaacaaaatgaaaatatttagagcatataacagcctcttttgctggaaggttttatagaaataaagttgccagcatatttttagaagagtaactgctccctgacaccagaatggcttattttgaaaaataagccaaaacaaatatacccttagataggtgtctataatattccagcaaagggattgggataggaaattcctacccatccctgtttttgctttggatgaaaacagtcttaagaggtttcaattgatggaaaagattagtatacatcatttcattggccagacgtggtggcgtctgactgaaatcccagaactttgagagccccaggcaggcggatcatgaggtcaagagatcaagaccagcctggccaacatggtgaaacctcgtctctactaaaagtacagaaattagctgaatgtggtggtgcacacctgtagtccagctactctggaggctgaggcaggagaactgcttgaacctgggaggcggaggttgcagtgagccgagattgcgccactgcactcagcctggcaacacagcaagattccttctc

SEQ ID NO: 236592 - DNA, 486 bp, Homo sapiens
agcttcaaaatccttactctgacatatactcacagccagaaattagcatgcactagagtgtgcatgagtgcaacacacacacacaccaattccatattctctgtcagaaaatcctgttggtttttcgtgaaaggatgttttcagaggctgaccccttgccttcacctccaatgctaccactctggtctaagtcactgtcaccaccacctaaattatagctgttgactcataacaatcttcctgcttctaccactgccccactacaatttcttcccaatatactatccaaattagtcttttcaaaatgtaagtcatatatggtcacctctttgttcaaagtcttctgatagtttcctatatcatttataataaaaccaaatccttacaattctctacaatagttgttcatgcatatattatgtttattacagatacgcatatatatagctctcatataaataaatatatatatttatgtgtatgtgt

SEQ ID NO: 236593 - DNA, 978 bp, Homo sapiens
  misc_feature (569)..(569): n is a, c, g, or t
  misc_feature (688)..(688): n is a, c, g, or t
  misc_feature (697)..(697): n is a, c, g, or t
  misc_feature (700)..(700): n is a, c, g, or t
  misc_feature (710)..(710): n is a, c, g, or t
  misc_feature (731)..(731): n is a, c, g, or t
  misc_feature (752)..(752): n is a, c, g, or t
  misc_feature (755)..(755): n is a, c, g, or t
  misc_feature (772)..(772): n is a, c, g, or t
  misc_feature (781)..(781): n is a, c, g, or t
  misc_feature (785)..(785): n is a, c, g, or t
  misc_feature (814)..(814): n is a, c, g, or t
  misc_feature (831)..(832): n is a, c, g, or t
  misc_feature (844)..(844): n is a, c, g, or t
ctcattttgatgtctagaatcaggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtccccngcctcccangtngctgggactncagtgcccaccaccacacccngctaatttttttttttttttngtngagacagggtttcactntgttggccnggcnggtcttgaactcctgacctcatgatccgnctgccttggcctcccanngtgctgggattncaagtgtgagccaccgcgcccggccaattccactgattctaaaatggccttaagtgaaattaatcacgtaccaaaatgccatcctaagaagtcccagaactatttaggttaaaataaaatatgaaatgacctag

SEQ ID NO: 236594 - DNA, 887 bp, Homo sapiens
  misc_feature (613)..(613): n is a, c, g, or t
acgcctatttacggtgttctgaatgaaacaggacactaattactattggaaccatttttctctgttttgaacagttggataagggaagtcttgacgtgctgcctatgtgtccgctgcccttcatcaaagttgagctactgagaaattggagttgaaggaacagtggctaatggcatgtgctgggatgcaagtaagacattatgcttgggcataaggagttctggtattttatgtatacctattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 236595 - DNA, 2778 bp, Homo sapiens
  misc_feature (2504)..(2504): n is a, c, g, or t
ctcattttgatgtctagaatcaggggatccaggatcatcaccaaggtcattttcccaggtatggaggggtctttctgcttctttcttgtcatgcacagctgctgaggaaggggctgggagtaaagacagtgaaatggggaggaggagtccattcaaaccgagaaacaaagtgtttggtttttcttacccctggtgtagaagctaccaaccttttccaagaaagagggcctggcccccttctcgggtctggctgggtgcctgctgtgcctctctggcctcccctccgaagggcaccattccctcgggtgagtactaccggcctgcaccgtcttccagtggggacagcctgagaagagagtctggggccttacttcagtaccttccttcactggcctcaccctgtgcaaatcatgccacacgctgcagcctccttttccctatctataaaataaaaatgaccctgctctatctcactgggctggcaagaacacactgttgttgccttgcagacagatgtgctgaggctgtagaaagtgctttttatttggttgggagcttgtgcataaatgcgagaggggctgcacatctgacggactagaggtgactcatggctgaaccggaacaggacatcggggagaagccagcagccatgctgaactctccacagggccctgtgaaaagctcttcacctcctctgccctctggatctagtgaagcctattcatccttcagatgtcagctcaaataatcaaccttcatggaggcctcccttgacccctaacatgctttcaaagtactgtgtatttcacattcatcatgccccgacaactgtgatttcccatttattaatatctgtctcttctgctggcctgcaaactccaggagcacagagacatctttgggatttttgaacatgatttccccagggcttagcccagtgcctggtgcaaagcaggctttcaacatgttcagtggatattgtaagaaagaaagaaatacacaaaaggcctggcatatgcaaagcactctaaatattcactcctttcccttccctctgggtgagaaaatttctccttataaagacaccctcctaactgtatctctgctagagaactgaagacataaagcactctgtgccaaaaatatttaagtaaaaacttgagctaagcacagagattataaatatttcttccccagattacgcaccatttaaaaatactgtctcagctccttttcatgatttgggtggtgattaaagaaaattactcttcaagactgaaagtcattactgcccttttcctgacttgccttttcccttgagaaggggaggataagctgcagggcaggaagtggaagtggggcatccttgtcctttgtctggcagacagccaactggtcaggtactgctccttctcaactctttcctgattcccaggtgaatataaacaagaaggcacaaatccacacttgccaacaacggacccaagtgataacaagaaacccagtgacacctgtctaggtgaagactcagcccctatgtgaccaggttgcaaagccaaactgaccatctgctttccatttggacttttagttcatactgtatcttctcaggacagttaagttggaatacaatgccactgtcctgaaagatggtagaattatcctatttctggaggagtgggggtggtgggtaggaatctcaagagcgatttgctcctctgcacaatagcttctttaaggacaccagggcccccagggctatacatttccctgaagctttccagataagcaacaaggtatgagcacctgctatgtattgcccaagggtgatgtgtttaaatatccattgcatattttaaatccttggctggcttaaagctgcaagctttctgtcttcagtggatataatgggggcatacatcccagagcttgcccaacactccaagaaaagaaccctcagctaatgcaaagtgtgtatgtgcccatgaaagctccatgtctacttaacattcagtttttaggattatttatgctgtaataatagatatgaaaatctctgacaggtattttgtttcctttacaaactgtatttgaatttatgggtgatttagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 236596 - DNA, 642 bp, Homo sapiens
gcttaccaccccttccgccgtctggccatcttgcctgcttcagcaccaccagccacctcaaatcctgatccagctgtgtctcgtgtcatgaatatgtctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccaggtgacttggcacaagcaga

SEQ ID NO: 236597 - DNA, 741 bp, Homo sapiens
aaaaggaaagtgcatgtcctggtgatggatggtcagcagcaacattttaaaacagagacagcacattttacttagatgacatcactgagagtatgaatataataccaacttggctttagaactgctctctctcctctgtccaatgactacagtctgcaaaccatctaaattccccacttcaaggaacttaaagtctagcaggggaaattttacttacacgtgagtaattaacaaataacttagaattggcttaataccagaaaagggtggtgcagacctactgctatagcggtaccttaagagaaaagagaaatagtagagccttggatgatcagaggatcaggaaagtcttcatgggttgaagtgaattaaatcagtctcagagactggaaggattctgataggcaaagagaaagccacataaaggttcagctaagaagtgctcatctactgtttggatacatggtgaaagatcatgaagaaacttgaatgtcagacagtgagatctgtttctgatctgttaatcatttctctttcttacattctccatatctgttgccccgagtccccttccaggaaatggtctgtttcctgggtactaaaaggattgtcaactaaactgagaaaaagttttctgtgcaagtacaatttttcctcttccaaaggaatttgccttttagctccggcccccattagataattatgaacaatttggaaagtttaagaatataaaaaggaaaa

SEQ ID NO: 236598 - DNA, 90 bp, Homo sapiens
ctgagtgaaaaggtcagagttcctgtgtgccccctgccagcccccagcttcccatctgttgctgtcaatgaaccagtatcggtgctcaca

SEQ ID NO: 236599 - DNA, 446 bp, Homo sapiens
caggaaagggaaggcatttgaggacacttaacatgtgatcctgagtgacttgtagataggctgggcaggagggcccccatctaattgacattagacacatacctgctgcaggtcagcctgggctgtgacacacaatagcctcgataagtgcagatagggctgggtgcgatggctcacgcctgtaatcccagcactttgggaggccaaggtgggcagatcatataaggtcaggaatttgagacgagcctggccaacgtgatgaaaccccatctctgctaaaaatacaaaaattatccaagcgtggtggtggttgcctgtaatcccagctactcaggaggctgaggcaggagaatcactcgaacctgggaggtggaggttgcagtgcaccgagatcacaccacagcactccagcctggttgacagagcaagacactgtctcccaagaa

SEQ ID NO: 236600 - DNA, 501 bp, Homo sapiens
tcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccaga

SEQ ID NO: 236601 - DNA, 1762 bp, Homo sapiens
aattaaaatatccagttagtctttattttcaagttcaaaaccttattgcgtactgaaaatgcatgaactactggacacttttacaagcttactttcacaggagtctggtaagatacgtgctattctcatatttttctcactagagggaaaacataaggcatagagagagaggcttgctgagtctggcccagatcaggcgcgttcattcggccgacccttgtgctggctgtaccctgcactgtgatgctctctctgcctcccacatggctgccagagtcgcctttctgagatacagatactgtcatatttcaacttaaaaccatcactgtctccaccatggaataaaggccgctgtctggagcatgcattctcggccttgggcagggccccagcgtcctcctccggagttgggagctgctggccctgcaccgtgccggccctgggctgcccctgctgcttgcccttggagtcctgccctgctcaggctcagcactcagctgcctctgcagatgccctcctcaggggccctactctcctggccacttcactgaagaattggccatttcccgccttgtctgcaatgctttattctcagccctgtgagcctctgccagggcctggctgacaatgcttgcatctggcccctagcatctctcacagcgtcttgaaccccggtgctcaactgcctgagattgaactcagtcaaaccaactcagcctcaaatccaagtgtccagcttctttatgggaaaagcaaaaccactggttctgtggggacacatattctctgcagatacagtggatggttcgaggtctaagggcatgcgaggcctccgtgctgctctccctttagtggatgccagccacctgctgtagctggagcccagggtgggcaatggctggccactgcctgacttgcagacctcccaaggtatcctcaccatcccaaggtcatgacaacctcgcacacttctgcccaggcctaagcaggaggggggcctgtgtgggagagagggcctagcacctcactcatcagagctgtgtacatgaccacactgctgtgcttcagggaggcccagtggctggatgttgagctttgcagacaccagtcaagaatgatgggtagttgggcgcgacaggagaggattcagaatttgccatccaaagccctgtgagacacaagactaaggcccagtgcctggtgcagttctgcctttgacattgtgaggggcgcaccttgggaacttggagcacagggatcttccctggaaatagtctcaggtgtcacttgtcaccctgcattgggacttcatgagactgtgaataactacagtaaaccagatgtgcaagaagccagagtctaggttatagttacttcagactctgtatttaaagattctctcttttttttcttttttttttttttgagacagagtcttgctctgttgcccaggctggagtgcagtggtgcgatctcggctcactttaagctccacctcctgggttcacgccattctcctcaactggaggattctacgcctcccaagtagctgggaatgcaggcgcccaccaccacgccaggctaactttttgtatttttagtagagatggggtttcaccgtgttagccaggatggtcttaatctcctgacctcatgataccccggcctcagcctcccaaagtgctgggattacaggcgtgagccaccgcgcctagcccaaaagttctcttaattaaaaaaaaaaaaaaaaaaaaaaaaaaca

SEQ ID NO: 236602 - DNA, 460 bp, Homo sapiens
tgagaaataacttagttcagtatctttaagatttattcaccttgtatttgcactgatcacatacattgaactgcaaactggagccaagaactgtatttctgaagctgagctggtgatagacagactgtctctcagtccttggagtcaatccagccatcttaaatattgaaatgtttctttatgatgctctagagacattttcatcatgctgtattctttaggagcagctgaacctaacaattgcatctgaatgtttttctaagacaggtaaattctcttagtaaaaattacttgaaatgctggtatgaatgactgacagaaaacacctacatggacatttaagaaatataaataaaatacacctggtgaaaaggggaaatatgaatattttaacttgacatatctgtataaaataaaaatattttattagataaaataaaatataaatattttaacttga

SEQ ID NO: 236603 - DNA, 781 bp, Homo sapiens
agccccggttcccgcccgcgcctctccctccacacttcgccgcaagcagagggagccggctccggcctcagctggcccagagaggggctccctcagtgcagtggcgagctgaagggctcctcaagggcggctggagtggacgctgaggccgaggagacgccaagagcaaacgagggctgctagtacattgtcacctctcactggtaactacagttgctgtcagtttaactgttgatattctggaagcaagatcttggaaggccaaggacaggtcatttcttaggactgtgcaaaagagaatcagtctttacagtaagctatttgattctagtagttctttcatctcagtcttttgaaagcaacttcccctctttaaccaacacctgccatggcctcttcatgagccgaagaaggaaagacaggacagattcttatgacctgaaacagcacctcaactcttaccttggatatttctacatgaagaatctgctctgaaactatagcaaacaatcacagagtgtttgagtgtgagtccagactggttcgggaagaccaagaagcaatgatgatgtctgtttttgtcaaatgtctgaaaactatttttatttttctaaaactttgttcagaagtctcaatattgtagtgtatagagatgtacactaatttagtgatatgaagatgaagggctttaagcctgtgttccttgcaggcatctcagtacctaggaactccaaagaacaaactgttgctcgtgcaaaattaaatttcataaaacagcaaa

SEQ ID NO: 236604 - DNA, 370 bp, Homo sapiens
aataattattgtgtttattttttcaaaaattaaaaaaagcaaaatggcattagactacattaggaactagaggtgctacttgcatgctgtatggacagttcacttctctttgtctctgtttattgaactctaaaatgaggtacgggagagaaagtatcctaacgtatcttcactgcctaagagtctattatcatatgtcaacatctatagcaatttgatcctacctagtgacagtaccactgtggttgtcaactctacaatattacagataaagtttaggaagaactttaagaacattaagttggccaagttaaagatctgctgagtgtatgtgattaacaggatgccttttgaaataaaaagatacttc

SEQ ID NO: 236605 - DNA, 408 bp, Homo sapiens
tttattgagtgattgtgtatggattataagttgtgaattgggaaggttgtaggaaagaaagtctggtcatttctttagagaaagattttacttctgatttgtgcgttcttgaatgggttcctaggactattaggatttattcatacaaaaatagaaatgctagacttaggaaaaagaaatttttatttgtttgtttgtttgtttgtttatttgacagagcgagacccgttctcaaaaaaaaaaaaaaaaaaaaaatccaaaaattagctgaggttgtggtgtgtgcctgtagtcccagctactcagcaggctaaggcaggagaatctcttgaacctgggaggcggaggttacagtgacccgagattgcaccactgcactccagcctgggtgacagagactctgtctca

SEQ ID NO: 236606 - DNA, 489 bp, Homo sapiens
gctttgaccttcttctctttgtctattcatggagaaattcaccttgggcttttgggacagtatctaacgtatagaagcaagaatggagagactccagcaagctctttgccttatgaggtccctttcataaggggtggaatacaatttaaatgagctaattgatatttcagggtatgattgcctataaaatatgggttgtgcactaaaatgaagaggactttgctttcgtaagattaagaatcactgagttagataaagttagacaagtctgttgcaggacttctcagagccttcattacgcttacacacattttagtctctatggagtgaatacggtacatactgtttctcaacttctttcaaccacaaaacacctttctcatggagtatcttctaatagctccccaagttattgttctgtggaacaaagtttggaaacattagtctcaaataataatactctctatattatttccattccccccagcc

SEQ ID NO: 236607 - DNA, 449 bp, Homo sapiens
tctgcaggcataggaggttgggcttcatgcagaccacaatcaaatccttgctctgctgctttgcttgctgggtggccctgggcaaatcacttaacctttttgagcctgggtgtcctatttccaaaaccaagtcagaaataagaaagttactatgggcctggcatggtggctcacgcctataatcccagcagtttgggaggctgagcccagaagatcacttgagcccaggagatcaacaccaacctgagcaacatggcaaaacccaaactctactaaaaataacaaacaaaaaaaaaatatggggcatggtggcacacgcctgtagtctcagctacttgggaggctgaggtgggagaatcagctgagcccgggaagtcgaggctatggtgagccatgatcacgccactgcactctagtctgggcgacaggagtgagaccctacctcaaaa

SEQ ID NO: 236608 - DNA, 471 bp, Homo sapiens
agtgcctgttttctataatgtcagagatttaaggaatttaaagcttatttctatttgggtgccacatttgttttcaaaacacccaatactgaggcaagagcagtatttgccaagtagcaaattcaagagcaaaatgttttggcagtcatattgcctggctttgcccagggttggtaccactgtccccactccaggaatggacaacctgttataacaaaagtaactgtgtgcttattaagtgtcaggtcttatggtaagtgctttaaaatgcattagtctttcaagaacccagtcagaagggttttgtcattactattttctgatgcaaaaaaaatgaaattaaagaagattaaataatttatccaaaataacagttagtgggtgtgatgaggtgctccctcagctatcaccctaaaaaatctaagaatgccagttcttctcagctttcagtttggagtaggcaaacatgta

SEQ ID NO: 236609 - DNA, 290 bp, Homo sapiens
gagacggatcttgccttgctgaccaggctggactcgaactcctgagctcaagcaatccaccctcctcggcctcctagtctagtcattttttttaaatcctaaactcaatatggatcttggctcaaaaaccacatatcagcagttaaatattcctatccaggaccatcttgcagttcatctgctagcagagtaacagagaaaaatattgaccttctaaaataataacgtgcctcaaaatccgttactctttccacaacaattgagggtaatggtgttcagttttcctttta

SEQ ID NO: 236610 - DNA, 492 bp, Homo sapiens
ctccactttatatatccatctgatcactttgtggggacactagacctgcatatgtgaggacaaagaccccagacagtggttttcaaaataaggtgtgactgctctgtgtgactctggcagaaaatgatcagctggcctccctagtggacaatctgttcctcatagctacaagtgcaaaaacatcttctctcaggccaaaaaaagaagaggagaaaccaagtcattcctcagaaataaggaaaggatcacaacttggaaatcatgggagtaagaggagagaggaaaggaggactggcccctgatgggagagctcagaaactctcgatggagtcttgttggatttttcaccctgctctttaaactgctttctctcccttaaatgtaccacatcaaaaacatctgccatttaaatttaccacatcttggtctatatgcacatcaaaaacaaacaaacaaaaaaaacaaaaacaggtaataaatacagtggagtta

SEQ ID NO: 236611 - DNA, 441 bp, Homo sapiens
tttaggggactaaggttggctttatggaaccaataaagtaccatcttggaaaaactggctctagggttcccagacttacagtccttcaaactgaaactggatgacttgacataagcttcagaaaaattaccacaacagcttgtgtgtggcccatctttatggcattcaaactgcaaactaatccaatgcctcttctcactccagctgaagatactacaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggttcttaatgaataaaaggtgatcaaacaaga

SEQ ID NO: 236612 - DNA, 1687 bp, Homo sapiens
  misc_feature (1068)..(1068): n is a, c, g, or t
aaaaaaaaatggctcctcccagccttgtgctgtcctcccctggccaaggcccggcttcaccatggagctggtgccgtgctcacgggccttcccagttcccacacctctcttctcatagctagtggctccagtgcccctgcaggccaacccgtaacaactcagctcccaagctgacccttacctgtctgtaaaagccttcccttccaatcagcatccggtgtttataaccacatcctgagccaggtgtggtttccccagaaatgctacccccttgacatgctctatccaccttgatcacacccctcaccggctctttgacctcctcaaaacctccctgcagaactcctccttgtcttctcactctggcagccacccctgtcttcacttccttctttacctggctccactgagagacctgagccctggggaatgcaggtgttgtgcccccctctgccctcccactggcccagcccttggatgcatcattagagatgggtgccagctcacatgaggacccactaccttggctcggccctcttcctgcattcatccttctaggggccccagtgagcacacaggttcttcaggaaaaatgcagctccttacccctcctcttcagcacctgcttttcatagagaaccctccttctatcttgcatgcatgacaggggtcccgtggggccatgcacccagcttccctcctctctccctggccatgttccagcctgggggtggaagaacctgcccatttcccatctcttccagagtctccttcccccaggaacccccttccctccctagtgcatggtttctgctgtcccttttgctccttcccttcagtctacaagttgcccaaatccctgaatttctttcttcctttttcttttttttttttttaaaacaacagaaggagccctccccagaacactgagagggatgcattattattcctttctatggatggggacacagtggcttagtggggaaatagctacccaagctcacaactatctgatgaaagttggaggcaggttgggagctcagccgcctgactccctgcacatgcctncaactttgagtcaaaggcggggaaaagatgcagcccttcctgggtgtcccatctttggtgcagggttaaggaaggagccttgggaccaaatgaagtgactgccagtgcaagtcatctgaggctttaagctgcttaactctcaactcctcggtattttaggtaccatctgtcttcccatctcaattatgaattctccagggactgtcacttcattttttttttttgtctcttaggatgctttgtgcatagctgatgcttagtaatgggctcttattcatctagaaattttttttgcctttaacttcaacctggaaggcttttaaaaaacatgattagccaggcgcggtggctcagcctgtaattccagtgctttgggaggctgaggtgagaggatcacatgtggccaggagtttaagaccagcccaagcaacatagctagaccccgcctcttcaaaaataaggatgaaaaatttagccaggcatggtggtacatgcttgtagctccaggtactcaggagactaaggtgggaggagtgtttgagcccaggtgtttgtggttacagtgagctatatcgcgccactgaactccagcctgggcaacaggatgagaccctgtctc

SEQ ID NO: 236613 - DNA, 471 bp, Homo sapiens
ttggtagttgtgcagccatgtgaatgagtggatcctaccatcctagtcaaacctctgataactgaaggtcccacctatatttgactgcagtcttccaacagaccccacccaagctgctctaggattcctgacctacagaaactgtgagggataagatatgcttgttgttttaacccactaagttttagagtgatttgttacacagcaatatacaacaaatacacaagtcatcacaagtaatatttttattaaatatttgcatagtacaaacctgggtctccatctttgtaggctttgatttttgttttttaccaatcactgactgttaagccacatattttaagtttttgttacaatcacacctaacctcaatgtaccaatttctgtaaatagataatgctaggtaccgtaaccgataaatcttgacatctgagtggattaatacaataaaagtttatttttcatctcatg

SEQ ID NO: 236614 - DNA, 988 bp, Homo sapiens
aaaggatcaacaaaatgaaaagttggttctttgaaaaggtaaactaaattaataaaccagttgtgagactagccaagaaaaaaagagagaagactccctcctccaaaaaaaatcagaaacgaaaaaggaaacattacaactgataccatagaaatacaaaacatcagaacattgcatacctgtatcaaaacatctcatgtgctccatcaatatatatacatatcatgtacccacaagaattaaaaaaaatatataatcagagactattatgaacaactatacactaacaaactggaaaactgagaggtaatggataaattcctagacgcatataacctacaaaaataaatcacaaataaatagaaaacctgaacagactgataatgagtattgagattgtctgagtaacacaaagtctttcaacaaagataagtttaggaacagatggcttcactgccaaattctaccaaagtttcttttctttacataaaattgttttgagacaaggtcttgttatgttgcccaggctagtgtcaagttcctgggctcacaagatcctcctgtttcagcctcctgagtagctgggacttcaggaacatgccacatgcctggctcaaattctaccaaactttcaaaaaagaactaacaccaatttttctgaaatgattccagaaagtttaagaggaagaaattctccctaactcattctatgaagccagcattaccctgataccaaaccacacaaagacataacaaaaaaagaaaactatgggctagacctacccaacattcctgatgaaagtagatgcaaaaattatcaataaaatactagcaaaccaaatccaacagcacatcaaacaaacaaaaaatacactataacaagtggaatttcttacagggatgcaagggtagttcaacatatgcaagacaataaacatgatacatcacatcaacagaatgaaagacaaaaatcacatgatcacctcag

SEQ ID NO: 236615 - DNA, 135 bp, Homo sapiens
ccacccccccactctccgaggaggcgccgccagccccgcccctcccggcccggcgggtgacgtggccgcggctctcccgcgggtgggtcacgtgttggcggcgcctggttgccttggcagcggctgcggcggccg

SEQ ID NO: 236616 - DNA, 257 bp, Homo sapiens
caacattttatccctggctgaggaattcatcctgggagtgtgggctccttcagaggctgagttgccttgtccaggtccccctgcaccccgacttcttgcctcaggtgtcatggtcctaagtggcctgacagggtagagctctctggatggtacagaagcctgaaccccaggcacggtcttgcccacaacactctgcagacctgagtcatcccctcatcccctactccgggctggcaggtgaccaatgtagggggcca

SEQ ID NO: 236617 - DNA, 235 bp, Homo sapiens
ggaaattcagatggcattgtcttaagaacagcccagacacgtttatatagcttccgtgctttatgttaatgtaagaatgaaaaacaaactgtctcgccattttcagtctcaataccaaattgtgtaacactgaacactcacccttgggtttctataacatgagaaccaaggagtggaagggacacataggagagagtcgcaaaactcaccaccaaattgcaactattctgatgcc

SEQ ID NO: 236618 - DNA, 528 bp, Homo sapiens
tcttgggtccaccttccttgctcattgcatgccacatcaccacgccctacttgtttctgtgttccatccagtcctctcttagtgccctggtgtctggagctcagagggtgcttcctccctgcttgctgaatcggattacaggcagcaggggtttttgctgtaaggaaaggaaagggagactctccttcagtgccttggtgtaggctgagacaccgaggccccctgggaaacacctacggatcaggacctcctgcacaggtgtgatatttatcctggaagcaatgtgtacatggaatgccctacaggcacaggaggcatccctggagactgaatggtgtctgggaagagtagggccacagagctgagcccctatggactgcagcagagggcctggctccaatcctagcctaccatatcccagtcccatgatcctctggtcccatggagtcttgtttgagtgcaagtgaactgaatttcccaattcctcaaaaagagcaatagtaataaaaaccataatagtgacactta

SEQ ID NO: 236619 - DNA, 385 bp, Homo sapiens
aggacagggagggaggtcaggctgttgatttttttaaatctgtgtttaaaaaaattaaactgggctaggcacggtggctcacgcctgtaatcccagcattttgggaggccaaggcgggcggatcatgaggtcaggagttcaagaccaagaccagcctgaccaacatggtgaaactccgtctctaccaaaaatacaaaaattatctgggcatggtggcgcacacctgtaatcccagctactcaggaggctgaggcaggagaatcgcttgaacccaggaggcggaggttgcagtgagccaagatcacaccattgcactccagcctgggtgacagagcaagactccgtctcaaaaaaaaaaaaaattaaactgatttttgatgatcaa

SEQ ID NO: 236620 - DNA, 443 bp, Homo sapiens
aattgtgtgacaatgttcaattccgagtttaaaactgacttcattttacaggccttgggggaagaggaggctgtgacatccagcctgcaccattcatagaagatgctttgttctgtgtgatttgggaaggtgttttataagcctggtgctgtttattgtttagcatctctcacagacaactctctttcaaaccccatttctcaagcgtatcctaattcgacaccacctattggttatgacttaggtgttgacagtcctgtttagtgtccaattttgattccttttcctgattcttgttttaggttttgtcttttgaaggccatatgtaagtgcaaggaaacatgctgtattctaatgaaacttaagatttacattcattttttcaagtgttcatttgacgtccctcctacaataaaagtcttcatctttttatgtgacacttc

SEQ ID NO: 236621 - DNA, 1458 bp, Homo sapiens
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccaggcccccagcccctcctccctcagacccgggagtccaggcccccagcccctcctccctcagacccaggaccccagtccccagcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccgaataaataatgacaataaaaatggaatcatcctaaattgta

SEQ ID NO: 236622 - DNA, 352 bp, Homo sapiens
cccagtagctagattgttataatagtttattcccgttcttaaaaaaatacaatcaggccaggcgcagtggctcacgcctgtaatcccaacactttgggagactgaggtgggcggatcatgaggtcaggagttcgagaccagcctgaccaacatggagaaaccctatctctactaaaagtacaaaaattagccaggtgtggtggcgggcacttgtaatctcagctactcaggaggctgaggcaggagaattgcttgaacccgggaagcagaggttgcagggtaccaagatcgtgccactgcactctagcctgggtgataagagcgagactctgtctcaaaaacaaaacaaaca

SEQ ID NO: 236623 - DNA, 367 bp, Homo sapiens
gggtctggaggagtggtcttcattgctgtccctactaatccacgctagctccaaagagagagcccagctggggcaacacaccatgcagacgctgctcccggcccacctcaccacacccgcccccggctgtgcccacagtcccacccgatgcagacactgctcccggcccacctcaccacacccgcccctggctgcgccacagtcccacccgatgcagacactgctgctgacccacctcacaatgcccgccgctggctgcgcccacagtcccacccgatgcagacactgctcccggcccacctcaccacgcccgcccctggctgcgcccacagtcccacccgatgcagacactgctcccggcccacct

SEQ ID NO: 236624 - DNA, 314 bp, Homo sapiens
tctgggcggagtttttagtgtggtaatgaggagagtttgccaaagttcatctccaactgaggcctctctggatctaactggcttttgtttcaccagcactgggcttcttcctggaacttttcttaaacaacaactcaagatgcaacagttaaagtggatactttttacagtatatgcctgaaaacctgaggacattgggttgcagcttattagctttatctctgtgttttcagaggttgctttaggatttgttgtatatttccttaagctaccatagtcatctgcaagtaatatcataccagttcacatataat

SEQ ID NO: 236625 - DNA, 1741 bp, Homo sapiens
atatagcaaatagaagagaactaatttgtctcagatttcttaaatgtgaagccttttctttcaaaataaatgtttagatgaggctggttgtagactttcataaagtacctgtgaaactatttttgttttcagaaagtgattactattaatataaaccaagatttacttgtaaaaagcagtgttctcagggtttatattatggaacagtagcttcaaatactttgtcttatgacagtaattcacttcctttctttttcacagagtaagttcctctcagtttatacagagtgattttacttattttatttggtggtagtggtggaaggtgggagtattataaataagcctggaaaaatatatagtgccacattaatagtggttatctctggataaaatttataactctttctcttacttacagtgaatatattttgtaataaacaaatcaagcttataagattacaggtcttcagaataagaccatagatacattggtaaaagattaataatttctctaaactaggctattgagaaaattaataaacataaaagacaaaagcattcagctcttcgaagtatattaagctgattagaaaaatctgaaataggtggcgccaagatggccgaataggaacagctccagtctgcagctcccagcatgaacgatgcagaagatgggcgatttctgcatttccaactgaggtaccaggttcatctcactggggcttgccagacaaataggtgcagcccatggagcagggcggggcatcgcctcacctgggaagcgcaaggggtcggggaattccctttactacaaaagggaagccgtgagagactgcacctggaaaatcgggatactcccaccctaatactgcacttttccaatggccttagcaaacggctcaccaggagattatatcccgcgcctggctcagagggtcccatgcccaaggagccctgctcattgctagcacagcagtctgagatcaaactgcaaggcgacagcgaggctgagggaggggcatctgccattgccgaggctcgagtacataaataaagtggccaggaagctcgaactgggtggagcccacctcagctcaaggaggcctccctgcctctgtagactccacctctaggggcagggcatagctgaacagaaggcagcagaaacttctgcagacttaaatgtccctgtgtgacagctttgaagagagtagtggttctcccagcactgagtttgagatctgagaacggacagactgcctcctcaagtgggtccctgacccccgagtagcctaactgggaggcatctcccagtaggggggcgactggcacttcataaggctgggtgcccctctgagatgaagcttccagaggaaggattaggcagcaacatgagctccttgccagcagcggaacaaagctgtatggagaatgactttgacgagtcgagagaaggcggcttcagacaatcggtaataacaaacttctcccagctaaaggaggatgtttgaacccatcacaaagaagcttaaaaacctttagaaaagagtagacaaatggctaacgagaataaacagcatagataagtccataaatgacctgatggagctgaaaaccatggcacaagaactacgtgatgcatgcacaagcttcagtagctgatttgattaaatggaagaaagggtatcagtgattgaagatcaaatgaatgaaatgaagtgagaagagaagtttagag

SEQ ID NO: 236626 - DNA, 501 bp, Homo sapiens
ccgggcagagccgggcagggtcccagccactgcatccagcactgcccaccccctgacaggcagcagaaggcccaagattagagattctaaccccaaggggaagccctgggaagcttgtcagctcagcttccaaaatcaggccctgggggaggcagatatttgataatgaatgattcctgtctgatggctgccctgggtggcagaatcccaggctcttattaagagcggctctggccaggagccagcaggcctggtttcaaaggttgccctccagcagctgtgccgtccggggcaccactgccctccccacgccccaggcccacactgttcaccatgtttagagcaggtgcccacagcaggtgcagcccgggggccttgagctcagcctgtgcaccatggcgaggcagcgccccagtcccccagccggccggctcccgcctgcgtcctccctgtgagcagatgtgcgagcagatgtgcttcaagctcggcggctgcggccgc

SEQ ID NO: 236627 - DNA, 439 bp, Homo sapiens
tattctaagacttgattctccttatgctgctgaccagtaagttgctgaaggctattctattaatagaagggtataggaagtacttaacaattattgtttctgcggcacttcatgtgcacaaaggtgtttgaagctactcctctggatttttacagggcttctctatggaagcattttcacatttttattcctaaatctggtagttctttacagtaatcctgtgatctcaagcccttgctttaacttttgtattgttagtagtgacatctagtggttctgttgcaagtatcttgcattctagaccattggagctgaaagtgattttagtgaccaccaggtctcattttgtaaattattaaaaataaactgaaaactcacatgtattcctacattcaaatcaactctatataataataaataaaacctatagctgtgtaat

SEQ ID NO: 236628 - DNA, 436 bp, Homo sapiens
agaggctgcagtgagctatgattgcatcactgcactccagcctgggtgacagagcaagatcttgtaatcttgtaaatacatagaaagagcacattctgtggctgagcccaagaactattatgcacaaggaataacttgttgggacgagccattaccacattggcagggtcgtcccggtctctgcttgggtatttttatctgtaggcctatcagttagtatgcttttggaaaaatctgggatttactagagaaaaaggtaaaggtctagggtcgatgttaattgtgtcccctccaaaaaaagatatgttgaagtcctaacctcccagtacctctgaacatgacatcatttggaaatagggtctttgtagctgtaattagctaagatgaggtcatactggagtggaacagattcctaattcaagatgactggtgtccc

SEQ ID NO: 236629 - DNA, 688 bp, Homo sapiens
gtaagagtctccaaaatatccttatactatagtcacatgcacgtgtccagttatttccttagggtaagttccaagaagcagaatttctatatcaaagtgtttactggaaatttttgccattctgataggtaaaagtaccagagtgtttaacttgtatttctttgagtctaagtaagattgtgcatctgtttatttgccatatgtttattttccacttttgagaactgcctgtgtactttatccattattattatttaaattagtcaagatattagcccttaatcatgaactgaaaataccccctccaacctttttataaactttatggtatcctttttttttttttttttttttttaaggattttcaatttttatgtagtcagatctgttggtcttttcctgtgtgtgtgtgtgtgtgtgtgtgttaacttcagtgatgtctcagttttggtcattcctgcactcctgcctgccccctcaccccaaggtgacttgtgagatgagagttcaaatacaagtagtttatttccaggtacaaagaacaaagggaagctaaggaagaaaagatagtcaataaaagatgtctcatctgggcttagtggctcatgcctataatcccagcactttgggaggctgaggcagtcggagattgcttgagctcaggggttcgagaccagcccaggcaata

SEQ ID NO: 236630 - DNA, 461 bp, Homo sapiens
tctgaatagtggttgttatgggaggtagggaaagattggcagaggtagctttctggaaaagttttatatcttgggggggatgtggataacatggctgtaatacctaaaatatgtatttttattatgcatcatttatagtgtaattttctaaatgaaacaaaaagcagtaacagacactgcccaggttttgagtagtaaatgcacaagatgagcatctttttatcccaggtagcaaggaagctgacaaatactactggtagcaaggaagctgacaaatactactaaaaccatgtcacaaggacttggaaactggcttgaagaggctctcactcaccaaaatggcccaatctgaatatcagtaaagaaaattttaaaaaaagaaaataactttaatggattgaaacacataaattatatttaaatgcatatgttcataatgacaaaatgcactttgaccaccc

SEQ ID NO: 236631 - DNA, 434 bp, Homo sapiens
aaggttggcccttggctggtgtctgagaacttggactttgggacggttcctaccattccctgataagaattccctgataaggtacttacactgtacctaaattgttggcacaacaatttgttttttgctgaatatctgctttctttcttggattctggaattttggtgcatgctaggtagagggtgcctacgttactgcctgcagagaaaaaccctaaatgcctaggctccatcgagcttctttggtagattacatttcaaacatgacacaacatgttgttgaaggaattacatacatcctgtttgactccactatgagaggactctagaagcttgcacctggtttcctctggactttgcccttttgcctttgctgattttctttgtgtttattcactgtaataaatcggccatgactatggctatatgctgag

SEQ ID NO: 236632 - DNA, 442 bp, Homo sapiens
ttctgaaccatatgtaggccagtttttatcatttggcttgtcaattggtgttttgatatttaattctttttttttaggttgtctcataattttttattaaataacaggccttatgtattaaaaacagaaattttaaatgatcttcctaccaaaaagttttgtttctttttttctggcagtcacacagaatataagcggtaaaccttgattaattggagcccctcaaattttgccttctcagttgttttatacattttatctaaattttataattatctttttgtaggtttctttcatctgatacaagttgcaatgctatgactaggattggctttattctggctttgttctccaacaaactaaaattgggaggttatatagtgaggaaggaatgtagctatgtgcaggcagaaatgtagctgtgtggggagtgtaaaccaaa

SEQ ID NO: 236633 - DNA, 406 bp, Homo sapiens
ggaaataggctaaaaagtcctaagtacagtgctattttctcatttgtttaggaaaaatggctcagagaatttggctcgcctcgatttaatttactttatatttcaaaaagtgatagatgagtcttccaccttcactttcctgagttgatatattaacaattaccctagactctgcaggtttgaggaactcttatgaccagctacatacactagatttccttgactaacccaaatctaaaatattaagtcccaaagtgttcatcaaagtgttagagacctggtgatatttattgaccaaaccacaactctcagatttcatagtcagtggtgcacaaaccttcgttagatgatgtattcatgaagtctagtcaccaagattgttctctaaatctggtctctggccttc

SEQ ID NO: 236634 - DNA, 352 bp, Homo sapiens
ggaaataggctaaaaagtcctaagtacagtgctattttctcatttgtttaggaaaaatggctcagagaatttggctcgcctcgatttaatttactttatatttcaaaaagtgatagatgagtcttccaccttcactttcctgagttgatatattaacaattaccctagactctgcaggtttgaggaactcttatgaccagctacatacactagatttccttgactaacccaaatctttgaccaaaccacaactctcagatttcatagtcagtggtgcacaaaccttcgttagatgatgtattcatgaagtctagtcaccaagattgttctctaaatctggtctctggccttc

SEQ ID NO: 236635 - DNA, 622 bp, Homo sapiens
ttgcaagggccactcttagttcttgctgtttggccactggctaccacccatattatcactctaagatataattctgagatgagctaggaattccaaagacgcctcaagctgaggtgtcagactccttcctctgtcaggctgcctgtcattttgaggcctttgtcttttctccctattgaggctgtgagcctgctgcccaacactggctggctctgtacctagcagcaccttggtagacgctgatgccgagggacacagctgacccctctgagtctcgacacccagcgcccttggtttgtgctggcggctctgctagcctacaggattctttggtgtgtcaaagcagaactgtctgcctggggaacgcagcatggtgtagtttcatgcaaattaaaggagatcatcttgatttctgaagcagcacccaggcatctcacacatgtgacctgggaaagacggggcaacaatctacatacacttcaaactggttaatgaaccagggaatggggcagaggaggacacagggccatcctgcaaaatcaaaagctgaagtcaacggaccctaccattctgactctagaaggatgtggatagcgggcgctcgtgccgaattcggcacgag

SEQ ID NO: 236636 - DNA, 480 bp, Homo sapiens
actctctttgtaagggcatggtagggcagtgctgatgggacagccgatgaagacaatggtcaatgtagatgtgccaggacaaaaatgtttccatgtgctttgttccttttctgttacatagatttggaaaatgagggtactacctctggtttgggttttttttgtttgtttgtttcttcatttcatattgagctactacaagagtgctcttatgcaataacttctttgttcacttattttctctgtattttgctccttgcccattttaaaggtcttcatggaaatttgccttaaaatccatggcaatgaaacattggttcactgtatttgtctaaatcatgttacttctttgcagatttttccttgagttttcaatggtgactggctgttgaggataacgagttatggcattccctattctgccttaggtagaggatgtcaagtagctaattactttggaactcgatctttcctaaaaaa

SEQ ID NO: 236637 - DNA, 955 bp, Homo sapiens
ggggtcctcacctgctgtgcctcttattcaattttttttctgcctcctccatagtcaattgacctcttcagatcccatagtctagccagccatctccctttatgccttgggtcccactgttccttcatctcatcccccattccctcagtcccggagtggctgcagccagcagaggatggactgagagcaagagaggaggtcctgcccaggaacccatcctagagaaacagcatcctgcctgggagctagtcttccagttcagcttttataagtcttgtagactcaaacccacttgacccacctgaaatggtattgacagtaatactattttcatggttgtttttcattgtaaatgcagagccttttagctacacaacgagtacagagagtaagggggctggcctgggaatgatatcatcttggatggcatttcctccttggagaaatatatgttagttccaactcacatattaatatacaatcctatagagagagatacagagagctagagagacataggtgtatttgtatgtgcataaaaaatctataagacacacttcggtattctggtcctttcttaagcacatttatatatgatctcagtttttatatggagcattgatagggtttggctatgtccccacccaaaatctcatcttgacttgtaatctctataatcctgataatccccatgtgtcaagggcaggaccaggtggaggtaactggatcatgggggcagtttctcccaggctgttctcatgacagtgagagagtctcctgaggtctgatggttttgtaagtgtctggcatttcccctgcttccacttactctgtcctgccgcctgtgaagaaggtgcctgcttttcccttgccttctgccatgattgtaaatttccagaggccaccccagcaatgtggaactgtgagtcaattaaaacatttttctttgtaagtt

SEQ ID NO: 236638 - DNA, 1008 bp, Homo sapiens
ggggtcctcacctgctgtgcctcttattcaattttttttctgcctcctccatagtcaattgacctcttcagatcccatagtctagccagccatctccctttatgccttgggtcccactgttccttcatctcatcccccattccctcagtcccggagtggctgcagccagcagaggatggactgagagcaagagaggaggtcctgcccaggaacccatcctagagaaacagcatcctgcctgggagctagtcttccagttcagcttttataagtcttgtagactcaaacccacttgacccacctgaaatggtattgacagtaatactattttcatggttgtttttcattgtaaatgcagagccttttagctacacaacgagtacagagagtaagggggctggcctgggaatgatatcatcttggatggcatttcctccttggagaaatatatgttagttccaactcacatattaatatacaatcctatagagagagatacagagagctagagagacataggtgtatttgtatgtgcataaaaaatctataagacacacttcaaaatctataccggttcctccagaggtatgtgtttggcagaaggtagaaggagggtattctggtcctttcttaagcacatttatatatgatctcagtttttatatggagcattgatagggtttggctatgtccccacccaaaatctcatcttgacttgtaatctctataatcctgataatccccatgtgtcaagggcaggaccaggtggaggtaactggatcatgggggcagtttctcccaggctgttctcatgacagtgagagagtctcctgaggtctgatggttttgtaagtgtctggcatttcccctgcttccacttactctgtcctgccgcctgtgaagaaggtgcctgcttttcccttgccttctgccatgattgtaaatttccagaggccaccccagcaatgtggaactgtgagtcaattaaaacatttttctttgtaagtt

SEQ ID NO: 236639 - DNA, 402 bp, Homo sapiens
aagccctcttcttgcaggagtccccgctgagctcccttcaccaggggctaggtgaagggagcgaggccaaccagaagccctagtggagagcccatccagggcaggggttccaaggaggacaaaaaagccggttagtgaaggtgcgctctgcgccagggactgtgccggcagacacaggcactactgacaccgcccccagcccttcggaggagtcctcggctcctcatctccagctccagcccctttccagccggctggtgggcggctgggagtggggacactggatcggaggggacccttcacgggagtactcgctgccctcactcgtctcggaacgcggctggacccggagtccccgaccgcagcccgcgcacgacccccgggagcctgtctccgcggccg

SEQ ID NO: 236640 - DNA, 685 bp, Homo sapiens
aaaaaaataaacagtagagcttgtttaatgtacttgtttgccacatacagggaagataatgccaaatacaaactaaaacatccaaatctctgcttcagtttgagcagttacctcacgtcaagactgaaagaccttcaattaataaagtctgacaagaaagttaaactgaaacgaattgccaaaaatttgccaaatatgtacctgtagttttcattccagcacttctgcaaaacctatcttcttatatattccctgacttggacacttcaaaattgtttaacctgcatctgtagacctttttatactttatatattaagcacagttacaagtgtaatgacttcagaatacaaaataatacaagtattaacagatgtaatacatcgtatgtgtctacacatcattacccttcctcgattctctaaagtagccttcccacctaaaacactaattcaagcatgctactggggtctgttcaattgcatctattcttctatccgtgcagctgaagcttaagactgtctaagtaaaacaaagttcgggcgatgcttctcccggggactcggtcctggcatccagtctcccgttgctccttttaaaaactgacacacaaacaaggcgaaaggagagggaagagggcggctggcgctccgggccccctccccgcctgcagccaggggcggccgc

SEQ ID NO: 236641 - DNA, 368 bp, Homo sapiens
agactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaa

SEQ ID NO: 236642 - DNA, 97 bp, Homo sapiens
cagcatgcatgcagtttattcgccacatttcccccaggaactctctctggttagggaatgaaagaattgaaggaatgggggatgtacaggtggaagt

SEQ ID NO: 236643 - DNA, 748 bp, Homo sapiens
taagctaagccttgatcttggtaacaggattgacatggacagtttcaatctgacccatatgccctttgcccaaagcactgagccagcagcatcagttatgttttaatgaaattgaagccccaggacctgccactatggctctgaggaggactcagcttcactagcttggaaattacatatttggagggatgagagcccatgagtgtgggagatagggtaggctcagtgtcagtgtttttgtttcttccttgttccatacacttgagtagggatacatggtattaacctctttaaacaggtctctaatttcatctcattaattcacagttgcacagccatactagggtctcttccataaaccataagattttattcaccaaagctctagagacaaggtactcagatctctgtggcatccctcattttctcaactgcttctctacaaacttctcctcactttgagagtttctaatgctcaggctgggagactttttagggggtgtttttggtttttatctcctagggttatgtctaatcactcttgtggcatcctgtcctgggatttgtgctcctaaggatagaggagagtatttctgggaggagtgttcccatgatactatttgattatgtcatccttgagatggtattgtatcttctacccttatatcctactcatcgcctggcacacagcttggaatgtagtggtgcctaccacagtttgaataaataacactacacctttcagagc

SEQ ID NO: 236644 - DNA, 715 bp, Homo sapiens
ttttgaggtagggtctcattctctcacccaggctggagtgcaattgtgcaatcacagctcactgcagcctctacctcccgggctcaagctatcctcccactttagccccaagtagctgggaccacaggcatgcaccaccacgcctggataattttatttattttttgtagaaacgaggtctcattatgttgcccagactagtctcgaactcttaggctcaagcgatccatctgctttggcctcccaaagtgctgggattacaagcatgagcgactgagcctggccagtaactaatatttttgatagaataagttgcaaatctggaacatacttattttaaaagtaaaaaagtcttttaaattggcaaaatctacaattctaggtcttaaatgaaatttagctgggcataaacaaaggctgaatttcattttgagtcactgataatctaagttaagggcaatgtcccttttcttctgttgtaggatcacctctactttgtgttagtctgggaagtgggggtgctgtgtaagaagtactaacaggtaaaagatgttgcagtaggctttagtcttttgactggtctcctcacctctattcttgttccttacaatttatacagatattgccactggaaccacttttttaaagctagttgaatcttatggataaagtgttaactttatagcttggattaaaaatgatttcctgtccagtc

SEQ ID NO: 236645 - DNA, 423 bp, Homo sapiens
ggctggagtgcactgtcgcaatgttggctcattgcaacctctgcttcccaggctcaagagatcctcctgcctcagcctccagagaagtgggactacaggcatgtgccaccatgcctgactatttttgcatatttttttggtagagatggagtcttgccatgttgcccaggctggtcttgaactcctgtactcaagcgatctacccacttcagcctcctaaagtgctcggattacaggggtgaaccactgcaccaggcctccagattaaattttaaaggggaaaaagatatttatgaaatggaaactagataagagaaaatcattcaaaatatgaagtatttggattagggggtcagagtgtctaggctggtaggtaaaaaaaaaatccctgatcattacattagaaaagtatggagatgggaa

SEQ ID NO: 236646 - DNA, 220 bp, Homo sapiens
ttgagcttgagtttaataactgatgcacagagatcactgagttttttgataagaattagagtaggaagaaatggccacagagaacaatttatatctccaggtgaggactcaggagataattctgcgaacagaacttcctgagaactgagatggggtaaatcgctggtattagaagagtgaaaatgtcagtaattaaggctacgactgtgctcttagaggc

SEQ ID NO: 236647 - DNA, 622 bp, Homo sapiens
aagagaggtgagcaccagtggagccccaaggcgttggaggataaaactgaggccccttcagacagcagggccactcagcctgcctgttctttctccctttctgctgagaaaatttcagacttcctgactgtggccactttcatcatgtggatcctggctcctgcctcattagtagacactgattcagctgacctgtttgccagaccctccaatcctgactgcccctgtacttacccccccccatcagatattgatcatgaaacgagaagccctacttataattctccttctccctttaggattaataataattgttagtccaagctgcaccattttgcaagtccctgccatttcacagaccctggtcagaatgaaagattccatggggccctgggctgtgagaaacatcctgcccagccacctgacttccttatcacatcctgctgggcaaaggcccaaggaacatctttatcaacatcctcctgggcagcaagccatacgggcccagacccctcctgcccagacctgtaattaccccagcctgtaagcagcagtgagctctggcaccaagctggtcccctctctgcaagttgtactggcaataaacctgtgttgctgtaga

SEQ ID NO: 236648 - DNA, 646 bp, Homo sapiens
aagagaggtgagcaccagtggagccccaaggcgttggaggataaaactgaggccccttcagacagcagggccactcagcctgcctgttctttctccctttctgctgagaaaatttcagacttcctgactgtggccactttcatcatgtggatcctggctcctgcctcattagtagacactgattcagctgacctgtttgccagaccctccaatcctgactgcccctgtacttacccccccccatcagatattgatcatgaaacgagaagccctacttataattctcctttcaccattcttgctgaatctccttctccctttaggattaataataattgttagtccaagctgcaccattttgcaagtccctgccatttcacagaccctggtcagaatgaaagattccatggggccctgggctgtgagaaacatcctgcccagccacctgacttccttatcacatcctgctgggcaaaggcccaaggaacatctttatcaacatcctcctgggcagcaagccatacgggcccagacccctcctgcccagacctgtaattaccccagcctgtaagcagcagtgagctctggcaccaagctggtcccctctctgcaagttgtactggcaataaacctgtgttgctgtaga

SEQ ID NO: 236649 - DNA, 378 bp, Homo sapiens
ctgattcttcctgctcctctgtgagtaataaatttggtttgcctgacttactgtgtgagcattcttctgtttctggcagcttggtttatataaaaaacctcctactagacctatgaatctatgcaatgtggaagtgtcatagaggtaaataagaagcaacttaactgagctaaaaactaacatacataacaaggggccactgcaccaaggagcaaaatgatcctgccaaaaagtcacatgtgaccattccagacatactgtggaagaagaaggatgctgaaactcacagagatctgaagatcttacccaagccaacaggaggctaataaagcaagagaattccactgtactttgattcgagaatacaagcttcatctc

SEQ ID NO: 236650 - DNA, 431 bp, Homo sapiens
ctcaataaaccatatattaacattgtttgaatccaagtttatgttatcttccagttggctacaccattttagaaaacaatttgtgtttgttgaatagtgtatcttttccctgcagattcaagtctgtgcctttacacatattgcattttcggagtatatggctctataccttgacgttatctactacatattgatttgtcagcctataagtataccaatgcctcactttttaaattatcttcattttataatatattttcatagctagtaggataatctcaccatactactactttataatgtttttcttttcatactcaatgctaaaagactgaaagctttccccctaagatcaggaacaagacacgaattcctgctttggctatttcaactcagcatagtattggaagttctagccagagcaattaggt

SEQ ID NO: 236651 - DNA, 810 bp, Homo sapiens
acagtcctaaatatatatgcacctaatactggagatcccaaatttataaaacaattactactagacataagaaatgaggtagttggcaacacaataatagtgggggatgttaatactccgctggcagcactaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccgaaaggaacactcaaaagcatgcaaatacatggtaattaaataacctactcctgaatgattgttgggtcaacaatgatatcaagagggaaatttaaaaattctttgaactgaacgataatagtgacacagcctatcaaaaactctgggatacagcaaaagtggaggtaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaagattaatc

SEQ ID NO: 236652 - DNA, 635 bp, Homo sapiens
cagtgagctgagatcgtgccactgcactccagcctgggtgacagagtgagactccatctcaaaaaataaaagagtcactctggatactgggttaagaaaggagtgtgcggggagagcggtgaggacaaaggtggaagcaggggagcagataagcagattctgcagacgtatccacccttccgtgactagctctagccaatggagaaagggcaagacctttcatacatgaccagggtgtatgagaacatgggtgttaccatttaatttcagggtctgtgtgcctcctgcagttcccaccggagaagtgactcctaggtttcaggctgggcttgtccgtatcatatgagctggcagtttctgtttactcattggcaaactgacatataccttgaggtagatgctggagcccacaatgtggagcaaaaagcaaaggaggtccctgggccaaactactgtttgcaccaaatgggaagggctaacttgttattggatttctctttgctctgcaaataggatttcatcttagtaactaagagtacactgtcagcccaccagaaaagccacactgctgtgattcattgatattcacctgatactgccctttcactcttggatttcttggttgaccctccgta

SEQ ID NO: 236653 - DNA, 689 bp, Homo sapiens
cagtgagctgagatcgtgccactgcactccagcctgggtgacagagtgagactccatctcaaaaaataaaagagtcactctggatactgggttaagaaaggagtgtgcggggagagcggtgaggacaaaggtggaagcaggggagcagataagcagattctgcagacgtatccacccttccgtgactagctctagccaatggagaaagggcaagacctttcatacatgaccagggtgtatgagaacatgggtgttaccatttaatttcagggtctgtgtgcctcctgcagttcccaccggagaagtgactcctaggtttcaggctgggcttgtccgtatcatatgagctggcagtttctgtttactcattggcaaactgacatataccttgaggtagatgctggagcccacaatgtggagcaaaaagcaaaggaggtccctgggccaaactactgtttgcaccaaatgggaagggctaacttgttattggatttctctttgctctgcaaataggatttcactagaggcaattcttctaatacttcttcagccacctgtccttcctcatctcttttcttagtaactaagagtacactgtcagcccaccagaaaagccacactgctgtgattcattgatattcacctgatactgccctttcactcttggatttcttggttgaccctccgta

SEQ ID NO: 236654 - DNA, 768 bp, Homo sapiens
cgccagcgcctttgcggagcacccgggccacgtctccttcggtccaggggaactcctccagctcggggagccgcggacagcgcgagaagaggtcggccacttcggggtcctcgggcagcaccgtgttcaccgtgtcccagctgttgtggcggctgttcatggagccggagtagcaccaccaggccgccccgcggtgctgctgcgccgaagagttgagcgcctgcgagttggacttggaggacgagaggctgagcgagcggcacgagtccccggccccatacccggagtccaaggtcaagtcctccagcgtcttcagagtcgagctgtacgtcccggccatggggagcctgccgagggcggcgtcgccgagcgaggggcactcacaactccatgccctctttcccaagtgggcagaaacaagctctaggccctccgggccaccctccttcctctctgcgtcgcggggctcggcggccgcattgcctgcccggaggccgcgggaaggtggccgagatccgtggccagcaggagccccacgctcccggcgtcccgactcgcagctgccactggaaagaaccccgtcgctaccccccggcactcccccttgtccacctctaattcccacaagcagagagtcagtcctccacagagaaggaatcccgggagaacagggcggcggcggcagaaggaggaggcggcggcgcagggcgcagggcgcagcgcgagtccgggaccagccggcgagaaagcgctccctcgtgccaactt

SEQ ID NO: 236655 - DNA, 393 bp, Homo sapiens
actgacacatgagagatgggtggtcacaccattaaaaaccaaatgaaaaaggcatttcaggaagaaaagagtgatagacaacaccgagaaattctacaaaacgtatctgtcccaaatagataatctgcaatctcatttaatatcttttagactttaattggtttgaaacttaagaaaaacagagatacaggcctcttcaacagttaactaacaaacctcaacctgcccaaattggatctatcatcaaacatttctaacattttaaactatggccaaggatggtctgacacaatggctaatgcctgtaatctcaacactttgggaggtggaggcaggcagaccacatgatctcaggagtttgagaccagcctgggcaatatggtgaaaccacgc

SEQ ID NO: 236656 - DNA, 844 bp, Homo sapiens
gagtgcagtggcacgatcttttctcactgcaacctccgcctcccaggttcaagcgattcttgtgcctcagcctcccgagtagctgggattacaggtgcccaccaccacacccggctaatttttttttgtatttttagtagagtcggggtttcaccatattggccagggcgaacttctaacctcaagtgatccacccgcctcagcctcccaaagtgttaggatcacaggcatgagccaccgtgcccactgagaatttaatacactttatgtaagttaattttttatgatagttatctagctttgccagaccaattttgttagtaaatttaaaacattaaaaaattttgaatcctcctaattctgtgtctctaatttagtaattttaagttttgatccttgtttcattctatcattcttttatttaaaaaaattgtcattggcttttctaaaagtgaatcgtgaatcatgattcatgtgaaataattaactctaaaacagcaaagataccttttagaaccttcattttttataaattgcattaacaagttatgcagtgatgtgaagatacaaactaaggtcattaagttttctttaatttataatttatattaacctattcattgaacaaggatttgatagtttgtgattaaagcaaaacaggcaaagaccattaaaaacaaagacagaaaatgagcataaatcacttgagaaatatgagcagaatgggggaatgggaagaaatctttataccagtaatctgaggccagatagttcctgggtttggaccttaaatttagctctgagcttcctggcaagcaagagaaaaaaggaaacagggtgactt

SEQ ID NO: 236657 - DNA, 433 bp, Homo sapiens
aaagaatgttattcagccttatggagtcagtataagattatatgctgataactccaaagtctgtatattctggccttcaactacctgctgaatgtccccactgcgtatctttttctgaaagttctgcaggtacctcaaggtacatcaagattgatatatcttaaatgaatctaatcttttttcttaagcttgtttttcttcctggtttctctgatattaatcactggtgtcatcatcctaaactatcatgtctcctaaacaaggaacttacgagcttctttagccttccttccactcccactttaactttcattagcaatgtctccattttgcctcccttcctcatggtcacaactgcggcatttcccaagttcgctctcttcatttctgtttcatttatctgattcatactatctctacacaggactgttta

SEQ ID NO: 236658 - DNA, 575 bp, Homo sapiens
aaatacttgtgtcatcctcaactgtatagtttttatgacttttcctgtgttcatctggttggcagatgaatgcaaaatgccttttagcttcatggaaggcacacatgaatcatggctatgtgataaacagaagaagccacgtttcggagggtttctggtgtgtgtacgtgtgcacttgcatgtgtgtgggcacacccttgtgccaaatggaccaccagtttaaatcgattttcaacagggcagatttcatatgcttctttagtgtggcccaagtcaatctatttttagaaggggaaagtagagcatgttctgaaagttcttttcttctgccatcagggattgtagtactttttatttatagtaatttcaggtctctaaatacttcaagcaaaattaatgaggcaaacaaaaagaattaggtaccagataattggatcatgtgttattttatagagagctttatttatcttgcctttggaaagtataatttgtatttttcaaaattatgattagatctaattctttttcaagatttacttaaaataaatatttctgcctaggcacaagactgtgta

SEQ ID NO: 236659 - DNA, 346 bp, Homo sapiens
tcttcctgctagggtctccggtgggtgaggcggggcctgacctagactcactagtggcctgggagagccgtcgctacagtgacctgctgctctgggacttcctcgacgtcccattcaaccagacgctcaaagacctgctgtgctgacctggcctgggcctctggggccggcccctggctcagcccctccttccaggtcttgatgggagggaggagggcccagaagctggacaacttaagccactccttggcctcccccagccaggggcctgggcaggaaagatggggtggtggactgtttttgcctactttttgtttttgaaaaacatgcactccccactctgagg

SEQ ID NO: 236660 - DNA, 531 bp, Homo sapiens
gaaggtggctacccagcctatgcaagcgggggtggctacgtcattgccgggcgcctggcaccctggctgctgcgggcggcagcccgtgtggcacccttcccctttgaggacgtctacactggcctttgcatccgagccctgggcctggtgccccaggcccacccaggcttcctcacagcctggccagcagaccgcactgcggaccactgtgctttccgcaacctgctgctggtacggcccctgggcccccaggccagcattcggctctggaaacaactgcaagacccaaggctccagtgctgactctcattggggagggcggaggtgctgacctggcctgggcctctggggccggcccctggctcagcccctccttccaggtcttgatgggagggaggagggcccagaagctggacaacttaagccactccttggcctcccccagccaggggcctgggcaggaaagatggggtggtggactgtttttgcctactttttgtttttgaaaaacatgcactccccactctgagg

SEQ ID NO: 236661 - DNA, 2426 bp, Homo sapiens
cagccacgtcctcatggccctgctgctcttgctgttcctgggcctcctggggctctgggggctgctctgcgcctgcgcccaagacccctccccagctgcccggtggcccccggggcctcgcccgctgccgctcgtcgggaacctgcacttgctgcgtctgtcgcaacaggaccggtccctgatggagctctcagaacgctacgggccggtgttcaccgtgcacctggggcgccagaagacggtggtgctgacggggttcgaggcggtcaaagaggcgctggcgggccccgggcaggagctggccgaccggcctcccatcgccatcttccagctcatccagcgaggtggaggcatcttcttctcatctggggcgcgctggagggctgcccgccagttcacggtgcgtgccctgcacagcctgggcgtgggccgggagccggtggctgacaagattctgcaggagctgaaatgcctctctgggcagctggatggctacagaggccggcccttcccgctggccctactgggctgggctccctccaatatcaccttcgcgctcctcttcggccgccgatttgactaccgggaccccgtgtttgtgtccctgctgggtctcatcgatgaggtcatggtcctcttggggtcccctggcctgcagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggttctgaaggcggctgtggtggctgctcctgtgctcccctggggaggtccccacccctcccctccaggagcaggcctggtgcagcccactctgtgcctggacatcccccgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgtgcggtgcccaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcaatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggctcatgcctgtaatcccagcactttgggaggccgaggcaggcgaatcacgaggtcaggagttcgagaccagcctgcccaacatggtgaaaccctgtctctactaaaaatacaaaaaaattaaccgagcatggtgg

SEQ ID NO: 236662 - DNA, 2529 bp, Homo sapiens
cagccacgtcctcatggccctgctgctcttgctgttcctgggcctcctggggctctgggggctgctctgcgcctgcgcccaagacccctccccagctgcccggtggcccccggggcctcgcccgctgccgctcgtcgggaacctgcacttgctgcgtctgtcgcaacaggaccggtccctgatggagctctcagaacgctacgggccggtgttcaccgtgcacctggggcgccagaagacggtggtgctgacggggttcgaggcggtcaaagaggcgctggcgggccccgggcaggagctggccgaccggcctcccatcgccatcttccagctcatccagcgaggtggaggcatcttcttctcatctggggcgcgctggagggctgcccgccagttcacggtgcgtgccctgcacagcctgggcgtgggccgggagccggtggctgacaagattctgcaggagctgaaatgcctctctgggcagctggatggctacagaggccggcccttcccgctggccctactgggctgggctccctccaatatcaccttcgcgctcctcttcggccgccgatttgactaccgggaccccgtgtttgtgtccctgctgggtctcatcgatgaggtcatggtcctcttggggtcccctggcctgcagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggtcagcagccctcggggccggggtggggcggcacctccagggctccaggggtgggacggccccagctccgcctgccgcctctgcacccacctcctgatctcaggttctgaaggcggctgtggtggctgctcctgtgctcccctggggaggtccccacccctcccctccaggagcaggcctggtgcagcccactctgtgcctggacatcccccgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgtgcggtgcccaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcaatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggctcatgcctgtaatcccagcactttgggaggccgaggcaggcgaatcacgaggtcaggagttcgagaccagcctgcccaacatggtgaaaccctgtctctactaaaaatacaaaaaaattaaccgagcatggtgg

SEQ ID NO: 236663 - DNA, 791 bp, Homo sapiens
agcttccacccgtcctagccagggtgagaccaccctgcctgctggtggagccaggcaggcccagagcccacctggaagatggaggctgcacggcactgcgtggtccggggcagccccagggcagcagagcattccctggccttccctgctggtgccagctccttaccacagagacgccgcgtggaactcactactggcgatcgcggacgccccaggaaggcgagtggcacgaggtgtggcggggctgccacaggcagtcacggagcacccgctggtgccaggctcacccctcagatacagcctcgtgggctggctcagtggcggccctgactctccaaggtctgaggtctgctctgtcttccattccatgactcacaggaggttcaaggttacttccactgtggcagctgcctccctcctccctctccaggatggaaggaggtcctgctgtgcaaacctgcctggctgtccccttccgggacacggacagggggtttcctggcagttcctggtcctcccttgagggctaagggtccccccgttctgtggccgcctccagcacatccacccagagtccctgggcgtgaacacagccgctggggacgatcaccgcctgcccagcgtgcagccctggggctgcgtccttatctccgctcctcctgcctcctgcccagctgttcaacgtctacccatggctcggggccctgctccagctgcaccggcccgtcctgcgcaagatcgaggaggtccgtgccattctgaggaccctcctggaggcgcggaggccccac

SEQ ID NO: 236664 - DNA, 275 bp, Homo sapiens
cccttctcttcttcttctccccttcccccatcacctggggcccgattcagctggcccagcccttactctgagtgcccacagatgagcctccatgtccatgctaaagcctccaagtgtcatgttggagagaatggtggtcacagtagataagcccaaaatgccttacagtttacaggctggagtcaggcctcgccacgtgctggctacatgacttccctgagattccatttcctcctcagtaaaataagtggtaagattttaggatccccagcact

SEQ ID NO: 236665 - DNA, 369 bp, Homo sapiens
gaataaatggcagctcactagtccccgagggtaagggacctcaccttgccctgcctgtttactactctgtaaaattgaaataacgcagctgggtgcagtggctcacgcctgtaatctcagcactttgggagtgcgaggctggttgatcacctgaggtcaggagtttgagaacagcctggccaacatggcgaaactccattgctactaaacatacaaaaattacctggatgtggcggcatgtgcctgtagtcccagctacttgggaggctgaggcaggagaattgcttgaacctgggaggcggaggttgcagtgagccgagatggtgccactgtactccagcctgagcaacagagtgagactccgtctca

SEQ ID NO: 236666 - DNA, 2481 bp, Homo sapiens
  misc_feature (1012)..(1012): n is a, c, g, or t
  misc_feature (1022)..(1022): n is a, c, g, or t
  misc_feature (1082)..(1082): n is a, c, g, or t
  misc_feature (1086)..(1086): n is a, c, g, or t
  misc_feature (1730)..(1730): n is a, c, g, or t
  misc_feature (1959)..(1959): n is a, c, g, or t
  misc_feature (2209)..(2209): n is a, c, g, or t
  misc_feature (2353)..(2353): n is a, c, g, or t
ataaattaaactttatcatgggtatgtatataggaaaaaataatagtttgtataaggttcgaatagtttgtataaggttcggtactatccacagtttcaggcatacaccgggggtcttggaacatattcccctcagataagagagaattcctgtgtatggaagagactcctcagatacagcttctcttcaactgtaaacctatgaattaaaaaaaagttattggtcctatccacccccgcacatacaacctacattgttatggcaaggatacgatgtcacatgaattgactaagtttacaagagaggaaattgaaggcatgtagcaatcccatggcagttgtgaaatccatctgcctatatgtcaccaattcccccaattccaggggtagggaacatttgattagtctactttggttctctgaagttggctcccttttctttttctcagttcttgacttttttctttgagctgtctttccttttccatgagaaatgtcctctttttgtagctttctcagcctgcttctaggctctgtcccaactggcacagttatccacactggcacaacttctttaaaaagctttgtggactttcaaattataaaccactcactccaccagagagaagccacacccacaaatttcttcaagaagtcctctatgtactttgaatgtcaatcagggaatgataccctttagagtcatatatgtcttttgtctacctgagagcgtcagctagacactggcttaaatctttctgaagtacaggtggtcgtccacttatgatggttcaacttagaattcttttactttaggatggtatgaaagctatatgcattcagtagcaaccatacttcaagtacccatacaaccattctattttttacattcagtacagtattcagtaaatcatgaaatattcagcacttcattataaaataggctttgtgttagattactttgttcaatataacataatgcaagtgttctgagcacatttaagcaatgacnggttaagctntgatgtatggtaggttacgtgtactattcaacttaatattttcagcttacgatgggtttntcangacataaccccattgtaagtcagggagcatctgtagtagtaacaaggttgtattgcatgtgctttattttatcttgatcctcagaccataatcttacagttaacaccctggatttttttttttttaacttcagaaccttttgctgaagaagctggtaacgagaaagttttattttgtaaccctgcaagtcccaggttgaaagtattttcctctaaattctgcttgaaactgagcagttccttgtttagttcttctctcttttaatacctttctacaggtgttttttgaaaaattgcttatcactttcagcatttttcctggaaaccttagccagatctataacttcaataggtactttttctatcttccaagatactgtctcacttgttttgtcagtagattacatggcttctgtccagcctgaaataccaatttcctcagtggttttccagcctccgttagtagtctctttgctgctcttccaccaaatgtctataacccagtccccaaactagtgctacatgtcttaagtttctgtcatggcaatgccctgtttaaataccaaatactatttcagttatctttttctgcctaacaaatcaccccaaaatttactaccttaaaacaaaactattctttgcttnagattctactgtctgaactggactcagctgggcatttcttctggtctcacctggagtcatttatgcaactgcagacatgtggggactccaccaaagatggctttactcaaatgtctggggcctcaactggggtggctgcattagctctggcacagctgcagttccctctccagcagggtcctgggccatttcacatgatgactgagggctccaagagggtgaaagcagnagcatctgggctaggcctcttagagcctgtgcataaaactgaaacagcactacttcatccatgctgcctttcaaagcaagtcccggggcctgctcaaaattacaggcagggaaaatatcctctacctgatggtagtgacaaagaatatgtgtcccatcgttaattcaccagttgccttcacagttgcaacaatgagactgttagcttttaaacagaaatgataaaaactagaagccggccgggcgcggtngtcacgcctgtaatcccagcactttgggaggccgaggcgggtggatcaggaggtcaggagattgagaccgtcctggctaacaaggtgaaaccccgcctctactaaaaatacaaaaaattagccgggcgcagtggcgggcgcctntagtcccggctactcgggaggctgaggcaggagaatggcgtgaacccgggaagcggagcttgcagtgagccgagattgcgccactgcagtccgcagtccggcctgggcgacagagcgaaatccgtctc

SEQ ID NO: 236667 - DNA, 497 bp, Homo sapiens
tcaatccaagctggctcatgacttgcttcaatgaataggaaatggcagaagtgatgctctgaggcttctgggcctagactttaagaggtgttgcccctttcctttttccctcttgggatccagcctaccacatagagaagtttgggttgacaactaaatgtgagagagagacagacagagagaagagggagagctgattcagctagaccttagtcattccagccatcctagctgaagcactagcatgtgaaagaagccaccttctaacctatcaatcagagcccccaattttactgacctcagtcaacaccatgtggaacagaactaccccagggagcccaaccaacccatacaatcatgagaaattaaaaactgatgttgtagcctcctgagttttaaggtagtttgttacacaaaaatactggaattttgacccaccttcacctccaatgccaacctagtaaacctggatatatctttcaaaatttggctcaagt

SEQ ID NO: 236668 - DNA, 354 bp, Homo sapiens
caactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactgaaaaaaccaaaaccaaaga

SEQ ID NO: 236669 - DNA, 442 bp, Homo sapiens
tggacggagtttcactcttgttgcccaggctggagtgcaatggtgccatcttggctcactgcaacctccgcctcccaggctcaagcaatcctcccatctcagcctcctgagtagttgggactacaggcacacatgcaccaccatacctggctaatttttgcattttttgtagagatggggtctcaccatgttgcccaggctggtctcaaactcctgggctcaaccaaactgcctgcctcagcctcccaaagtgttgggattacaggtgtgagtcaatgcgctcagccaacctttcttgagtgaacaaattccccccaatatccgcaagcccttttgattcttctaaactccaaccacccactggtcggctctgcagcctccaagctgatcacagatcacagcctccatcccttctgccacagacactccagccaccttctcc

SEQ ID NO: 236670 - DNA, 480 bp, Homo sapiens
ccaccaattttttaataaaactataaatttctctaaattgactatgatgtaacacacacagtggtttatcagtgttcattatgttcctgtaaatagaaatggcttagaaattgcttctaggcaaaaatttgctatttcccccctacatgcttttgtatctaacaagaataccattattggtctgaccaagttgctgttacaaggctgtattttgatgaaatagcctggaaagttttctaaactctctaaagttttagccatgtttgcgggttttttaatttgttgctttatttatttgttgttttgttttatgtgcattctattatgtcctttgtatgttcattattattctattaattttatacttccttaaggcattgatggacttttctgcctttctattagtacttttgagtttctgagttacaccattttatatgtatttcttctgtgtgttaaataaactcaaattcaatccta

SEQ ID NO: 236671 - DNA, 2047 bp, Homo sapiens
  misc_feature (1909)..(1909): n is a, c, g, or t
  misc_feature (1926)..(1926): n is a, c, g, or t
  misc_feature (1936)..(1936): n is a, c, g, or t
aaaattaataataaatgtctaagctattctgctgccacaatgtggccttactgctccctgatatacggtgcctttctcctcccttgtttcattctcttcactttcttcttccagatgctcgtacacccagtccccctacctgggaaatcacaacctcattaagagctcagctatcttaagtcctatttcctcatgaagtctaactcaactgctgcaacttccgagtagcaattaaatcagctccagcataacctcttttttcccttgtctcctgtgttagtattatgtcactaactttgtggggacaaggtcatataacactctagagcatatcagaatgacagaacatcttcagctataacctacctagataccaatatttgcccccaaggcaatgtttgatttttattccccattatgagaaacaaactcacccctccaaacccaaagaatggactcagagacctggagaacagcgaaagtgagacttttaatgatgctcttgtaatattgggtgtctggcagcaggcacacccagcacagtttcaacaagcaatttatcccctagtgcacaggtgcctcccccagttcctcatgggctgtgtattatggggtcacaatcttcccggacattgcctattggtcgttgggtaggggcttcgggtgttttctttagggttgtcctgctgcgttttgttgcagcccacaatgcattgcaatcctagttagctcaggggctcttcaggtatttgacttatgacttaagtagctggggcaggctgataagaacaggcaacacgagctattttgcagctagtaaactttcatcttagactaaacttctttggttcaggtgagggtaactaagggggttgggggggggtgacaagcaggcattggctgtccaagcaggagcctactgtatcctgttttcttctgtagtctactgacctaagttgatttaaggcactttgtcttggaaatggaccactgtatacatttccttcacccagctaagttttaaattttttttgtagaggtggggtctcactctgttgcccaagctgctcttgaactcttggcctcaagtggtcctcctgcctcagcctcccagagtgcttggattacaggcatgagccacctgttcggccatcattgtttaaacaaaaaagtttagaggactcccaactaggaactattgcaataatctgggccagatattattctagctgggttgaaacaatgaccaaaataaaaaggaggaagatggggaaaggctgggaggtgtacaaccgacaggacttgcaagtaagcagatctggtggcaaaggtcagagaaaaccaaagaagactcccaggtctccaggtgatgaggctagacatggtacatggtagtgctggcagacagagtgggagtgcataccactacacagttggcccacacactctggctgcaaagggccagggaccgtgtggtctccagcttgctgcctgaatttggacaacccactcactctcactgcctgtcttcacaatttgaaaatgaagctaaaacaaacccgtctctagcttgttttgtttttgtttttttctgagatgaagtcttcctctatcacccaggttggagtgcagtggtgcaatcttggctttctgcaacctccgactcccaggttctagcgattctcctgcctcagcctcccaagtagctgggattcaggtgcccaccaccatgcccagctaatttttttgtatttttttcagtaaagatggggtttcaccatgttggctaggttggtctcaaactcgtgaccacaggtaatcctagcactttgggaggccgaggcgggcggatcacctgaggtcaggagttcaagaccagcctgatcaacatggagaaaccccgtctctnctaaaaatacaaaattngccgggcgtngtggcacatgcctgtgatcccagctacgcgggaggctgaggcaggaacttgcggtgagccgagattgcgccattgcactccagcctgggaacaagagctaaactccatctc

SEQ ID NO: 236672 - DNA, 548 bp, Homo sapiens
aactgatagtaaggaaaaagaaataggaagtaaatgagtgaactaaatctttactctctgtagctgggagccaacaaatgatatccaaagttgataaaccaagaaaatgtcagtaaaatcatgttatttggagtcatctgtgtaaataattgtgagaaaacaaacatttaacctctggaaaactggtttaggaatggaaaagaacagagaagggaactttgctttttgttttatgtcattatctaacattaggttttttccccatgcatgtgtatatattgactttttttagacaaatatggtagataaatagatagataataggaaggggggaggataggatggagagaggaacacctacatacctagaggttctcactgcatagtgagatatcaggtgattttttcttcattatatctttttgtatggcttggatattttacaaagagtaggtaatatttttataaacataagacgaaaataaactgtttcccctttgtaaaaaaagaaaatcttaaattaaaacaaaaatcaaccttaaagagta

SEQ ID NO: 236673 - DNA, 556 bp, Homo sapiens
ccaggctggagtgcagtggcacgatctcggctcaccgcaacctctgcctcccgggttcaagcgattctcctgcctcagcctcctgagtagctggaattaacaggtgcccgccaccatgcccagctaattttttgtatttattagagaccaggtttcaccatgttggtcgggttggtcttgaactcctgacctcaggtgatccacctgcctcggcctcccaaaatgctgggattacagccgtgagccaccacgcccagtctgcagcttgcttttttaagttactatgccctgggctcccttccatctgggtacacaggtatctactgcttccttatttagagtctacatagcacttcatggttatgaacacccttctatcagacacagattctttctagtttttcactaccgtaaataataagccaatagagggatgttagttcaatggcttcttttcaaagcaagttatcttatcatctcatttgattttcacagaaaacttgccagagaggtgatatcttttttttttttttttggaacagagtctcgctctatc

SEQ ID NO: 236674 - DNA, 441 bp, Homo sapiens
gagaaaaaacaacaaaaaaaagaagcatgagctacccttccacaaaagattaaaggtaaaagaagcaaaaagtagaactgtgtggccctgagaaacaaaagagaaccaaaaactggaaattttatacccttatctacccaccctcccctcaaaaaacctaagaatcagaattttgctacactgacaagagtatatcgaatgacaaattttatgaaccataccaataatgcaaatatgaacagaaaaatacatcagtgaatctatacagttttattataactaatcagaaaattatatcaacaaaataaacacttatgaagcagcagaaaactgtaaggctacaatgcaaactacattaaatacactcagccaagcatttaggaatataaaaactaccttgaattagacatgcaatattaaaagaaagcaggactgacaaaa

SEQ ID NO: 236675 - DNA, 176 bp, Homo sapiens
ggaattttttccagtatatttgaattcgatttccgtatgaaataatgctaaaatgttacacttaaacatgatatatttacatatttactttaatagattggaatatgccagatgtgcaagtgtagaatcatactaatgtggatgttttcatttcctgtaaatcaattcataaaggt

SEQ ID NO: 236676 - DNA, 412 bp, Homo sapiens
ctctcctctcccgatcccctcggagctctctagctctccctgtggccctctctccctttcgcattttggtccctactctccccttcccttggagcgcctctcgggtctctcggaccccggcccccaccccatttccgaatctcggtctccgcgtactcagtctcttctttcctctccctgctcccgcccggggtctccgcggccccgcccccttatgccccgcccacctcgaggcgcccgcggcccaattaggcgccggccccgcccgcagccccacccctagagagcccagagccgcgcggagctggcggggcggggcccggccgagggggcggtggcccggctcaaggaggcgggaggagtcaggcgggaggctgcaggcgggaggcgggaggcgggaggcggcggccgc

SEQ ID NO: 236677 - DNA, 723 bp, Homo sapiens
  misc_feature (5)..(5): n is a, c, g, or t
tgtcnaaccttacgaccgcagaactcagagaaggatcagatagctcaataagaaaagactttactctttctcatgtctatttgaaaaacaaaagagttaaggatgatatatttcgtattttgtactttgttgcagtaatatttttactttcatggtaattcaacaatatttcagcttaatgacagtctaattattttgtaaacgtcacaaatacttgagtcaagggtgacattcggtcttttgatattttatatttttttgcccagaaaaacagagtttgcaccattaaatattgcctcttgaaacattcttaatagggagtggggccagaaatcctatgttaatatgagaaatgaactatcaaataaatcataactttaatttttcaaaaagcatttttacaatttaaatatatttttgcatttatttttatttctctgtggtattataaaatcttttagaatgtactgtaactcacttaatcgctagtatattctaagcagcccttctgggaattcttaacagaaacagcatgaagtgggtgctgagaacactgcagcttgctttataatttacaatgtaggtgtaaatcctttctcttaagaatagcacaaaattgccatttaattcacttcaggaacatttaagttaggaacacttatactttaaaataacactgtgttttcctcaagtcatagccaagtgaaatgttcacccaaagta

SEQ ID NO: 236678 - DNA, 466 bp, Homo sapiens
ggttcatccatgttgtcacaaatgacaggatttccttttttttttttaaaaggccgaataatttccattgtatataccacatcttctttatccattcatctgtttacagacacttaggttgtttcaataacttggctattgtaaataatgctgcaaagacaataagagtacagaattctcttcaacatactgatttcaattccttcgaatgtatacccagaagtggggttgctggatctagtgtataaataattctgtgccatatggtcagacagtactttctactactagtaacttttgataatttgctgcttattagtgattactaatcttaaaaaatcaatttaatgcactgaagggcaagttggtaatatatatcaaaacccttaaaaatctgcatgccctgtgactctataattccatttctaagtgttaatcctaaataaataataatggatgtatacca

SEQ ID NO: 236679 - DNA, 416 bp, Homo sapiens
ctcctggcctcaagtgattctcccacttctgcccctccaagtgctggaattacaaacatgagcctctgtgcccagccaaaagtaccttgattttatttatgatattgctaaggaaaggaggcagagaaattctgggcagaagagggtgggtccccaatgagggctccccacctggagctgaaaagcctgatactatggcccaaagtgagcatttacatccctgtttgccctcttgaaagttgccttttccataactacccatggcccaccccccatcctgtgcccatgaaaaccccaggctcagctgggcacagtagcctgtaaccctagcacttttggaggccagggcgggcagatcacttgaggtcaggagttcaagaccagcctggccaacatggcgaaaccccacctgtact

SEQ ID NO: 236680 - DNA, 421 bp, Homo sapiens
tgggtacagagtttctgctttgcaagataaagcgagttctggagatgggtggtggtgactttgcacagcacaatgcgtgtatttcataccactgaactgtacacttaacaaacagtgaagctggcaaattttatgttatatatattttactacaattttaaaagctgggggaagaattgcaaattttggctgcacagcctttacatcagaggagatggcccaggtgcagccatgtgcggtggctgcggaggcaacagtgaagatgacaatgattgctgacatttaagaagtccccagagacagcagggataatgagtaggaaaaaactctgagggcaggggctatgtcataccctcctctccatacccagcaccaagcccatagagtgcagtggcgggctctcagccacagcggctgagga

SEQ ID NO: 236681 - DNA, 504 bp, Homo sapiens
gagaggttaagtaaacctgcccagtgtcacacagcagcaaggtcgtggtactgggatttgacccaggtcttcccgcccgcacagctttttgaatatttctttgctcgtgcttctgaaacttttgtaagagtcactgaaggcgcttgttgaatgtattagattagcgtgcacgtaactcttatatgatggcccacactttcagaaacaccactctgcctgctcccaagccttgctctttggccagtcagcaagagtgactgtcattagaccgggctgtgggatttcctggcccctgttcaccagaagcctgagcagggacaagagcggcaccccttacacaaatggcctccgtgtcccctgagcgaggcctccaccacatagccctggtggggctcaacagttttaagcctttgcacagataccacttcctgttattactgagcccgtaactcctgtagcctcctttttagaaatacttatgcctcaggagaaatacagtttatt

SEQ ID NO: 236682 - DNA, 721 bp, Homo sapiens
tatgtattttattttcctcatctttaaaatggataaatgttacctttcctgattcaaagattctaggcaaagatcaaaagaagtcaaagtttgtgaaggaactttgaaaattatatatttctctgcaattgtgttagggtacttttctgtctttgatttatgttggttcttggagtgatactttagatgtacaaatagtaggtcagaacaaacctgtatgtaataaattctggagaattgagttcaaactttggttttgcttatatttggataaattatcatcaactttgttgaggtgtaatttatacacaattaaattcacccatttcaaatcttccatgtgttttgactgtttagataaattgacaaataattatcttagataacagttggtatttctacattaaagaagggagaaagagcaccctcttttggcaaaagtttctcctgtgtgggctctccggtccccctgtctcatttcaaaatcagatttgcatcctgctgttggagtacacttgagccctttcatttatactggtgcaggttttgtagtctcttagagattcagtatgtcagtcccatgtctgagagcaaaggagaaggaagagggtaggaaagagcacctgaattgaatagagaggagggagcagagaaggcagaacagtgagatagtatccatttagtctgagtatttccaaattttccaataaaatgtcagtgg

SEQ ID NO: 236683 - DNA, 514 bp, Homo sapiens
tgagtaaataatatatgagcatggtacaaaggtaagaatgttcaaaaaggctgatggtaaatggtaggacggtctctcattcttgcacttgccacttggtttctttctccaaaggcaattgctagtataaggttcttgtgtgtcctgatactcatgtacactatgcacatgcaaaaacatgtgtatatgtttgttattgcttaaaaaaccaaatgttggaaatctgaactaactctttcacactctggtatttttagtttaacaatatatgtgttgtgtcttggaaattagttcatatcaattcatattgagctgtctcattctttttttaatggtcatatacagtagtattcaattataagaatatatcctaatactttttaaaaatttctcattgatagttctttacatagcttccaaaggattgtttttacaaacaaagctttaatgaataaggtgtacatcattgacatgtttgctgtcatatatgcagaataaagtaccaaaagtaaaa

SEQ ID NO: 236684 - DNA, 617 bp, Homo sapiens
gtagcgtgcacctataatcccaactatacgggaggctgaggcaggagaatcacttgaacctgggaggcagaggttgcagtaagccaagatcgtaccactgcactccaacctgggcgagagagcaagattccgtctccacaaaaaagaaagatacagagatgaaaaatacactgaagactgtcagaataaacattgcacaagtaaagatttgtgattttgaagacttaaccatagaaactatccaaaatgaagcagaaaaaaaaaagaaaccctgaaaaaaatacatgaacacaacatcagtaaagtgagggacaacatcaggtagccaaatgtgtgtggaattggagtccctgaaggaagggagggtatgagggaccaaaaaatatatatagagagagaaaaaaaaatggctgaaaaatttccaagtgtaatgaaagcagtaaacacacagatccaagaatttcaaggaactccaagcacaggaaacatgaagaaaaactatatactaaggcacatcttaagcaaattgcttaaaaccatggtttaaaatggccaaagaaaaagatacattatatacttaagatcagggtgacaccagatttctcattggaaacaat

SEQ ID NO: 236685 - DNA, 730 bp, Homo sapiens
agtttcaccttgaacacttctgtggtgagactgtttagtcttgtagctctaaactccagccagactctgtctcaaaaaaataaaataaaataaaaataaagtttagtaaaataaaaaaaatcagtaaaatacaaataaaatttagtaaaaataaagctgattctaaaatgcatgtgcaacagaggatctagagtagccaagatcgtaccactgcactccaacctgggcgagagagcaagattccgtctccacaaaaaagaaagatacagagatgaaaaatacactgaagactgtcagaataaacattgcacaagtaaagatttgtgattttgaagacttaaccatagaaactatccaaaatgaagcagaaaaaaaaaagaaaccctgaaaaaaatacatgaacacaacatcagtaaagtgagggacaacatcaggtagccaaatgtgtgtggaattggagtccctgaaggaagggagggtatgagggaccaaaaaatatatatagagagagaaaaaaaaatggctgaaaaatttccaagtgtaatgaaagcagtaaacacacagatccaagaatttcaaggaactccaagcacaggaaacatgaagaaaaactatatactaaggcacatcttaagcaaattgcttaaaaccatggtttaaaatggccaaagaaaaagatacattatatacttaagatcagggtgacaccagatttctcattggaaacaat

SEQ ID NO: 236686 - DNA, 427 bp, Homo sapiens
ccataaaataaaaagtaaaagcatctaaaatggagcacaagtctagaatgtttgagctataatgcaaggattttctagccaaatcttcttttacagatgaagaaactgagacagggttatctaataagttttctagtggcaaactgaaatgcaattctcagggtggttaatgagatacaagttttgaaattagttgtacttataaggtgtgaaatcacaattttaccactgacttagaatgtaacttggacagcttgacttccctaagccttagtttgttcacctgtaaatttgggctggtgaagtaaaggatctattgggctgtagaagtaaaggagttgatacatgtaaaatgcttagcatatttttgtcacgttgtatgcactcaataaatgatacctccattattactattatttttagctgt

SEQ ID NO: 236687 - DNA, 599 bp, Homo sapiens
ttcctcacacagtacagcctcattcctcactatcttctgggcacatctgtgagctgcctgctgatgccatcggctctttgttccaggaagccatctaattcccatggtggggaaccacagccagctcccttacaggactctcgcagtggaatcagcatgatagtcagtctaaccctgttttcttaagatgtatccagctctctactttctccactttgaggttaacagtaagactttggatttagtcaatgagggtttggattcagttccctcacttactaggtgagagacctcaagcaagtcactaagcctctccaagcctcagtttccttgtatggaaaatgggtacaatactgcctacctctataaactagtgtgaggattaagatgatgtgtacagagccagcacagggctgggaaaagaataaacccctaataacccatagctaggaggataaggagaaggttaacgtcaacattagcagtactaccagaattttatcttctctaagacaggcaaaggaaattctcactggtccatctttgagttttgaacttcgtatcttttgcatttaataataaaatagattactgccaaa

SEQ ID NO: 236688 - DNA, 347 bp, Homo sapiens
aaccgggtctgacatctagtggcctcctgggcccgggcagggcgagggcggggcagggaagaaggtggagggcagaatgggaggcgtggagcgagaaaatcaggaagcgcgggaccaagccggggaagggcggcgggtctcgcccctggcacccgctctcctcggggcccgtcccatcccccaggcctggccgaccccaggtccttccgtgcgcagtcggggctcgcaaggacgaatcccgcggccctcgaggcaggcccgggggagctcccggccctccacccccgcaggccgcagatcccacgcacccccgatcatgggggccccggagggaggtcgcgaggccg

SEQ ID NO: 236689 - DNA, 516 bp, Homo sapiens
acatgcttgccactgagcaggtgcttagtttgtatttgttttgttttgaactgcccaactattttgcttgagagatctagaggtaaggaatctttgaattggattgtagtcctcactggccataggaccttcaccatataatttaacctctttgagccttaagtatttcatctttaaaatgagggttgtgaaaaattattatttaatatttcttttgacaaactaactcccaatttacacaaaatatacagaacagaatatgaattttagattaagactgctattttcttaggaaatagagaaggcttatgacttacaatttaaaaaatcaagatttaattagtactgccagaaaggtctctgtatatttccacagtttcccatgcagtgctttataattatttaattgggttaggttgatagactatataattagatagtgaagtttaaatattccaaaaaaattcagaatcaatttttaaaaaaagagaatcaatatgttatggtagaatttct

SEQ ID NO: 236690 - DNA, 378 bp, Homo sapiens
atcgtagttattgacaagctttaagatgtttaacctaattattaaatagtattgcctgttttttaaaaatctgctttattaaggtatggctagcatttaaaaagctatagatatttaatgtctacaactggatgtgtttgaacttaagtatatatattattatcactgtcaatgccacaaacctatccatccatcagctccaaaagtaccctcctcttcttttccttttgttgttagagaacttaagaggtaccttattagcaaatttaagaatataatacagtattattaatctgtacagatctccagaactactttgtacagatctccagaacttatttattttgcacaaatgaaactttgtaccctttgaccaac

SEQ ID NO: 236691 - DNA, 366 bp, Homo sapiens
agatttcactccagacattacgaccacctcatgctcagatgccactccgggttcagcaattgttctaagaatgtctttaatcaccagggagctgatatatgtgggcatttcctacccccttattttcctaaatatatacgttatggtgttctatttgtcccagtggtagatctgtatatttttggaaatatggaaagtgatctaaattgatgtgattatttttattgcgtgtaaatctgcaatcctcactaacatgttggaaaagtttaacattttcatcctgcatttggattggttcatttttgccagttcagattttgtagtctgatgtagagcaaaagagaaatctttcatcagcattgaaaa

SEQ ID NO: 236692 - DNA, 426 bp, Homo sapiens
tgttcttaaaagctgctggcaaagatagacaaatctagaaagccttgatgttgcataaacaatattattttcattacatgtatttctacacattcccatgaaaaattaaattttggctccttctgagagccaaaggtgagtgtgtgtgaagtgagggagatttatatgaaaggacacaatgcaaaagatgaaaataattctatcctctttcccttagacaaatggtttgggtttaactgcccttgtttttgttggatgtgaatatgttaatcttctttttcaaaacatacagacttacggaaatggaagtgaacatctgttcaactgtcaagtcaccagctaaattcaagtctgagaaaagaagacaatctgtttaaatgaaactttgtgtgaatgaaggccagagtttttggcacttgtgtttgc

SEQ ID NO: 236693 - DNA, 504 bp, Homo sapiens
aatatctgattgccttcagtgcgtcaaaggcacattcctggtacccatggctgaggccaagaagatggtacccccgtggcccagtagccccaagcacttcttcagcaggactacagggaatgtgtcaaagatggggctggccctccaggtcgatttagaatgaagagtaaagactctccgtgaatttacatacttgcaacacaaggtcatcttgtaacaggagaagaatttggatttgaagttagacaggtttgaatttgactcaccctgaggaaaactagtcaagctacctctctgcattttagcttcttcatctgaaaaaaatgagcttatagatagtagcaccaactctttagagtttcaatgaggattaaatgcagttaaatgaaataatgtatgaaaagcacctatgtggccaaggttatgttaggggctgtgagagtacaggagatacatagcatatgtatttgtcaataaacgttcattagaacttagtatatttga

SEQ ID NO: 236694 - DNA, 375 bp, Homo sapiens
cactgggactctttttaccctgagatatgaagaaaagtggctttttttttcccacaaaggtgtggccttcttacccacttgaaacagcctaaactgtggaaggaagctttaatttaaattgtgtccaagaattagatcttttctccatatgggagggaaaatggcccaaggtccattatatacaagatttctttgccctatgagaaaacccagacctttgcaagcattgcacaattcacccagcccttctagcaatcatatcaggaaggcccaaagggaatgattccccaagactagaaaagcaacttccagagtgtattagtctgtttttcacactgctgataaagatgatatacccaagactaggcaatttac

SEQ ID NO: 236695 - DNA, 563 bp, Homo sapiens
ctgtctcaccctccctgtctgtggcctgtggtccatggagagagtgcttgggagaggctgggtacttcactggagctctcgatcccagggagcttctataacaacttgtgcagcagccccagggctcagagaaagaccctgaccccaagggccctggagagtgctccagccttcagattgttgggagaggcacaggtgtcagaggccagccaagtcatttctacctcttctgctcaggacaccttaagccaggtcataaaccactgtttcaacttctgtctttgaaagcaagccctcttgctctcacctggctgaatggtggactctcagaccccgtggtggtggggacattcctggtctcttttggtggcttgactccgatctccccctcacgcctcccttgtggctgctctccacccctctctgcctctgcccaccccagaacatgcagccgccttcccgttactgggaggacaaatggccttattcagggacaccctgccagagctgtctctctaagacaaagctgtgcgcagctctgcgtgaaaaacagctcgcggccg

SEQ ID NO: 236696 - DNA, 405 bp, Homo sapiens
ctttcagcaaggcccgggaccgtgcggtgcaccagtaggccccgtccgcctccccagccgtgcgtttctcaaaggcagggtgagcccagcagtgtgtgtgcgtgtacgcgtgcgcgcgtgtgctgggggcggggtttgcaaaactcccgcgagcccgccctccctccaccctcaggctgcaggcccccgcggctctaacagccggtgccctgctggacacaccccgcctcgcggaagcggccttggcacgaaggccctggcgacccccaggcagcgcaacgggccgctcccctctcacccccgcccgcgcgaggccccgcgggaggacgcggacagaggctgttggctgtgctgcctggccccacgcctcctgtctgcgcggcgggaacactccgcgggcggccg

SEQ ID NO: 236697 - DNA, 2374 bp, Homo sapiens
attgcatttaagttgtgccgaaatgagggaaagttttattattttgatgcccaaatatcagtaggtacagtcatatggacctcccaccataattctttatggagatttgttgaagattatttatacttgaggtaacacatacctgagtgctaacctctagtctgcattaaaaaagaatcaatgatcttcataaaaataattgagagccaagcaatattaggtctaaatttatatcctacactgtcactgtttttttttaaacttatactcaaacatacacaacagtaaaggaaattatatgaaaagaattataggaagctagatgaattgtttatctaagttgtcaatgcaaagcaaagtttgttttatctgtatcctgtattattttgtaacaaaccctgaacattttgtttcattcataaatatttcattaggtatctttgaaagataaggattttttaaaaatataactctaatgtcatttatattttcaaatatagctagtcagtgttcagattttcctgttagtctcaaaattctttcttatggtgtgtttattgtaatcagggtccaaataatatctatatattgcaattggttgatatgtctcaagtgttttttgatccatagttatccattctaattttctttcaaaatactaatcgaagaaactgggttgtcttatagtgcttcccatagtttggattttgtaaactatgtttccatgtttagcatgttattttttcacctatattctctgtaattgatagttagttttaaaagcttgattagctttaaattttactttttaacaagagcacctaatagacagtggtgtgtatttcagtcaagaagcatgaaaagtctctcttttgatgattagcagccatttaataattgctgtctagatttatcattaattgtgggctacaaattatgatactctaattctatcccacttttttacttattcactggaatatttctatgaattgatgtttccctataacaattatttggtcaccctttgaaggacaattcttacaagattagacaggataaatgctagattcttttcctttatttagctgttttcaaaataacgaattggaaatctagcatcctccaaagataactgatgaatttttaaagatattataaatacatggatttatatgcaaagtgttttaagttctttctttttaatttttatcaatgttcaaattgaattatcatttgtaggaacctcctcaagttcattcttgagtctttttgacatgatttcctaagtagttattgacagttttcttactttgtgttatgacaggatgtttatagtatgcatttcctaccccagacctgtaatctgccatttgtctagggagccctactttcttttagtaggaaatagtatttagaaatccatatgggtagtaggcatgttcttgctactggattggccattatttctaggcttttgtagtggacagaactgggaaataattttcttttttaagtgactttgatacatcttaaggaaaagaagaggaaaaagtcctatattgtttgtattaataatattgttctgagacaatctgtgtatgttgtgggataaaacaagtgaggaattatgttagtgtcattagtaatcacagttttcagcctgattaaaaggagacgcatatgtaagattgaagaagtgaaaaccatatagtcttgaatttaaatggaagtatcagtatgacctcagtttttctcccccacaacccctaccataagtcgccatttaaaagttttagtttgtatctatctatccatccatctatctgtctgtctctcatcttagataagtgttagcgcactgtacatactgttctccaccttgctgtttttaccttaaaatatactctggatattgtacatgcgctacagcatgcattctcaatgggagatactaccgcaagagggcaaatgttgactcttgaaaggtgaaaaaaaatcttgaatataacaatggtttttgacccttcaaagggccatagtacataaacagatatataatacatttgtggcattaaagtttcctaggggtggctgggtagcgtggctcatgcttataattccagcactttgggaggccaaggcgggtggaccacttgaggtcaggagctcaaaaccagcctggccaatatggtgaaaccctgtcttttactaaaaacacaaaaattagctgggtgtggtggtgcatacctgtattcctagctacttgggaggctgaggcacgagaattgcttgaacctgggaggtggaggttgcagtgagctgagattgcaccactacactccagcctaggcaacagagggagactctgtct

SEQ ID NO: 236698 - DNA, 540 bp, Homo sapiens
gatggcgtcgtccttgttggcgcagattgtgttggggggctggttgtttgtgggcgcctttaatattcaaaggggagaatactgttctgattgaggcattatgcccgctgagttgtgatattacatccatcatcttgttcaaataaatagcgccgtatctatatgtcggaatgaataaataaaagtgctgcagcagggaggttgggctggaaaccagaggcccacgatgctctttgctggctttgaaatgcccttgcaaagaagtattgaaaatttaccagcccacaatgagtcttttaaatctccttttccttgctaccaccaacccctgcaccaaccaagaatacgttgccagcagagttctttatttagttggcattggtttttattgaccctgattgaatttgaaattgtaaggctgagagaggatttgcaaaacatttgaatacattttgctcacggtattgttttgtaacttggaggaatttatctttttagccaatcaggttaaggtcaataaatttggtttttaaaaaaatg

SEQ ID NO: 236699 - DNA, 2021 bp, Homo sapiens
  misc_feature (707)..(707): n is a, c, g, or t
  misc_feature (927)..(927): n is a, c, g, or t
  misc_feature (1001)..(1001): n is a, c, g, or t
  misc_feature (1121)..(1121): n is a, c, g, or t
  misc_feature (1257)..(1257): n is a, c, g, or t
taactaatacatgtacaaccaatcagacttgccatggtatgggatctatataatcttccaagcccccttaagtgggcgataatgaaaactttatcattaggaggaggtttagagagttgtttttattgacatcttgtcttgattcctcttctgtgtgacccactggattcagaggtccccatgagcaccctcaggttcaatgattcatgagtagaactcagaggtagggaaaactgttatatgcacatttagcatttattacaacaaaaggatgcagatgaaaagcagcaaatgtgaaaggcacctctagagagagtccaagagagcccaggcacaagcttccagtggggttgcacagtcagcatctaatcctcccagaaataatgtttaacaacacgtggagtattgtcagccaggaaagctcatccaagttttggtgtccaggggatgtttgggggtatggagtaggtatggagtgccttcatggcctgcatggctaaacttagttattcagtctccagtccctctagaggtcaagctgatactgcacgacctaaggccccaccataaatcacattgttaacataaactatctgtcatggcacgaagccccaggtacaagagacactcatcaggcaggatattccaaggatttacaggggattccccaggagctggtcaaggaccagatgttcctctgaaaggtncaggatttgagctcatctgtggagtacgtctgtggagtcaactttcttctgcatccccacatactgatttgccaccttcattgtatcagattcctttttcactatattcaggtttgcggttgctccagtatccctatctatgctgagtctccacgtagagcatgtgtgccctctccagtggctctgcacggaccccttatttctcattaccagggacagnttttctcctgatgtgcctggtgctccttctccactctcttgccttaggactctgctgggccatgagtatttttnttacccttttgtgacctagggctgcccttgggtgaggaaagtcactttctgttcatcatctaagtagaaaacagtttctgccattggaagacccctgagttccctggcactcctgtgaancacaaggtgcctggggaggtagaacttggacattggagagaggagcagccagacatttctctttctaatcatatgcagaaagatttctttttattctccagaacacttgaaagactctccaagttatgcaaatgtnaagctcataaatgtatattatcatgacttttgcaaagatgaagaggatacagcaaattttctgggaggcaaagggacttctacctggataggaaccaagcaaactcattaagcatggattaatttgattcaacccttgcgtggatattaattaaggacctttgacaggagagggtcctcaaggttcctcaaagagtaacttatcatcaaggaaggtgaagaatggatggatggcttgggcccaagactggggctattcacttgtggggaaacccatgtgaacccagttaccccatactttgggaataatgactgagcatgactataatctttaagaagctcaaatgcggaatacctctgaggcttatgcaaggatctggcctagcatcaaggacaaaggctcagaggactccttggggccagttttctacagtcataccatcagccacaacagcagcaaaggcagaaggaaaacagggcccaggagtggctgacgactgcctggagtccaactggtctcctggagttcataagaggtttgaccccttctgagctgaatgtgtcctgatttaggggatagctagggcaataagaaagcctcagggggtgctactgatctggaactcctactaattagtgtgtatgtatgtggccaccagtggttagcagatgaggtgaaagagatgggacagtgactgtatctgttctgatgaaggagattgtgcagttacatgcgtaacgtcattaaacttcattcttccaggt

SEQ ID NO: 236700 - DNA, 347 bp, Homo sapiens
gttgcaaagaacatgaaaccccaagtgtgattcctgtggtatgacagtggttgcatatcccagaagctggccctgacctcagacctcttttatcaagctttccctgaattaattacaatcttctcagtgttcccaaagcacttcttacttttaactgcagcacttccttgcgtgctcagcatatacattatgtctagccctgaggatggtttcttcaagaagagaaccttgtctcagtcatgtttatatcctcaacagaacctgagttttatatatgttgtgttcaattaagaatgaaattcaatctaaagaaaattttttaccttaataaatatttttaagttaaa

SEQ ID NO: 236701 - DNA, 868 bp, Homo sapiens
ttgtatctatgtgatggtaagtttgatgtgtcaacttgtctagactattagtatcagttatttaatcgaaccctaatctaggtgttgtcatgaagatattttgtagatgcggttaacatctacaaatcaagagattccacttgataatgtgtgtgggcctcatttgatcagttgaaaggctttaacattgaaaattggtgtttcctggaaaagaaattctgcttcaagactagtgcctaaactcctgagtttccagcctgttggcctaccctacagatttcatacttgccagtcccttcaattgtataagccaattcctaaaatctatttatacattttatatttagatctctttatacatgtttatacagaatgctacggttctatctctctggagaatgctgactgataacaatactcaagtaagagacctgccagttttataacaaacagtatagaaggcagagagtcagaatagaagggtttaagggacaatgagaaaaaaacaattatgagtttagagcttgggatgaaggcaagtgctgtcaaaaataattcaaagtctgaactgaagttaaatgattgtttgatgaagacagtggtaggtttgagcaaaatttggtggttttgagtggaacatacaagtaaatttaaaaactaacaaaaatatcagaaaataataatgcagaatccatgaagaatcattaatttttattagttaaaaaccagtattggccgggtgcagtggctcacgcctataatcccagcactttgggaggccgaggtgggagatcacttgaggtcaggtgttcaagaccagcctggcccaacatggtgaaaccccatctctactaaaaatacaaaaatt

SEQ ID NO: 236702 - DNA, 461 bp, Homo sapiens
tatccaataggataagtaaaaacaaatctcttacaatgtctttgtgaaatagcagaaaactgaaaagagagaatacttttataatgcgcctgatagaaaagacatatttaccgatcaaagaaaagtaatttgaagggcagccgatgttttcaacaacagccaacaatggaagccagaagacggcaaccaccttgaacaaacagggaaatatacacacttcaagatagacaaaagctgcttcccaccaatacttctaagataatgtttctaaaacttgcctgatgatagggctggaatactcaatgttgctggtcaagcatacagatcaacaatcaaaatgcataaatacaaaatgataagagacttctgctttccagtttcacataagtcaggagcttggaagttgccactctacctaacaacaggtaaaaagctgaataaactgaaaaaccaactcttct

SEQ ID NO: 236703 - DNA, 972 bp, Homo sapiens
aaatgtttgaggcattgattttatttaaaatgttttatctttgatctaagggttttagagttattgttcaaagttacttcacttttatgattgaatttttaaaaactgagtgtgtaattttttggctaataaaagactacaatgtctactgttacatctgttgaaaatgagaaatatttatgcatatggtttaaaggttaaatatacagtttgtatcttaccatgggttagttatgacattctcctttcgatattagaacatcaaaagctggggctctttggcataaataacagaactgttaaaacctgtatttaaaaaaagtttaatgttgatttaacctgtatatgtacaagatgcctttatatggggaaactatacaggttgagcatccctaatctaaaaatccaaagtctgaaatgctccaaaatctgacactttttgagtaccaacaaccttggggtcgtgatcagttgtgaagcatgttgtaagtaattagatactaaccagaggtgacaaatggttttacttttttattttcagtaataaaatataatagattcatggatatttttatatatctctctattaatgcgttcctataagcttttttaagtgaaagagaagggtagaattttaaggagcttgtctaattgcaggactttatctttgaaccaatgagaacatcacaagtttaaaagtcatccattaaatgtactgaggtttgtaaaaagttgcgaactgctgatctaaagcccttacctagtgaagtttatacaatacaaatatatgaccatctaaacccaacctaaagcagtatcaaaaatcaacattttctttcccttttttggccagaagggaacgacttaactatactttctttcatattatttatttaccgttgttatttctttataaattgatggataaaatattttgtccagttttttataaacattggattattttatagt

SEQ ID NO: 236704 - DNA, 544 bp, Homo sapiens
cgaggaaacgcgccggaagccagggtggcggtcgtcggctggccctcgctccctaggcggccagcacccgggccggcgccgcccgaggccgcagccagagcgcccagccggcgggcggtctcgggcccacgagggggcgagcgcagggcgggagccgggcgagcgggtcgcgctttctttccccgggctccactcgggcggttcacgtggcgcccgcagccgcagtgagcccggcgcggccgggggtgggggcctggggcgagggtggggagaattggtagttggtggtggagggtgtgtttgggtagggggtggcgttaggaatggaggcgccgccagacagcgagttcatttccctggtaatcaacagcaagctgctatattcagagaatgctgtccctttaattgaacaggctaggtaattaaatggcacttttccaataggacgtgctaggtaaatctaatagttggttatttaatatcactttgaagtctgcccactcaagcacaatgacagcacaggagcatgtgaactattagctag

SEQ ID NO: 236705 - DNA, 402 bp, Homo sapiens
gcatcctgggccggctcccagaccagaaaatgacatcaggtaaaaactaaaggaagctgaataaatggtgggctttagttataacagtggatcagcatgagttcattaattgtgacaaatttgccattctaatgtaagatgttaagaggagaaaccgggtgtggggcatataggaactctgtgttagcttggcaattgttctataaatctacaacgaatctaaaatgtaacaattattggaaaggaggactgaaaagattcaagagaaagtgataatattgaagacaggggaagaaactgacatacagataataggagtccctgaagaagaaatccaaagtgaatagaacagtgaaatttgtaaatcaagaaaagtttcctgaaataaaatttgaaactaca

SEQ ID NO: 236706 - DNA, 600 bp, Homo sapiens
aatgaatctgccagctttgtaatattctctataatctgtactaggaaagtttttatgtatgtataaatggcatgatttatttttttgtcatctaatttttaaaaaatataaatctgacttgtttgttttaaatggaatgattagagtattccaaatggtgcctttgcatgtgtttacagtatctatattgtagaactttgactagtggtctacttttgtgtagtatggcttagtccacagctcttctgtttcgcctattggtgtctgagacttagggactctttactttaggaaagtatgcactttacttgtaactatgcttctgctggtaatcttaggcctcttcacactagagtagctccatgggaaggccagttgggcaagtagaaaagataacagtggcttcttccttcctagttctcagtgtactaaatatagcgaatacttgtcaaagcattatatttctttaaggttgtttttcttaatactggaaatattatattggatttcttattttttggcagaggggttgttcaacaatcagtcttcttttaagaaggtcttagttttcatttttattcattaaaccctctgcccctg

SEQ ID NO: 236707 - DNA, 438 bp, Homo sapiens
caaaagagatgtggggttttattgggggcttacatacaaaggagagggtacagtggcagtgggctggacgggagaactgccttatatacagtccagtggcagtgggctgggcagaagaaccacaactgcctgccataggcatgcagtttatatagcatttccacttagcacttccacctagcaacctccacctggcactctttattctacccaaaacttggagcctcagtctcctgtagggcttgtgttccaagagacaggttgggggctcagatgtccttatagacaaggagggaatctctgggttggccactcctgaattccctagctcagaacacacattcaggtgcatctgccatacaaagtcattctaaggatatgcttaaattattgctgtcaggtatgtttactataaccatattatttctctttgaaagc

SEQ ID NO: 236708 - DNA, 144 bp, Homo sapiens
actttccaagactctagggaaatctttccagacgctagacccgagttaaagattagatgttgattgaatgaaacactcctgcttgtaggtgcaatcccacatggagcttaagatatatataagcactagaaaaaaaaacttgta

SEQ ID NO: 236709 - DNA, 349 bp, Homo sapiens
ggggatggaagagtgcctcagatggatttgtatcaagaggctgtgctctgaatccccttatggggtcttgctaagctggaatcccacatgaagtcacccacctctgggcaaggtgcaaaagcccaagattcacgttcatgtgttgcaagcacaaaaagaagatcctgtggctggagtagagtgaggaacagtgagaatggtaggagcagagggcagagaaagtggcaaaaacaaggtcgcatgaggccttgtaagccatggtcaagaggtgatattttattttaaatgaatccaaagtaattgcaagtttttgagcaagtaagcaaaatgctcctttgcaaaaaacaaa

SEQ ID NO: 236710 - DNA, 529 bp, Homo sapiens
tattttttttaagatgaaaggagagacccaatcttgctatgctgcccaggctagtcttgaacccctgacctcaagcaatcctcctgtctcagcctcccaagtctctgggattacagacacttccaataagaagactgagccaccaggcagatgttataagcaatgtgagcttgtgctggaagaagagagaatccaccagtgtcctgggccctccaaggcctctctgagggaaagacatttggacagagatgccaaggacaaggaagaggcaggtcacccacctctgggcaaggtgcaaaagcccaagattcacgttcatgtgttgcaagcacaaaaagaagatcctgtggctggagtagagtgaggaacagtgagaatggtaggagcagagggcagagaaagtggcaaaaacaaggtcgcatgaggccttgtaagccatggtcaagaggtgatattttattttaaatgaatccaaagtaattgcaagtttttgagcaagtaagcaaaatgctcctttgcaaaaaacaaa

SEQ ID NO: 236711 - DNA, 485 bp, Homo sapiens
atacggtatttgactttctgtttctgagatgtttcacttaagataatgacctccagctccatccacattgctgcaaaaggcatgattttattatcttttatggctgaatactgtctcatatatatataaatataaaaaatatatatatatatataaatgatgacacacatgcacacgcacacacacacacactacattttctttatccagcttcagttgatggtcacttaagtcaattccctatctttgccattgtgaatagtgctccaatagacataaaagtgtaggtctctttttgatataatgatttcttttcctttgggtatatacccattggtgggattgctggatcagacggtagttctgttttttttccccaagtaacttttgtttgtgaaggtttatattgactatatcagaaatgaaaactgacaaatttaaaaaaatatttaccaatcttttaaaataaaccaatttcatgctaa

SEQ ID NO: 236712 - DNA, 231 bp, Homo sapiens
ttgctcccatctgctcccatccccactaacagtataagtacctttgcctgtcctattgtatcctattcttaattgctgttcattgtcagtgttccctacttgactgtaacctccacgaggtcagatctcatcttgtatccccagtgcttgaagagtgcttgctacatagtaagcatgcagcagatgtttgctgacaaaatcaaataaaagaggaattatttttcactgtct

SEQ ID NO: 236713 - DNA, 386 bp, Homo sapiens
gtccaagtgatgggagtttagcattcgggtcttacttttcgtctcttgaggttttggttattttattgtcatgtctaagaattatttgaagcatcttcgtgttaattaaaagttctgcttctttttagaactcagcatattgaagggattttatactgaaaacctcagacctggttatgtatgatgcttcttttgttttgtgtttgttgtaactcagttatctcttttatgctgcattcatttcccactctcgtgttactgaccccaagttaaattaggttctgtgggagacacaaaggtgaatgagattccgttcaacccttaaggagctggtattattggagggtattatagatccagtgtattgtgactgtatccctcggaga

SEQ ID NO: 236714 - DNA, 195 bp, Homo sapiens
ctgtctcaaaaaaaaaaaaaaaaatttttttttgcacattatttacagttagtaatattttcctttcaaagtatctaaaatatctgtaatagctgaacatatatcaaacagatctatagagactagcacatgtaaaattttttttaagtttcttgtttgattcttctgtatttcatctttcttcatataaaatca

SEQ ID NO: 236715 - DNA, 784 bp, Homo sapiens
gcaactgcagatgggtgtctctgccctgacactaatgcatcatctcagatgtggaaccaggcccctattctgctattttccctacagcatcactcccacagggtatttgcacatgtggtctattttaatgaaggtttggagcacagtgaggctagatctggccagcagatgtgtttagttcacctgtagagttacatacagacgaggatacttcccttaaacatttactatcatggttaaggtagacactgaagccagactgcctggacttatggtctggtactgcttctcacaagctgtgtaaccctgggcaggttgctttgcctctctgtgcctgttttctcacctgcaaagtggagagaatatcaaagtctacctcagtggttttcagtttgctcccagaccagcagcatcaccatctcctgggaacatgtttgcagtgcaaattctcaggctctatcccagccctctgggagcccttgctgggattctcatgcatgttcaagttccagcaccactgatttacctcctagggttacccagcggattaaatgagctaatgcacgtgcaacactcggcacctggagcagtcagtgatccccacagttagctggtattaggagttgtgttgccaggcatggtggcacatgcttgtaattccagctacttgggaggctaaggcaggagaatctcctgaacctgggattcggaagttgcagtgagctgagattgcaccactgcactccagcctgggtgacagagcgagattccatctcaaaaaaaa

SEQ ID NO: 236716 - DNA, 450 bp, Homo sapiens
tagctgggactacaggcgtgtgccaccatgcctggctaatgtttgtatttttactagagacggggtttcaccacgttggccaggttggtctcagactcctgacctcaggtgatccgcccaccttggcctcccaaagtcctgggattacagacatgagccacaccgcacctggccctcttcaatttttttaatcagtgttttgtagttttccttgtagagatctttcactttcttcgttaaatttattcccaagtattttattttttataggtattataaatgagattgtcttcttgatttctttctcagctaattcattttcattgtatggaaatgctactcgggaggctgaggcaggagaatggcatgaatccgggaggcggagcttgcagtgagccgagatcgcgcccctgcactccagcctgggctatagagggagactccgtctca

SEQ ID NO: 236717 - DNA, 470 bp, Homo sapiens
aatttcttaactcgggaaaagagggcttgctgaatttcagaaggtatgggagacacagattatctccctgttcatctcttattcatctctgtcccctttgcttcaccgttctgtgtctttatctctctggctgaccagctttgtttttctccaggccacacaacaagaggaaaatgcccatgtgacactgctcctgattttatacatttgacttctttagccacctagataatagattcctctctttttcattatctcagttccagatttctagggacgggaatgttttcagagagtcagggtcacaaaacagaaatgtggctttcaggagccacctctgggagcctatgaattgggttgtgaggagctttcaagcaaaggttgagggtagataacccacaagtgccctctactttctactccagcctgggtgacaaagcaagactctgtctaaaaaaaaaagacaaaaa

SEQ ID NO: 236718 - DNA, 485 bp, Homo sapiens
gatgttatttgtacatttgaagtacgacatctttactcctctgtcatcatgcagaagtaattaagaataatcaagtgggtgttaattggatataatgaaataatctccagtcagcccgagcctaatatttgcttcctactagtaattatgaacactaaacattcgtgctaatctccttcttcttacagaagctaaacagagatacagtatttactcagctgatggcttgttttgtctgcaatttaggctgttttaagctaggaaattcataatttgccaagctgtcaccagctgctgggcccagatcagggatgtggagtttctagtgacaacggttcagtgtatgtcatctgagaggaaaggacagatattaattaaactgacctctagttgcaactgtacctgaacgtgtaaatgccaaaaaaaatcgaagttttcagatccactattgtggatcacgaactcatcatacgcggagagtgtca

SEQ ID NO: 236719 - DNA, 359 bp, Homo sapiens
gttaagcagttgctgtctgttccacagggaagctggcaaaaacttgatacaaacattctccaactgcactgggaggaataagtgaaggtaacacctttttaagaagggcatacaaagagataaaagatctacctagggacttactcaaacctagatgctaccattgtacaaaatgttaccaagtctacctatatctaactatagttctgataaagagggaagtgatgttttaatttgggaaaacacacttaatcaaacatgtaaatgagattctgaattaaaattcatatgtattttctctcactatctatcaacgtgctagaaaaataaaattgccttctttggaaggacaggggcaa

SEQ ID NO: 236720 - DNA, 540 bp, Homo sapiens
gttgctttaattgtgtgctaactgcagccaaggtttgccttcttagttaagggtgcggttagttccgtgtgtccccaggccttaccagttgtgaagctggcaagtcaatatagttctgaaaacccaaaaagcagtttgtaacctcaaaacacttagcaaaccttgcatctgacctgcattatttagcctacctatttacattttgataatacctgcatttgaccaatagtttttaagactgtttctatttcttaaagattaaagtcatgtgaactgaaaggtaccagactttatcttccctttaaaaaatattagattcaagcacttgtctttctttaggctgtattaattagagttctcttgacaaacattacgtacagtacacacacaggcaggcagaagaaaacccagttgctgggtggggccctttaagagaaagggctaggaaaacatgcagacattgaatcttacagggttcatcctctcaaggctttgctaaacaaatccttgccacaattaccagccatgccctcaggatat

SEQ ID NO: 236721 - DNA, 809 bp, Homo sapiens
attaacaaaagctaactcaatattcagacaatattaccttgaatctaattgatttgccattcatttgaggtttccggggggaaaattcaggagacagaaatgaatgtaaagtatgaagttaatgaaaacctattattttaactttttgcctgagctgttcctgaagacctaataatgctacttttggcaaaggccaaatttgatgattttggtttaatgtaaaaacctgtgagaaaggagcctagaatggggaagaggcaggaggctttgagcctaggagactgagcacacgaaaagcttaacagagtatgaataatgataggaaagaggcaattgggagaagaacctggctgtcaggaaatgtcacagttggtttgggaagatgcctgcagaggtgcctagaagccagtaagtaaggatggtgagccatccttttccgcttcctgtttcgttagagctgtggagcctccgtgttctgatgtcccctgagtagggaattgtgagtccataaaaggaaaatgtgttaggcaggatgggaagtgtgattaaggcatgagttaagattttggtcaagtagaggagtaagctaggatgggtttgcctgttttagacgcttgcatagagaatggaaagggactttctgaaggaaaatgacattaggtcatggttacctattgtccaaggatgatttaagacatgtaaatgtaatttagggcatcagctagtgaattttctcatggcttttaattatattgtctatttcgagacttgcctcttatctctcagtggtcagttccagatattggtat

SEQ ID NO: 236722 - DNA, 203 bp, Homo sapiens
tagagtcaatgctggagtgcaaaaggagaagctttttgtggtctctgagggctcatttatcttcatatccccattgcctacatagtaccaagcactctgaatcaactttaattgcacttacttccatttgtaatcatgtttctatttttgcttatgtggttgatatcatgaagacaaggatcacgtgcattttgctatgtatc

SEQ ID NO: 236723 - DNA, 408 bp, Homo sapiens
aactgagtggagtacactttattttgcaagaattaaaaaacattagttttgtactggaagcaccttcacacacaagcatatctcttttaagcaatgatttataagcatggctcagaagcactgaaaaaagcaattgcagggattctgaaattcctcatcacatttcattccaagttttgtgtgtagttttctggaatcagttactggattgattgtcccaacaaaccagaagatgtgacatcaccaaattcagcttttgataaatagggtaagtgggaagttatatgaagaagaaacataatttatgtatacatgcatatgtttatgtaaattcattcaagtagaaaaatcctcatgtggcatctgtgaaagccaaaattgtagttttaaatcttacctcccctcctt

SEQ ID NO: 236724 - DNA, 356 bp, Homo sapiens
gtgggcctggcaggtattaggggtagtaggagctcagtaaacatttgctgggctgaagagaatgacctggtgttcatgggcatggctctcatagcagggccttcacttcactgctagatggaggtagcatggctctcttgccactagaggtcccatggctctgtggaaaagctcaagagtgtttgtactggtggcaggaactttcagagaaatcagatttttacactcctgtccctgactcctggcctgatgtggaccttgtctcccaaggccatctgattttctcattgatccccaagagcaaatgcaggtaggcatgatctctagagctgtggaattaaaggagattctgaata

SEQ ID NO: 236725 - DNA, 257 bp, Homo sapiens
aagttatttaggaagttactctgagttcttgtctgttttaacagttttgaacagagttgaggagcatatttttaatatatttaaatttaattgcttcttagagtttagatttaattgtttcttatttaatcaataaactttaaaatagctctaagtaaccttgttatttaaaaatggcaatatataatctggtatttttaatatgaatactttacatttgtttcattttatctcatttataaattaactaaaatgga

SEQ ID NO: 236726 - DNA, 498 bp, Homo sapiens
gactgggcgacagagtgaggccctgttaaagaaaaaaaagtttttaataaaagaatttaataaaaccacattcaccactcttaggtatctaaccaagagaaatggaaatagggtcacacaaaaacttgcacctgagtgttcacagcagcattatctgtaagaactaaaaagcagcaacgacccaaatgcgcgtcgacagatgaattgaacagacaacatgtggtccatccacgcaatggaatattgtttggaaggaatgaagcgctgacacatgctgcaacatgcttgacagcattatgctccgtgaaagaagccagccgcaaaaggccacatggtgtatgattccatttacgtgaaatacccagaataggaaaatctacagagacagaaagtggttgccaggagctggtggtggggtgggggctgcaggagaatggggaatcactgcaaatgggtatatggtttttttttttttagacgacagagtgaggccctgtt

SEQ ID NO: 236727 - DNA, 878 bp, Homo sapiens
ctttgcccatgcagtgctgctggtggcaacagcttccatgtcatacaggagggaacggaggctcggaactgccaaagctccacacggatacacccttgtagagagactcccccatggaagggtcacctcaaccactttctgctggttcccttgcagacatttcaaactttgtcacctattcaaagatggctttctacggactacatgagcaaccaacaagctaacccattgggtgccatgaaaaaacatgaagcaacagccacataggagaggggattccgcacttggagatgctggtcctacctgacggatgaagacccctggtgggaggtcacctggctcccatctgtcgagggctgtcagtcctacacctgtcctctcacaggctaagccaatctgcaagcccatttgaatgaaggtgtcatgtggtgaaccactgttttacatgccattcaatgttgtttgtttggtatatgccatgggctccgtgttccatgtccccatcctgaaaatggaggtcctggggatgagggatctttaggcaaaaagaaccaggccagattggtgtgcacagtgccatgtggtaaaagaggctttccaagccctgtgggcaaactctggggaaaacaggtcaccaaaggccctatgcaggcttcaaaataaaagccttctgagagggctgtgctggggtggctggcagagcaacagggcaaggcctggggaagctggggagagaaaggaaggaaacgggacccaggggaagaaagcgctttccagagggaacgttggagctgtactagttgttaaaacgtggacgtgcatctgtagcacttggttccatccactgcctcccagcacctgtgctgcccctccccctc

SEQ ID NO: 236728 - DNA, 397 bp, Homo sapiens
tgatgaatgtgcctctccaagattatgtagctgtttccatatcacctggggagaggaagccaagattatagtctaggtaagtgattctcaaatgccagtggtctacgaatctcttgagtagcttgtgaaatgtagactccttaccctcagtgagtctgactcagttactctggaattgggcctgaagtctccacactttcccaaacaccccaggtgattgcgatatagatggtcagtggaccacatttccagaaacactaacaggcaattcaattctgctagccatcaggtcagtagatatggcagctgggggagactgtagatttagacagtttcaggcaggtgggaggaaggattcagcgtcatgtggttggatggatttcgaacactcaagatt

SEQ ID NO: 236729 - DNA, 405 bp, Homo sapiens
cctttcatcactttgaataaaacatctcatgtactctggccagtgagttttctgctaaacattctactgagagttttatggaggtttatgtgacagattggttttctcttattgctttaaaaattctatattttatcttttgccagtttgattttagtgtgtcttcatttggattcatctcatttgatgtacttcgggatttgggatttggatatccgttgcctttccagatttaggaagttttcagctgttatttatttgaataatctttcttgatttttctttctctcttattttgagattccatgatgcctttacttgtctgcttgattggtttcatcattctcttaaaatttctccaccctttttaattcttttatttttaatttttactctctctttttt

SEQ ID NO: 236730 - DNA, 217 bp, Homo sapiens
agcgtcacgtgattgacggtgctgtccaagaactcccttgtgggtgttttggagagggggctgtgacacaagacggtgagtttgttctcacagcactggggcagggctgctgcctggtaggatccctcccccgggagccctgcctggtgccttgggcacttgggtgccatttgccttttttttttcttttgagatggagtctcattcctgtcaccta

SEQ ID NO: 236731 - DNA, 372 bp, Homo sapiens
actgagaactgaagcaatacatggccaagaagtcttgtctctgtcctcccccaattcacatcaaaaaagtcattttaaaaagataagagctgggccggtcgcggtggctcatgcctgtaatctcagcgctttgggaggccgaggcgggaagatcacaaagtcaagagatcaagaccatcctggctaacacgatgaaaccctgtctctactaaaaatataaaaaattagccaggtgtggtggcgggcccttgtagtcccagatactcggaaggctgaggcaggagaatggcgtgaacacaggaggcggaggttgcagtgagccaagattgtgccactgcactccagcctgggcgacagagcaagactccatct

SEQ ID NO: 236732 - DNA, 300 bp, Homo sapiens
tattagcccagcctctgcaaggagagagactgcaggtcagccacataggcagtatgcaatcaagccccaatgcaaactccatacaaggactggatgagcttccctggttgggaatactttacacctgttatcacacatcatggcagtgaggaagtaatgccaaccaggattccacaggaagaaaaggagcagaatctctgcatttcaactcctcctggactctgtcctatgcatctctttctttgcctagctctaatttgaattctttccctgtaataaattatcactgagtgtaataac

SEQ ID NO: 236733 - DNA, 157 bp, Homo sapiens
ttgctctcccaaaatcttttaaggctcgttgcatccctgtcctcttctctccctgggcactccaacccatctgctcaatctgataaacaaatacataacaacaagatatattaagagatcttttcatttttttcctttcatttttaatttcaaaggg

SEQ ID NO: 236734 - DNA, 426 bp, Homo sapiens
cagtatcatgaatctttgctgctttcaaagtggattacttatttatttttagagacagggttttactctgtcactcaggctaaagtgcagtggcgcagtcacagctcactacaatctcaaactcctgggctcaagcaatactcccacctcatcctcccaagtaaccatcacgcccggctatggtctttttgtttgttttatttcattcttttaagggacggaattttgcagccttaccaacatggtgaaaccccatctctactaaaagtacaaaattagctggatgtggtggtgcatgcctgtaatcccagctacttgggaggctgaggcaggagaattgcttgaacctgggaggtggaggttgcagtgagctgagatcacaccattggactccagcctgggcaataagagtaatactccgtctca

SEQ ID NO: 236735 - DNA, 469 bp, Homo sapiens
tgcttcatcttcccgaatagctgggactacaggtgctcaccaccacgcccagctaacttttgtatttttagtagagacggggtttcaccatgttgaccaggatggtctcgatctcttgacctcgtgatccgcctgcctcagcctcccaaagtgctgggattacaggtgtgagccactgcgcccagctgaagattacactttttaagtgtcggagatgttgacggtggtactcttactagaaatacgggcaaggaggtacgtaatgagatcagttttggatttgttgacttttttgtatacttgccaaacgctggaaatgtccaaaggcttttggaaatgtggatttgtggttaaggggagaggtcaggactaggcatatattaaacatgggtttagtgaataatacaaataggtgtactggttgaatctgtgtaagaagatgaaagtgccaagggagaatgtagagggg

SEQ ID NO: 236736 - DNA, 415 bp, Homo sapiens
agcggggaccgcgcgcagcacctcgcgggcgccccagcccccgcaccctgcggagcagagccgagcgcccaggacgccgcgggccccagcggtcctccccaccccctggccgcgccgccgccctgcccggggcggagtaaacaagagacgcgcaagatttgacctggcgcgacccggctttctggccggggttccccctgagcaggtgactccgtgggaggggtggaaatgagtctctggaattccgggccaaagacaataactgtggttctgcttttaaagcaggtatttcaccagcaactgcggaatgttttgtgtctccagtttcaaatttcgcggaaagggaccaaatgtgaggacatataaaatatccccttctcttttcattaaaaatgagtgcattacaaaggaaggg

SEQ ID NO: 236737 - DNA, 488 bp, Homo sapiens
gatcacaacgaagtgttgagtatgtctaaatgtatgtggatatgtttgtgtctaagtgtatttccactagcatgctaaggtatgtttgtgtgtgagtatgtttcctccagtatgctaagttttgacacatgcaggcatctaacttgggtgttatctgtccttcctttgcccaaagcatagattataattgttcattctcaaaaatgcaactcttatctatttcccctttatttgaaggcagctgatggttactctgcaaggtgtaagtttctcttttaaaaactaagcggtcgagcatggtggctcatgcttgcagtcccagcacgtgggagtctgaggcggaagagttgcttgagcccaagagttcaagaccagcctaggcaacaaagtgagaccccatctcactttggaactcaggactgcagtaagccatgatcataccactgcacttaatcctgggtgacagagtgagaccttgtctcttaaaa

SEQ ID NO: 236738 - DNA, 698 bp, Homo sapiens
gggcagaggcagggtaaaggacaaatctggcaagtgtcatgcatgggggagtcatccaggaatctctgagccaaagaggtggtggccctgctttcaggggagacctcatctctgcctggagtgacttctggattgtagcctttcagattaaagattcctcaaccctatcatgggctgctctgaggaccctccttcagacacttccagtatagacacagtatccactgcttggggaagtcagactggtggtcagctggaggggtggcttacatgctgcaggaggaggctgtcccacaggggcaactccgctccccacggaaatgtgcggaccctcactccctgccagcgtcttccccattcagaatgcacctgtacctcagcaaaaagaatccctgcccatgttctaacgaatccccaaacccccattgccccttggatgtccacccttgagtggagtataaggcgtgcgggtgacctacatcagaaacagggtgtgatcatttcagttcatcacatctggggcctctggtcctggcacaagctcaatagctagtgcctgacagcattcaagtagatcacatgacacccaggaggggttgtgaggactctggggaagaaaagccatctccagtggggcagggaagccttgaggtctgagaggtaggtatgaggatgctaggggtatgacccaccttgtg

SEQ ID NO: 236739 - DNA, 332 bp, Homo sapiens
gtatatatcttttgaatttattctgatggaataaggctagctaacatttattgagcacttactatgctccaggtactattctaagcatatatcatttaatcctcatggcaatactatgagtttggtattgttatcaatatcactttagaaatgaggtaactgaacttagaaaagttaaataacttgcccagggtttcataattagtaagtggcagagttgggacagaaattcaggcagtcggactctcaattatgacactatgtgccaacatgaaaccaaagatgaatggcagacataaaggtacttattgcagcattgctcattataggaa

SEQ ID NO: 236740 - DNA, 485 bp, Homo sapiens
actgttatttcttcttcagtgctcttcacaaaagtcacatggatgatggtaaatcttcgagctgatgccagataaactctgaaattttaaagtatttgtttcatatgggcaaagcttttcctttttttcccctttttttcttctctccctttaccctgtgggaaaatgaacttattttcagtcacccctgacatctgaccactcaactgatcacgaggacactgtggcaaaccacaactcaacttgaaattgtctcttttaggctcggttcctgtactttggatggcaccatccttgctacccagcattagctttttttctatggaggttccatttttactttcttccatttactcaaagtaagtggtcttgctgtaaagtctctcagttgggcttgtcctcaaaataaactgaatgcaaaaatgacaccaacttttcagccaaaaccccaaaagtggcccatttacacagtgtgtccttctttt

SEQ ID NO: 236741 - DNA, 534 bp, Homo sapiens
ttttccctaggcctggtgttaacagtttcaacctagaactacccttgtgcactgtaacacactcataattcactttctttcagactaagcacagcacatattcctcaaccactgaggcctaaaagttctttagtgatgatatgttgtctctaatcaaactcttgcctcagctgacccttttaactgatgcctctgaggccaccactatttgcatgctccctgttcttcatgcacataaactaagcacaggtcaagatcacagtgctgggacctgtacccacaggcagtctacaaatttgttgggactccaaaagccctcttcacatttgttggggtgtccttctatataagctatcacagaactctggccagtgtcacaataacctgcagtaacctgccatggtcaaaatagtccaaagattcaaagattcaaagtccctagaccatgccacacattcataaagccaactccacaatgaaaaaccagctgcactgtgtaatgcaggtggcaagtcactaagattaaaaaaaaag

SEQ ID NO: 236742 - DNA, 795 bp, Homo sapiens
ggtgtggtggctcacacctgtaatcccagcactttggtaggccgaggcgggcggatcatgaggtcaggagttcgagaccagcctggctaacatggttaccactagaatcttcaaaccagtacaacacttgtacatactttgttttcaagtacacacatgaaggcccaacaatgataaggtttgggatcaaaaatcactagaatgtctcactttttttttttactactacttaattcaagtgactgtcacttaatatgaataatggtaaacacagctaaagtaatttgagagaaactccagtcaatataattttctaaaggacaaggtcaatctttcctgaacattaaaactttgtacccatatcaagtttttcctcattttctaaaggaaaagatctgaaaccaactcaaattattgactaaattgaattaccttggaaataaacaccatttaaacatatccactcccatctacttttccaaataacaaaatattgtactatttctgttcagaacttataaaagtaagtcttttaattttgtccaagagctttataaactcttatagatcattaaaggaaagcataaccaatgctaatgatcctatagatcattagaggagagcaaaaccaatccaagtttaaaaggctggtgtgctctatcatttttttttttgaggcttgacaaaggtagcttaggaattttagatagatagagcaaatgatgaatgttggaaaaacatgggaaaccaaatggctatccatagaaccaaatgcaagcttttcattaggaactg

SEQ ID NO: 236743 - DNA, 190 bp, Homo sapiens
agtgaccacctgaaaaatcaattctcaaaacttttgagagtgtgtgaaagtggcatgaaagcaaagcaaaccttaacaagtttgtgggtttacattctacatcacctagcaacctcctgactcagccagatctcttgtctacccttagttctgtttacagactattcaaacggcccttcgaaaccatgaa

SEQ ID NO: 236744 - DNA, 187 bp, Homo sapiens
ttgcaacccgaatgaaggcactgatttgggaaaaggccgttggcagttgctgaggcatccggggacctggaggcagagcgtttgcgggcgctggggcatctctgcataggtttaccaccgacggctctgcactcacctcttcagacaagcgattgccctggtgctccatgccaccccatcgacgcct

SEQ ID NO: 236745 - DNA, 459 bp, Homo sapiens
agatgcctccagtggagcagacaaatctctgaagtgagaaagagtgagatttccctgcaccgggcctctgcgtgtgagggtaggagggtgtaggagggggtgggcgggggccatcaagggagaagcctccggcctttccctgtctctcaacactagccctccccggccgcctccccttccccaatcctcaactagccgcgggaggggggccccggaggctggctgggccaggaggctcggcctttgtggctctgtccccgacggtggcgcggaggcagagggggcggggacgcgggccggagaccctcagccggggcttgacccccaggtgcattgtccggcgggacccgtacccttcccccagggctccgacccggccgccactggccccctcccagcgtctccctccgccggccgcgccgacctccctggcccagaccaagggccagatgtagaaag

SEQ ID NO: 236746 - DNA, 337 bp, Homo sapiens
ctctccactaagaattaatctaaaaacaattagtaggcaaaccaaacattcctttaaaataaatggaattttaaaaatatcccaactccttggttcttttcagagtcctgtaagttgccagtgcatcaactctaagtaacttaggagctgatttttctgtctgtcattttttaaaaccgcttgattttcccttcctcctggctgctgccctgttttgatattttcagcatcattctgtttgccattatttattactgctgtgattatttctatcattatcactgtcatttacgcttcagtcagtcacaagaaactagaattgtctagcctagtgcaa

SEQ ID NO: 236747 - DNA, 117 bp, Homo sapiens
gacacagttaactccattactttggctttttatgaaaacaaggaaacaaaactttctgtttgcccattaattcatttatactattcttagagctcacttttatcatttgactaatgc

SEQ ID NO: 236748 - DNA, 412 bp, Homo sapiens
gggtaatattgacatcctaacaatattaaatatttccatccatgagcaccggatatctctgtttatttaggttttctttaatttctttcaacaagattttgtagttttcagtgtgtaaatcttttacttcattagttaaatttatttctaggtattctttattgtaaataaaattgctttcttaacttcctgtgtatttatcttataccctatagctttgtgaaatttatttattagctattatttccttctttttcatttttattttttgagacagaatcactctgtcacccaggctggagtgcagtggtatgatcatagccttgaactcctgggtgtttatgtgatgctcctgcctaagcctccgaagtagctgggactttagccacacaccgccatgcacagctaatta

SEQ ID NO: 236749 - DNA, 460 bp, Homo sapiens
gtaaagctggaaagaaaaagtaaatttgggtctagatctgaagagatgatttaggattagagatgttgaattgagacttaacttgcatagaggtgttagctgaagccatagaagtcactaaaattgctaagagaaacagtttggaaagaaggcagagaactggataacagggagcacgttcttttaggaaggtgaagaggcgagggagaagtaagaaaagggaggcgtacctagccaggagagagcttttttaaagtttgtaaaaaaccgcagtgacagtggtagttaaaactgtaaagtgtttcgcattctactaaaatgggaactagtaagagaagaggataacttgtaagagctatgaatgtggttgctaattcgtatctactgtagtttttatgtatttgtgaagctgattatttctaaatttcaaacctagatttataaattatgagaaccctgg

SEQ ID NO: 236750 - DNA, 495 bp, Homo sapiens
aatattctcattaatattttattagatcatttgaaacttatgattactgggcagaaataggattatgatctttctcttatagaagaagctgaaactcagaagctaagtgacttgctcaaggtcacagaatatggtatgtatcagatttgatgcccaatttagtgctctttctactcagccagtggttctcagctgggtgtgggacggtccctgcaatctggttgggggaaagattgggagacagcctttggaatttttttttttccatgactagggaatgggactggcatttagtgggctggaagcaataatgctgaatgttctgccttgctgaggacagtcccacataatgaattgtcctgctccaaatgttaatagtggtccccttgagaaataccgagctaaattaagccaaagaaaattacacactgactcagaactgagaataaggctgtctcataatgatactcaataaatgttaataaatgatatcac

SEQ ID NO: 236751 - DNA, 523 bp, Homo sapiens
ttagacatggcaaggtgagagccatcttgttgaactcactcgaagaggagacccatctggtcaacctcagacatggcaaggtgagagccatctgatcgaccttagacatggcaaggtgagagccatctggtcgaccttagatatggcaaggtgagaatcatctggtcaatcttaaacatggcaaggtgagatccaacttgaccttagatatgatgaggtgagaaccaactgttcaatcttagacatggctaggcaagtgccatctggtccaccttagatatggcaaggcgagagccatctggtcgaccttagacatggcaaggtgagagctgtctgttcatcttagacatgacaagctggcagctaaatgcgatgcatgcagtcgacatccatctcaaaataaatgaaccaacagtaaatatataacaataacaaggaaataatagtgaacaaccctaaagaccaaataattaagtaggagtgtacaataataaaaggtaattaatgtcgcaatttaaaaaaa

SEQ ID NO: 236752 - DNA, 409 bp, Homo sapiens
ccctcaaaataagtagaggcctttcctacagggtccgagaaggccaccgcagtcatttctttcgttctgtcagacataattcctcagtttagccttcccaccttaatacagtctgataacagatgagcctttattagtcaaatcagccaagcattttttcaggctcttagtattcagtgaaacctttatatcccttatggtcctccagtcttttaaaaacacacctcaccaagctcagccaccaacttaaaaaggactggacaatacttttaccactttcccttctcagaattcaggcctgtcctcgtaatgctacagggtacagcccatttaaggtcctgtatagacactcctttttattacgccccagtctcattccagacaccagaccaacttagactgtgcctca

SEQ ID NO: 236753 - DNA, 431 bp, Homo sapiens
ccctcaaaataagtagaggcctttcctacagggtccgagaaggccaccgcagtcatttctttcgttctgtcagacataattcctcagtttagccttcccaccttaatacagtctgataacagatgagcctttattagtcaaatcagccaagcattttttcaggctcttagtattcagtgaaacctttatatcccttatggtcctccaagaaaagtagaatggactaaaggtcttttaaaaacacacctcaccaagctcagccaccaacttaaaaaggactggacaatacttttaccactttcccttctcagaattcaggcctgtcctcgtaatgctacagggtacagcccatttaaggtcctgtatagacactcctttttattacgccccagtctcattccagacaccagaccaacttagactgtgcctca

SEQ ID NO: 236754 - DNA, 435 bp, Homo sapiens
tacaaggctattgatacatgtgaacattgagatgacagagatgttagaattatctgacaaagattttaaagcagctgtcatgaaaatgctccaagaggcaattataagcatagtggaaacaaacgaaaaaggtaaaagttttgacaaagaaatagaagatacaaagaataatcagataaaattttagaacagaaaaataaaataattgaaattatcaaaaactaagaggatgtacttgacagcagagtggagaaggcagaagaaagaatcagtgaactggaagaaagaataatggaaataacttaatctgaacaacagaaataaactatacttaaaaacagagacttaggcaactgtgaaactataacaaaaaataaaacatttgtatctgtgtcactagaatcccagaaagagaggagaaaaagggcaatgctt

SEQ ID NO: 236755 - DNA, 311 bp, Homo sapiens
ctcctctcccagctctcggttcactgagtcaaagcttatctctgtcctgcctactagacccaccctgggattggtatgggagctccaatccccattggaaccccatctggaagttgccagagacctggtagcaaaatcaatcaaaaccagagaacccctacctggcccagctttctttggatgccaaagaaagctgtgtctctttggagggctgggccagtgccaagccccagtgctgggtgtctgagcgatcagaacacagggggccaattgatgcggtgtgggcagagctccagcatgaggccgcaggg

SEQ ID NO: 236756 - DNA, 499 bp, Homo sapiens
ctttgcagttttagtcaaatattgccatctttctagtggaagactttgacatgtaagttctagattatactttcatttataaataactgtgtagcttaatgagatggcccctgttagtatcttaggccatctattgaaggtttactaaattcttccaaggcacgtgagtctgctcctcagcaaagcagtgacaaacctgcttttccctggtttccccaactatgtaaaaccttattaaagaattcctgaacaatataaagttccctcagcaagacggaacttcccaagctcttgtctcaggagagaatgtggattatagaaagattgtgggtgtgagtggagtgggaagttatttaggtagtaagattttcaggctcggtgcagtggctcacacctgtaatcccagcactttgggtggccgaggcgggcagatcacaaggtcaggagatggagaccatcctggctaacagggagaaactccatctctactaaaaataca

SEQ ID NO: 236757 - DNA, 611 bp, Homo sapiens
acaagaatttaaatccctgtgtgcttaggaaactcacagatgtagttactgatacagtataatgacagaacagatttattctcactttctaaaaatggacatttaattcatctttgtaatagagtaaaatttcaagtactaattgtgaatttttgggtttttttgttgacctcatgtaatgtaattgggtttttttgaaggccagaatatcatcaatttttaagaatttaaagttcttatagcaagtagacacctggagaaacttgaagattttaatgatgatttacaggtcaggtcattagttatatgctgggctgtggtttagtttttgcctattctgtagaaatagatgagctttgccaaggaatatacacaacttaggagcagttaggattttattattagttccttttcataaataataaagtatactatgtactactataaataatgcctaagagtatgatacataaatctgttatgttaaattttttttaataaactttttttttgctttctgggagcatacactcaagttgccctgaatatacattccctatttttaatttttaaaataaaattgtatttattcacaatttaaaacttctttt

SEQ ID NO: 236758 - DNA, 393 bp, Homo sapiens
aattttttttttttatttaagaggctgcaactgcggaacatgtagtgtcattgtggatatctctgttgccctggaaagtatcttcatattataacataatttaatagtgggtaaaagttatagagactatgagttgtaaagaatgtgctagattatgttcagcatatatttcaagttggggaaatagttgaacaaacagcagacagttataaaatacagactataatgtattttgcttgtttgtttttttgagatggagtctcactctgtcgcccaggctagcacgcagtggtgcagtcatgtcttgcagcattctccgcctcctaggttcaagtgattctcctgcctcagcctccagagtagctgggattataggcacttgccaccatgccc

SEQ ID NO: 236759 - DNA, 412 bp, Homo sapiens
tgaggtgtggccaatcagagtccagaattccccagagccacggtgattggctggatttggacgtgtgaaggcccacctcaaccaatcagagccctcctctgggtagggctgtcagcagataggtgacctgaggagggaggcgggtccttcccgactctttgagaaccccaatgcaggcacgtggcgcacacgcgagccacccaactggggtgagcaagtgcattctcttgtgggcttaagccacagtcagttggtcccaagcctgtccggtgctcctggtgcccatgcgctgtgtttacagcctgtctgcgccctccagcagccccaacatgggcctcccttggacctcagtttctgtaaaaacagatgtaccttattagctaataaagaacatcatggttttataactcta

SEQ ID NO: 236760 - DNA, 484 bp, Homo sapiens
cttccatgctgagaaaaagttgtctttaagagaatgtgctgaacaatcagggcccagaaaggcaacaacgaatattttgcatgccaagaaggaggcaaaagaggaagtggaattgtacccaaataatgcttataataggtgttatttagctgagctgtaagctccaggagggcagggtattaatatattgaggtgttggctgagcactgtggctcactcctataatctcaacactttgggaggccaaggtgggaggatgacttgagaccaggagttcgagaccagcctgggcaacatagcaagacctcgtctctacacataatttaaaaaaataggcatggtagcgtgcgcctgtgattcccaactactcaagaggctgaagaaggatcaccggagactgggaggtcaaggctgcagtgagctgtgtttgcaccactgcactccagcctgggggacagagcatgaccctgtctcaaaaaaaaaa

SEQ ID NO: 236761 - DNA, 638 bp, Homo sapiens
ttgaggcagagtctcactctgtcacctaggctggggtgcagtggcacgatctgggctcaaagcaacctctgcctcccaggttcaagcgattctcctgcctcagcctcctgagtagctgagaccacaggcgtgcgccaccacacccagctaatttttttgtatttttactagagatggggtttcaccatgttggcagggctggccttgaactcctggccttaagtgatcagtctgctttggcctcccaaagtgctgggattacaccacgcccagccacaatactggaaacttgctgaatgaatgaatgaatgttctctctctgaaaattaggacataattccaatttaagtcccgataaaaggagccacgaagaggcaaaagaattaggcaggaaaggttggggtagtggttacactagatgctttacaggtatttatagggcaggacttaaactcttggtttgataaaatatatgaaggagcatataactgacagctcagctccgttttgcaaagtgtcagccagcacttctctctacacaaaacagattagtaacatctcttcctgccagagggcttacatgttgcaattctcttgtaaaaagtttctgaatatttaatagttgaagttgaatgact

SEQ ID NO: 236762 - DNA, 3200 bp, Homo sapiens
  misc_feature (2)..(3): n is a, c, g, or t
  misc_feature (5)..(5): n is a, c, g, or t
  misc_feature (9)..(9): n is a, c, g, or t
  misc_feature (2073)..(2073): n is a, c, g, or t
tnncntatntaactgtgctcatattaatcttagttatgaaacagatcatttagaaggtaacattggaaacaaaaggctaaactcagatacataatttgccaggcctcataaactgtgctttgatgttctaacaacttcccaatagaagccatctgttaaacaagcaattcattcagagtggaggtattaacattaaactgtctttcatatagttagtcattagttattatactatctgtctctcatatagtatagttagtaattactgaaaataagataatcctattaatggccacaacatgattctgatggttagtatattctctagccacaaaaacccagacctaggcctccccaattctgccattcacactgcagcatgtgccatctgtcctaagaggagacgacaggctctcctcttcctccatagatttcatttgaactgtgagaaccaagtttgccaaatgacatttgtgctagaggaagcactcacatgaggccaaccacccaaagcaatacaatatttaaccacatatttcagtgctggcattcgtacccacacaaatattaaccaatcaaaacttatagtctccttgccaaattctcagaagaatggctgaagaagtatcacatggtctgaatctatacaactttacccagattcctgtgtaattcaggggaattctctagttttgtttagtacgagtgagaaactcaaagaataagaaaattgttggggacaggcacagtggctcatgcctgtaatcccagcacattaggaggccagctggaggactgcttgagtccaggagttcgagacaagcctggccaacatagtgagaccccacctttacaaaagacaaaaataattagtaaggcctggtggcatgcatttgtagtcccaggtacttgagaggctgaggcaggaggatcacttgagcccaggagtttgagcctacagtgagctgtgatcacaccactgcactccagcctgggtgacagagcaagacctcatctttaaaaagtaaaaaaaagtcttgagggctatagtaagcacaagaaattatttccttaaactccttttttttcttcctacgctattaaaaaggaaaagatttggggaaaagagaaagggtgtgatataagcaaatgctctatatcggcaaatctctctgtaactttcaccactactatctctgtcaggcgagcataaagtgaaaatatttagctcaacatttgtgtaggaggatttgcgagggttccaaattttctccccacaattttgcaaaatccagttgccaataatcaggtaatttttacttgagtgctttagagcaaccccaaagactgaattttatttatctctgagtctctttagggggtgaaaaaacatcaacataaacaactgaaggaatatcacctggtaaaatcattgaccccacaccgggactgactccatgttccctccccaagccatattggctttctataacaacttctgtcttttgtatgaagtaagatggattttgatccgttgatccccttatctttctttggtgtaacaactggaaaactggcaattcatgtgaagtactttgccaagaggatagtaaagatccttttaatgttttaagcatcctttgttgagttattgtgtgctggaatgggcctaaggtccattgtgtggttcatgttggagcctggatgggtacatctggtaaagacagcaaagaagttaaagggggaaatgttcctcaagacagattcttttctgtttttcagttcctgggcagttctttgtatttttccacacagggtgaaaaacacagtcataaaaccccgaacagtagaacagtcagaatgaaattagtttgttttcactgaagcatttgtgcttgtttccttcagaagctgatcttgatgacatgattgattgtccctgtggatccttcccctttatgctttccatatcccccaactgctcagagattgaccgcgtgccaatgcaggcagaagggacacgggttaaaagctgccaaggcgtactcgctgccctcagcccaacacagggangcagtcctaggagcttgacttgacttcagggttcacagttgatatgtgcatctggtccggggagaaagagggaaactttccttcaacctgacccaaggctctaagctcacttgctgcctcactcttttcctctcataacacaaagttgtgccatgctgagtggagcctcctggctctgaaaccaatgtggtttgccatctagatcaatgcagacttcattgtgcactgaatgccagcaagagaggggcatctggtgtcatctcaaccatggaaagggtacattagccctgctaattgtcctcaccactatgccttaaaaatccccactcacccttcccaggtggctgcaaaggatcactcatattcactttgtgtctgatcctggtatttaatgccatttgtattcatcagactaatggaaatatcaattaagcccagtcaagactagctcttagagcaataatggacacttgtacctgagctcagagcagagggaagaaaggcatctggaggtaaatggtgaatgacggtcaagtgactatgaaacctgcaagtgaaccaataaagttaaagtattggtacaaatttgtacacatttatatagccttaccaggtatagtcatcagtgtacaggcaaatgatttttttttttttgcttgagtgcattagagaaagtccaaaaatgcagtcttataaatcttggaaaactgcaatttaaaataagctgtggaagatcacctagcctaataattgaaccaacactgggatctagccccaaattctatcactgtgagcacacaggctcactccaacataggcggaacctcggggaatgatttctaaatatcccattaccataaaatctctggtatttgaatctcactaattcaatctggtatttgatggatgcagcagggggtggccgagacattcataaagtttgaaggtactttttcttcattgtttcctagttttccttgaggaatcagatgatattttgcatagttcagagtgccctccaaaagaaaatcaacagtttaaggagttttctgcattactgagatgaagtaagcttacaagctttaacttgctgcatatgtctctcattaaagaatcttccaaccttc

SEQ ID NO: 236763 - DNA, 440 bp, Homo sapiens
aaaaatggcaaaaactctgaaggtgctgttatgagtgattgaagttcagggaacactgtggcaatgccaaaatgtggcgaatcactctagagagctgtgtattctatagagtcaaagggaatggaagggttgagtgatgcataaaaagaggatgtagaatctaagatgctagtgggggtaaagacgtgcacttttgggcaattcacttatctttgtctttagacagtaaaatccccactaactagggttctggtcagtcggcttttctaattgaaggttcacttgtattgatgaaaatcatttctaatggcacaggagtcccatttccactatagtaagtcagagttgagggagaaattgactatcattaatgaatgaaggttttcaggttgttttaagccattgtggatcttgtaatgttgattagcagtaaaaaaaaa

SEQ ID NO: 236764 - DNA, 1132 bp, Homo sapiens
ttttccagtaagatacattcaaagcaacaaaataacttttactaacacttaacttttcaacgctaaaacttacagaaattgtttacctgacttgttagcagtacagtagtccccccttacccgcaatttcactttccatggtttcatttacccgtggttaactgtggtctgaaaataagtgtgtgcagtacaatattgtgatagagaaaggcctcaatcacataacttttttttttttttttttttttaagagacagggtctcactctgtcacccacagtggagtgagtgatgcaatcatggctcactgcagccttgaactcctgggctcaagtgatcttcccatctgtctcctgaatagttagaactacaggtgtgtcccaccacgcctagctaatgtaaaaaatatacatttgtagagatggggtctcactgtgttgcccagactggctcaaactcctggcctcaagtgagtcttctgccttggcccctcaaagtgttggtattataggcgtgagccagtgcacctggcctcacatgacttttattgcattatactgttataactgttctcttttattattagttgttaatctcttaccgtgcctattttataaattaaattttatcatatgtatatatgcataggaaaaaacatagcatatataaggttcagtagtatacacagtttcaggcatccactgggggttttggaatgtacccaacacaggtaaggggggattactgtaaatacatttttaaacgtaaaagtaagatatttctgacagtacaacatagttcttaaagatttaagattatatagttgacacacagcagaaataaaaagaatgaaattctactggagaaataacttgtttccatctatgttatacctgagcaccaccatggcaggtaaaactgcagcgactacaccaataaaaacaaatatatgaatccaaagcagttaagaatatgaactggatgaaagaatgaagtacagtatataaaagaatgatcatgttttctctcccatgagattaaataaattaacagaattaagagaaagaaaacaaaatgaagtctgcaagtataccaaaatgaggccaaacagataaagacttatacagacatac

SEQ ID NO: 236765 - DNA, 416 bp, Homo sapiens
aggtttccagtttgcttggggaaagagcctttctccgtatttccttattgccagcctcattcctaaaaggatttgaaatgtctgacaaaagcacaaatgtgcagcaaaggaggacacccaggcaggggaaataaaggcaggaaatgtgaggcaaagccacgtgaggctctcatacaaaaggctgattgatattcacttgctaatttgattctgcgttttcttgaaagaaggaaacataatcaacaattcccttcacagtgtccatgagataaaagcaaacgagttgtttgggagaaagttctgaagtgccagatgcatctctggtgggatgcttattcttttaaggatgtgagcaacaccctcaatcatgatgagttttatgagccatacaattattaaaaatttttaactttctt

SEQ ID NO: 236766 - DNA, 302 bp, Homo sapiens
ctcttttattattcttatttcctctttttgcaattgtgttctttgcccatctgtatactgatttttaggtgttctttataatttagggagctaagtattgcatacattttgtcataaatgttgaaacattcccccccaatttttttttgcttttaaattttattttctaatgtacagcagttttatatagacaaaccaattgatctttgtctgattttgatttcatttatcatttttaagttttaaaatcctttctcacccagagatttaataaatattatattatttttcttctagttttt

SEQ ID NO: 236767 - DNA, 542 bp, Homo sapiens
agaggtgcacatttttactgataagaaaatacaaatttaaacatcagtgagacatttcagactctaaaaattaaacttgaggttttggaggacaggaaataggaaatctttgtacctgtggaacagaattgatggaagcacttgggagagcaatttagcaccatgtattaaagttacagttgccttttcattttcagacagctgtcctataggactcttgtacatgagcttaagtatatgtagtgtgtgtatggaggtgtaaagcataactgttaatatttaaaagtggaaaataatctcattgtcaatcagtagaggaatgaataaactggtttctttgaataatccaatagtatgtaatagctacaatgaacatattaataatttttaaaaactattgagtgagaaaatccagttttcaaagaatgcacagtatatcacgtatgcaaattgaaaagcagaacaatactgtattgtttatgatgaatatatacctttggagtaaaaaatcttaaaatatgtttggcaaggaaaccatgctg

SEQ ID NO: 236768 - DNA, 387 bp, Homo sapiens
aaaaagaagaaagtaatacattagagcccaatactttttaatcaagatatgaggacttaattatttttttccagtaaagtcgagcatttttataaatggtttatgctccttgagtggtactatttggaagaaggaggaggagtatttataaatggattttcttcatcataaaatataccctttggttaatttgttaacataaaatttgtaattaaaataaagttagtgaactggaacactcaaagtacgtaaacccagaagcacaatcgaatagcctcagaactgtatttcttaggtaagaaattttaatttttgattcttagatctactgggaaagagtcagaaggaaaggtaatttgaagttatcctagaaagactctgaattct

SEQ ID NO: 236769 - DNA, 146 bp, Homo sapiens
caggaacttcccatcttgttgtaacttatgctctgtaggttttacagctgagctggaactcagtaaaaacctcaatgataactcccaggagaactaagtgatattaagacacactcttgcctcactgcctttcaatgagttgactg

SEQ ID NO: 236770 - DNA, 557 bp, Homo sapiens
cacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctagcatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcagagc

SEQ ID NO: 236771 - DNA, 384 bp, Homo sapiens
tgcttactgggcgtatggaggaaactgtggggtgtatggaggaaaccggggcgtatggaggaaactggggcatacggaggaaactgtggggcgtacggaggaaattgaggcatatggaggaaactggggcatacggaggaaacgcgggtgtacggagcaaactgtgaggcatccctcagagcctagcatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcagagc

SEQ ID NO: 236772 - DNA, 372 bp, Homo sapiens
attttgttaatattggcgttgttgatattctgagcctctcactgagagctgagtaaacagaatttaatcacaatatatgtctgtcagtgcatagttggcaaaggtccctatttggttcaagttttctgtcaagtctgctttctggttgcaataatatatttgtaatgggtagtctataaatagagtaaagtagtaggaacatttggaaggtcaactaacttttgactgttcaagttaaattatcaaagaagttgagagtctaattaccagaatgatttaaagcagcttctgtgtttgcctctctctcaggaaacaaggtaagcaatgagaaaatctggtttatctaagacttactgaggcatatggccactt

SEQ ID NO: 236773 - DNA, 531 bp, Homo sapiens
tgagaccagtattctcccaaggatgtgagttctgagttcacattatttaggttaaatctttacttcacatagtttctcatttatattttcacatttcccaagtgacttcatgtgctgtgctctttataactttctatcaccattttcatttcactttcaaatgccctaaatagcaagaatgatgatgtgccagtcactgtgcaaagcattttataagtgtgattccattggattctcatcacgattctgtgaaataggtatcattatggtccccattttacagaagggcatatagaaggttcacatgggtaattttcctaaggtcacacagctagtgcatggcaaagtctctttctttttgcttggtacatcagagactaccctgtttccatttaaggcataccaacaaaatagcaaaccctttttgtcccagtcagtgctttctgagaaactcatcctatggcattatgccttcagacaaggagcaagtgttttcggtatctttagagatgcatttttgtgcagcagaaa

SEQ ID NO: 236774 - DNA, 475 bp, Homo sapiens
aggcaaacactggagtgtatactactcctattcctaacagactgaggattgttcctgggggtagtaatttcccagcatttccagccttctctgtctttgcatatgttcatgggcagtgtatattccttagaaaaccctaaggaagggaaaggcttaggtggaagccatagacgtgtacaggagccatccagcaaagcccccgttgagctccagtgtaagcttagggtagagaaggatactagaaacatgtgacagcttctccactagatatcaaattgaatatttaattaaataaatcacaacaaatcccaaatattaaaagatgacaaatgtggtcatttcatactcaccaacatgaaggtcggtatgacagaggagaagtcaggagaggtgtgataacaggcctaaatgactgctgccaagaatcttattgttgcaatagtaaaataataaagataatgacaataatacctta

SEQ ID NO: 236775 - DNA, 507 bp, Homo sapiens
acagtgatgggaggcagtgacagatcatcaggcattagattctcataaggaacatgcaacccagatccctcaatgtgcagctcagaataaggcttgaggtcctatgagaatctaatgccgggtgaagcttgggtggtaatgtgggcactagggattggctgtaaatacagatgaagctttgctggcttgcctgccacccacttctgtgctgtgtggccagttacacattacacatttacaataaatgtgtaaatcccaatacatttacacatttattgtgtaaatcctaaggttatagaaaacctaaaccttaggatttacacaataaatgtgtaaagacattctatttagattacatagaaaatctaaaatgtattgtgtgacatcttttttaaatcccaatactgctgcaactacaattctcagatagtcccatttgtttaaatcacgcattttctttcttttttttgaggcagagtctcactctgtcgcccaggctggagtgca

SEQ ID NO: 236776 - DNA, 493 bp, Homo sapiens
ccatgttggccaggctggtcttgaactcctgacctcaagtgatctgcctgccttggcctcccaaagtgctgggattacaggcgtgagacactgcaccaggccagcgatttttactgtggtgttcctatggtgattttctggttcattcatctcttctacatttattaattggaatttttttgtagggaagatttgccaaatatttacttattcaatcatttatttatatcagtgttcactcgtggatatttatttgagcctttgggtgataatccaatatcttcattgttacggatttggtagctcaaatggtttcagctttggacattggctgctcttttgtttggcttctatgtgtttttgacatgcccccgcccatccgtccatctgtccatccatccatctatttacttacttatttttgagcacttccttactttacggcaccacaaaacactgcagccttgtcttatttttttccctgccccagcta

SEQ ID NO: 236777 - DNA, 456 bp, Homo sapiens
acggtaaggacttcaactgaccttcctcagactgagaactgtttccagtatatacatcaagtcactaaggtaggacaaaagattgctacagtcctattattttatggttattataagtgtaccaggactctaaaagaaacttgtttgtataatgctattctatccaaggtatgtagcccaggaaataaccaacctgatgcgcgttatgacccattttaagcctcccatgatcacagtttttaaaataaaattaaggactggtccttttctaggtgacacaagtaaggtaatagctagaacagaagaaagaggggtccccaaaaatgtaaccttaaaatttgatgcttgtgccgctattaatagtaaacagcatgggatagaatgcggttctctagattgagaaaaaagttacacagcagaaaataagtacatctgtcaaaaatcatatttatgtga

SEQ ID NO: 236778 - DNA, 393 bp, Homo sapiens
ttatagttaaactttgaagcaaggaaaactgaatcccctcttgctggagactaatgctgcattcataacacaagattagaattatggttggggcttgaacttctatacattgctttctgctccaaagtcacatgagaggtcataagatttgtaactccccagctactcctatagataacataactattgtgaaacctaaagaactggtctttaagatatttttcagatttagcatttcaacaaagagataccacttggttctgagaacaccctttcccccttccctgggaagacttagctgtgtgaagacaatttagacacctctgtgatttcatcttcagccaatcaattgtttcagtttccccactacctgcctaccaatttacccttaaa

SEQ ID NO: 236779 - DNA, 573 bp, Homo sapiens
gcggccgcccggaggacactgatgcttctggagctcgcgaagggtcccccgcgggagaggaacaaggccgcttgcgctccgcagaggcgcaggcacggggctggggcccggggcgggggcgcgggtgggcggacccctcccgcaagcccatgatggccaggccaaggccgctgggaaaggcaggacgctcgcccatgcgctgccagctgggcttttctccttcgcccgccctgtgttccagggcgcgaccccgttcggtccagccgctggctccggggctgaaccccaggtagaactggaagattttgctgaaagattggacatggcattcagagaaacagaggttttaatgacaaactccaagtttttggctggagcaactggaagaatgaggttgccatgaaccgaaaagagagattgcagaagtaaccaaatttactcacgtaggccaggaatttctatgacgtgttccaaattcagcctctcactgaacacttccagagcaaggcaacataaacatctgcaagaagaacattgtgtgagaaatatcaagtgagagtggaagagtctgcg

SEQ ID NO: 236780 - DNA, 298 bp, Homo sapiens
ctcaagatggcgaaacctcggccgccgcggctatattcgccgcggcgtcactgccttcctggcctggtggtgagaggaagtcgggccgcgaaagcttcctgaggagaaaatggagggcccttctctcacaccgacgagaaaagttcgagggggaaatacgagttcctttctgaagggacaggacggctgcttttccacagccgcgacgtgattgagaaatggtggctggcaagggtaggcctgccttcgcccctccaaagtaaaaatcgggagttgagaccaaaggaacatctcttta

SEQ ID NO: 236781 - DNA, 150 bp, Homo sapiens
tatacggctgttagaagacgacagaagggacaggacggctgcttttccacagccgcgacgtgattgagaaatggtggctggcaagggtaggcctgccttcgcccctccaaagtaaaaatcgggagttgagaccaaaggaacatctcttta

SEQ ID NO: 236782 - DNA, 376 bp, Homo sapiens
atagtggaaaaaatggtaagcagtaggaataaatatgtaatgctagaaagaaccgagaaatttttaaggagtggggctgctggtagcaatattccttgtctgtatttggacaaaaatgtttgtgtttttgcaaggctgggtttgctttatttaaatataaacaaaaacaaaacaaaacaattaaaaaaataataaataaatataaacagcaactatctacataaactttcacatacctgttggaaagaggacaatttctctagaattatacatcagtcaaaaaaattattgtgtaatataatttacctgtctgtttaagccatcccattgcaaagcagggacacagtccttgtgaataaaaagcagactaaaacaa

SEQ ID NO: 236783 - DNA, 463 bp, Homo sapiens
gcatcggccctgctctctctatggaccggctctggtcctgtcctgcactggccataccatgccttgccctgactcagccctgactcagctctgactcagccctggctcagctctggccttggtgttgcccatggtcctgccatgtttcttgccctgtccctatcctggccctggccctgacccttaccctggtctggccctgctcttgccctaatgcagcccctggacctatcctggccctggccctggcccttcctggcttgagaccttaccctggttctgccctggccctgaccctgtcctgaccctgaaatactggccctaccctgtccttgcactgctctggtccttgccctgattctgaccctgtcactatcctagccctagcgctgttgctggtcttaccatggcccagactctgccttggccctgccctgacctgtcctggaccccggctgtgcca

SEQ ID NO: 236784 - DNA, 406 bp, Homo sapiens
  misc_feature (4)..(4): n is a, c, g, or t
  misc_feature (9)..(9): n is a, c, g, or t
tcantgacncccttcctggcttgagaccttaccctggttctgccctggccctgaccctgtcctgaccctgaaatactggccctaccctgtccttgcactgctctggtccttgccctgattctgaccctgtcactatcctagccctagcgctgttgctggtcttaccatggcccagactctgcctggccctggcccttcctggcttgagaccttaccctggttctgccctggccctgaccctgtcctgaccctgaaatactggccctaccctgtccttgcactgctctggtccttgccctgattctgaccctgtcactatcctagccctagcgctgttgctggtcttaccatggcccagactctgccttggccctgccctgacctgtcctggaccccggctgtgcca

SEQ ID NO: 236785 - DNA, 2181 bp, Homo sapiens
  misc_feature (1908)..(1908): n is a, c, g, or t
taaaattatgaaactcatagaagaaaacagggacaaatcttcatgacaaatatgtacaaatgaccaataagcacatgaagagtctcagcatccttagtcattgggaaaatgcaaatcaaaaacacagtgagctgtgacttcatgcttactacgatggctgtaattaaaaaacaggaaagggccgggcgcggtggcttaagcctgtaatcccagcactctgggaggccgaggcgggcggatcacgaggtcaggagatggagaccctcctggctaacacggtgaaaccccgtctctactaaaaatacaagaaaaattggctgggcgttgtggcgggtgcctgtggtcccagctacttgggaggctcaggcaggagaatggcgtgaacccgggaggtggagcttgcagtgagctgagattgtgccactgcactccagcctgggtgacagagtgagactccatctcaaaaaaaaaaacaaacaggaaaggtgactggtgctggcaaggatgtgcagaaattggagccctgcattgctggtgggaatgcaaaatgatgcagcttctgtgaaaaatactttggtgcttcttccaaaaaatttaaatagaattaccatatgacccagcactcctaggtatttcccgaaagattgaaaactgggggccgggcgcggtggctcatgcctgttatcccagcactttgggagaccgaggtgggcagatcacttgaggtcaggagttcgagaccagcctggccaacatggtgaaaccctgtctctactaaaaatacgaaaattagctggatgtggtggcaggtgcctgtaatcccagctactcaggaggctgaggcaggataatcgcttgaacctgggaggcggaggttgcagtgagccaagatcacaccactgcactccagcctgggtgacagaggaagactctctcaaaaaaaaaaaaaaaacaaaactgggactcagatatttgtatgtcaacatttattgcagtattattcatagtagccaaaaggtggaaacaacttgggtccatcagcaaatgaatggagaaactaaatgtggtatatccataccagggaatactaatgagccattaaaaagaaatgaagggaagttacagtgagctgtgatcataccattacactacagtctgggcaacagagaaagaccctgtctcttttaatcccactacttgggaggctgaggcaagataatcgcttgaacctgggaggaggaggttgcagtgagccaagatcgcaccactgtactccagcctgggtgacagagcaagactccatttaaaaagaaagaaagtccgggcgcagtggctcacgcttgtaatcccagcactttgggaggctgaagtgagtgaatcacctgaggtcaggagttccagaccagcctgggcaatgtggtgaaacctcatttctactaaaaatagaaaaattagccgagcatggtggctcacacctgtaatcccagctactctggaggctgaggcaggagaatcactggaacctgggagacagaggttgcagtaagcagagattgccccactgcactccagcctaggtgacagagcgagactccatctccaaaaaaaaaggagtgaagttccaatgtagtttaccttgaaagcattatgctaagttaaacaagccagacataaaaggacaaatactgtgattccatttacacgaaatatctagcataggccagttcatggaaccagaaagaagaggttagcaagggctggggagatgggcagttaatttcttaataggaacagagtttctatttggatgatgaaaaagtttggaaatagatggtagtgttggttgtacagcattatgaatgtaactgataccactggattgtacacttaaaaatggttaaaatgggncgggcgcagtacgcctgtaatcccagcactttgggaggccgaggtggacggatcacaaggtcaggagattgagaccatcctggctaatgtggtgaaaacccatctctactaaaaatacaaaaaattggccgggtgaggtggcaggcgcctgtagtcccagctgctcgggaggctgaggcaggagaatgatgtgaacctgggaggcagagcttgcagtgagccgagattgcgccactgcactccagcctgagcgacagagcgagactccatctc

SEQ ID NO: 236786 - DNA, 311 bp, Homo sapiens
gctatagagttgtttgagctccttatatattctggttattaatcccttgtcagctagatagcttgcaaatattttctcccattctgtgggcagagcttgtactcttaaccacatattatttcaagtgtagtccatagacaagctgccagtgaacagcctaattgtcactggtccatgacagacaagaaatgtgcaaccagtcactaaacaaaccgcttgattcagccaagtttttcttaatatcaagactctcctaatgaaggaaaccaagtattaatgtacattttggcataagttcctgacatcttctc

SEQ ID NO: 236787 - DNA, 423 bp, Homo sapiens
accttgagctaatagagcttttaccactaaaagagcattattctcatgtcataatgagaataatcatttacatacttggcataataaatgcctaaaagacattttattttctgaatctatcgttttcttgctataatggggatattgtaaattatgcatttgtattaatggtatttcttaaagcaatctatgtaactgtaaactaaaccaatctacaaactattgtaggcatctgtaaattctgtcgtaggtattataaaccttgttgaagtcttaatcagcagattatgttgtgaatgtatttgtacattgttaaaatagtttttaagattatttgtttaattgaataagtgtcttattagagtgatagctttgaaggtgcaaaactttatatttgtataaaattctactgtttacaaggca

SEQ ID NO: 236788 - DNA, 675 bp, Homo sapiens
gctacatgatcatctatattcataaaagataatagtctgtagtgttttggggatatatttgtctggtttgggtatcaggttaattaatactggcctcatacagttgtcatttttcttccttttctggtttcttggaagagtttgtgaagaactagtatatactagtattaattcttcaagtgcttcttagaatttgcttatgaagccatctaggcctggcttttgttaactagatttttttttttttttttttgagacagggtctcactctgtcgcctaggctggagtgcaacggtgtgatctcggctcactgcaacctccacctctcaggctcaggcgatcctcacacctcagcctcccaaatagcagggactaaaggcatgtgtgacatcatgcccggctagttttggtagttttttgtagagacggggttttgtcatgttacccaggctggtatcaaatttctggactcaagcgatctgcctgccttggccctcccaaagtgctgggattataggcatgagccactgtgcccagcctgttaactagtttttttttattattattaataattcagtctccacttgttatagggtatattcagatagtctggggtttttttttaagtcatttttagtaatttgtgtctgtctacagagttcccttttttgatta

SEQ ID NO: 236789 - DNA, 410 bp, Homo sapiens
ctgtaatcccagctactcaggaggctgaggcaggagaattgcttgaacctgggaggcagaggttgcagtgagccaagatcgccccactgcactccagcctgggcaacagggcaagactcctcaaaaaaaaaaaaaaaaagatatggctagaggggtgaagaaaaataccaaggcagaggcctagtccaaagtaaaatgtttaagggatcttaacaatattgtaatgatcagttgcttaactgtgtgacagaaatactaatagtaatttgagtaacatgacaaaacatacaacgcatttacctaaatacagctctcaatctttataacttgtgacatgtataaggcagatattttgccttgttttactgatgaaagaaagagaataaacatgtcattcttatttcactgaa

SEQ ID NO: 236790 - DNA, 579 bp, Homo sapiens
ggcgttaagctctctcactctatccctttttaaagacaagaaaaaaactttcgttggcgaaggtggtacttttttcttttggaatgtctgagctcagagcttcccataagaggtattgcgattcaatactgtacagtcaaggtgaagttccactaagattatgggaccgtggcatattctacggaagataccagggttccttggcgctctgttcattgccagggtggtctgctgaaagccggcagtttcccaccctcagactccttggagctctttaaatgacggtctgcctggtgtttctcagcggtacacctgtgagtgctctgttatcatggaaatggtaacccatgcaggtagggctcatgccaaccagactgtggtggggtgtgtgtgtgtttgtgtgtgtttatacatgcgcgtgcgtgtgaacgtgtgtgtttggagtttccttttgacaggtaatctttggatgtcaaagggatacagttatttgtctggcagtgtcagggcaatctgagtttctcgagtaactaggaggaggtaatctccagggaagcctttttgtgctcttgactgtct

SEQ ID NO: 236791 - DNA, 1683 bp, Homo sapiens
gacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcctaggaagcacaatcaagactaatacacaatcatgaattagttaccgttttaagtgagattttgcatgcttttacatgtaaattcagggttttgtgtgtgtgtgtgtgtgtgtgtgtgtgcgcgcgcgcacactctccatttgctcattcacacttactgagagttgactacttattttttgctattttgcttttactcatattttcgccaactttaaatgctttcttttcttttgaaatcctaacatctttttactccttcagagaacgttaatcagaccttcatttaattccctttctggtgtgcattttattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaataagtctttcttatctgt

SEQ ID NO: 236792 - DNA, 896 bp, Homo sapiens
gacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaagagtcttgctctgtctcccaggctggagtgcagtggtgcgatctcggctcactgcaagctccgcctcccggattcgtgccattctcctgcctcagcctccccagtagctgggactacaggtgcccgtcaccacgcccatctaattttttttgtattttcagtagagacggg

SEQ ID NO: 236793 - DNA, 1610 bp, Homo sapiens
gacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaagatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcctaggaagcacaatcaagactaatacacaatcatgaattagttaccgttttaagtgagattttgcatgcttttacatgtaaattcagggttttgtgtgtgtgtgtgtgtgtgtgtgtgtgcgcgcgcgcacactctccatttgctcattcacacttactgagagttgactacttattttttgctattttgcttttactcatattttcgccaactttaaatgctttcttttcttttgaaatcctaacatctttttactccttcagagaacgttaatcagaccttcatttaattccctttctggtgtgcattttattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaataagtctttcttatctgt

SEQ ID NO: 236794 - DNA, 646 bp, Homo sapiens
ttgagacaaagtctctctctgtcccccaggctggagtgcagtggcactatctcggctcactgcaagctctgcctcctgggttcatgccattctcctgcctcagcctcctgatcacttttatatatactaggaaaccaaaaagttcatgtgactcactttattgtggtggtctggaactgaacccatggtatctctgaggtatggtaggctcccggaaccctgctgaagtacaggactgttcttcctcccatctctgctcctatatccacagctggactcctaactaatcagaagcttctctgttcctgagatgggcaccatttaccaacactgaattccttaggggtgggagaaaagaaaacctttaaatctatgtgagtcctttaaaataacgtgggaaaacgtccttcctggagaagcaaatatttatgcacataattaactaaggaggtagagtgttctttccaaatcttaagcaaaacttggtggaaaaaaaacagacctgcttatgaaatggcctctcacagacactggaaggggccacacgtctgaatcagctcatgaatcctctccctattaaaaatataccactcatctgggctaacccaagacttttctggtacctcactccctactcctcatttac

SEQ ID NO: 236795 - DNA, 448 bp, Homo sapiens
ggtctgatgagcttagcatagtgcctggcacaagtaggtgctcaatattttatactcatttttcttggccctataatattccagtatacgagactttgcagttagttcatcccatcccatatcattcattcgttcttgatactcccagtggttctagggggtctaaagatgcagcaatggtaagagtctccccgtcaactctccctgctaatccaagcagcccaaatgaggttaattttctctgttgggggttgagaatgcagactcctgtgtcagaacaggctcaggttcaaatcccgtggccttaggcaaaatgactttcccacattgagcctccttttcctcttctgtgaaatgggagcattcaagccagcctggaagggagatggaaaagctgcgtgcgcagcgccaggcccctggcaggctctcagcaggtgtttcccctggc

SEQ ID NO: 236796 - DNA, 597 bp, Homo sapiens
aagtatcaatggctctccctcactttaacaaataatttggccaaatttctctcactaatcttaaattcttccaggtctcattttaacaagcaccagttgaaataatgggtattatgaatatatttaataataaaaaatctgtcaaaataattctgaaaagttttcacattctttagagtcgattactatacataatacaagtacctgcccaaaagtatgtttgttctcctaaaccaggttattttcctcaatttattaaactggattcttatagaaagattacaagggtttgaataggcaagaactgcaaagttgtgcatacttacagaaatttagggaaacacacaaagaatgaatgaatgcaaagacacacaaaaccaggtactttactgcaggtcttggtgtttttttcagttaaacaaatcttaaatccccaaagccaggtgaaccattaaacctcaataatgtaacacattatctaaatactagaattcctaaagggaacagtaggtctgaatttgtagtcttagatcagaaagtaaagcgaaggaagacaaactggagcatggtatatacttgcgtgatttccactatggg

SEQ ID NO: 236797 - DNA, 901 bp, Homo sapiens
ggcaatccggccctccagagaccgttcagctatcttgagccgctagagctaggagaaaaatgcagacgcgaggagacgtgggggattgctcttccttgtttgatgtgggagaaaaagcgactggggcttgctggacccgctcccctgtgcggtgacatggcacctcccttccgaccgttggccgggatagctttcccggaggtcgcgtcccccagcggaggcggcgggaatcgcggaggttttgtgctgcggctggggtctttctggccgtcccgcctctagatgccgggtggcagggagccggtggcggtcggccatgtgaaggtggccatcttggccggccagcgagggctcctcacggccttccttcggcgtccctgcccggctcgttgccggccccgggatatctgaggggcgcaggcccaccttctagtcgtttcctggtgaatggctctgctgaagatggccggaaagcagattaatgaaggtgctgccatcgatttaaacaatcgccctcctgcccgctcccctgcgctaaagtttctgagggatcctcacccttcgtggttcgtggacttaaaagtggaggcagcgctccagcctttccctccagagagaaaggaggccgctcccaagtccgtccttgccccgtggccttcctgttcctttgaagggggggggaatcgatgtttcaatcctctgttcaggagaatatggaacgaacatttcttttttggtgggtgggggctattcgttcccttgaatgtgcttaagcagatctcttgacggcgtggaatgggctgtttcatgaagctttcactttaaaatgtccacctgcgtttgtcccagttttgcccaataaaggaattacagggaaaaagagcgaacaaaacttgagcca

SEQ ID NO: 236798 - DNA, 391 bp, Homo sapiens
agttgctattgtataaccgtcccaatctgttttgaataaagagaagaaagtgtgttatggggcaggagcagtcatggaaaccaaaaagggcgacatcaggctgtgcgcgatggctcacgcctataatcccagcactttgggaggctgacgtgggcggatcacctgaggtcaggagtttgagaccagcctggccaacatggtgaaacctcgtttctactaaaaatacaaaaatcagctgggcctggtgacacatgcctataatcccagctactcgaaaggccgaggcaggagaatcacttgaacccggaagacagaggttgaagtgaggcagtgagcagagattgtgccaccgcactccagcctgggcaacagagcaagactccctctcaaa

SEQ ID NO: 236799 - DNA, 459 bp, Homo sapiens
gtgacaattgttaaaaagaattggtcttctacagatttccaagcctttaattttcattttccataaaggattttaaaacttcacagtcttagctgctgttggctaactcatctgcagtgaagtctatttaaaagtactaacaactcaaagctatgtttcatcccaaagcacgttatgaaaacaggaattgcaacagaaatgtaattcaaagacttttattgacttttcatgtttaatggttattattctggtttgtttcgagtaattttaataaccacagtttaattacaaaattcagactaattcttttgttcccatgccaacaaaatacatttgttcccagacagctggtatgatgcatcattctaagacttgttatgagagatagaaccacatgtaattttggccacatgttattctccgtgacagtttgaacacttgcctctgttttctgaaaaa

SEQ ID NO: 236800 - DNA, 292 bp, Homo sapiens
gcgatctcggctcactgcaaccaccgcctcctgggttcaggtgattctcctgcctcagcctcctgagtagttgggattacaggcgcgtgccaccacacccggctaatatttatatttttagtagagatggggtttggccacgttggccatgttgtgcccagccaatgtcatctgtttctttttactttttaaaatatgtgggtcttgaacatttacacacgtgttggtcaacatccaggtgagaaaagacggaacacacaagctgtcagggaaatgcaaatcaaaaccatcg

SEQ ID NO: 236801 - DNA, 446 bp, Homo sapiens
ggggagctgtctgatctgaattccgcagggcagtcttgcccatcatagagggccagatcaacctgagcaccctttggtctgctggcctctcctggggccccagcctggccatgcctgcttgcagggcagtctcaggtgccctgggggcctgcatcataacttctgcactggcagacttgcctgaccagtggagagctccagcatggcggagcctagaggagggtccccatagggaccttctccccatactgcggcttcccctaggcccatggcaacttctcacatctccttgctgacacatgtctttgtgggcaggttttgccatccttgccccgccagcacacaggagtgcagtctgccctcccagcttcatcatctgccattgcagatgaagctttggtgggcagaaagccagccagccccaccatcaccttacccttgtgcta

SEQ ID NO: 236802 - DNA, 478 bp, Homo sapiens
cagatacgtagagatatggagataaactaaacagccactctggctgggtttgttttaccaaacaaacatagcaagtccgcaaacatttgctggtgtgtggtatatgccaggcactatgttagagtcccaagatccaaagatatatgagctcacttccagatgagctcacttccagatgaaaaggctttcactgtttagtagtaaaatgcacatacatccacatacacacacatctgatatgctcttgccatgtctctgacaaggtctgtgtcagcatctgaggtttctcattagagaatatcagggtgagatgggccatgacacagcctgtaactgcttattccttagtgcactggctgcaaaaccttgggctcaaggttgctggggtcacttggcaaagtaggcaaggcccaaggagcattctctcttcttgctttggttattttattttattttttcaatgctttaggggagaccg

SEQ ID NO: 236803 - DNA, 377 bp, Homo sapiens
gccccaagtgacttggtcggtgctcccttccctgcagcctgtgtaactgcttcagtctccggtggcctccccgcgacccaccacgaccccgatcacggatgccctcctactggccccggacgacccccttccccttaggaaccccacgttcctccaaccagaaaaacaattccacagaaatgcatcgagagcctactaagcgcaagctcccactgtgagcggcgtggtctgcacggggctcgcggcccgggctagcagtccttttcccggccagcccatcccagccagaggccggcgctgcctccgccgcggtgcgggggcgacagccgggggcggaatgcgccgggcgcgggcactggggcaccgagaggcggccg

SEQ ID NO: 236804 - DNA, 454 bp, Homo sapiens
ccaattattttgtctaattatttactaagagagacatgttctatttgctactatggtggtagattttccattttccctttagttctgtcaattgtaggtgactaaaagttgtaattattgacccctggacatttatgcggactctctttctttctttgggcctagaaatggtttttaagtttatttgttgtaatttgcccaacagtcagtgattctgtagagagagtacttttcataaagtatactactcattattgttttttagccactatgcatctgagggtttgagttaatttttaaaatatgtaaatttaattactatggatactaatatcgaacatcctaggtttacgtgcttggtaaatgcttactgaataaaatcctgaacatttgtcttaggaaaataaaaatattttttgagctgttcttaaaaataagaattgcgacaatttat

SEQ ID NO: 236805 - DNA, 175 bp, Homo sapiens
ttatgcattcattcattccacaaagatttattgaatgcctgctatgtgttaggcactgtgctacagatggacacagatgaaaaataactcctatacccaaggaatatacgatatatttggggggaaagggaggaatctgtatgtgaataagagcaataaaaggctgcatctgttg

SEQ ID NO: 236806 - DNA, 370 bp, Homo sapiens
gacgtcatggcgggcacctgtggtcccagctacttgggaggctgaggcaccagaatcacttgaacctgggaagcagaggttgcagtgagctgagatcacaccactgcactccagcctgggtgacagagcgagatcccccatctcaaaaagaaataataaattattgttttctaaaccactaaattttagggttggtttgtgatacagcaacagatagccaaaatactagcagaaaagactctttggcttttgtcttatttctgcctggaatatgaacacaattcttgggatgcagccaccatcctgcctccacgaagaagaaaaccgcccataatttctacagcagcctgaatagctgacccctggactt

SEQ ID NO: 236807 - DNA, 364 bp, Homo sapiens
gttttaagaaaaatacattattttaggatgtaaacacaggtaatctttctttgaaagcagcttataaaataaatctgaggctgggcatggtggctcatgcctgtattcccagcacttgggatgccaaggcgggtgggtcacaaggtcaggagttcaagaccagcctggccaatatggtgtgaaaccctgtctccgctaaaaatacaaaaattagccgggtgtgttgatgggtgcctgtaatcccagctacctgagaggctgaggcaggagaattgcttgaacccgggagatggatgttgcagtgagtcgagatcccgccactgctgtccagcctgggttacagagctagattccgtctcgaaag

SEQ ID NO: 236808 - DNA, 577 bp, Homo sapiens
ccactcggcaggctgaggcaggagaatcacttgaacccggaaggaggagattgcatgagccaagattgcaccactgcactacagcctgggtgacagagagagactctgactcaaaaaaaaaaaaaaaaaaaaaagaaaagaaaaaagaaacgtaacatggtactactcatgttacgattggcttcagtcatctacttcagtggattcaactctctgcttgtagataaattacttccatttcctgagaacataatctgcctattttttaggccagtggtctccaaattattttgattacacattcctggccaggcgtggtggctcacacttgtaatcccagcactttgggaggccaaggcaggtggataccttgaaccctggagtttgaggctagcctgggcagcatagcaaaatcctgtctctacagaaaaatacaaaaattagcctataatcccagctactcggaaggctgaggtgggaggatcgcttgagcccaggatgtggaggttgcagtgagccaagattgtgccactgcactccagcctgagcaacagaatgagaccctgtctcaaaaaaa

SEQ ID NO: 236809 - DNA, 159 bp, Homo sapiens
agttgagaatttgctaattcagtcatcatggtgactttacagaatctaactaccaagaattacaaaaattgactgtatttagcttttccagtctcctttatacaggtagacaggagaggtgttagggaatgagtgcttcgttagtcaacctacaagtgt

SEQ ID NO: 236810 - DNA, 453 bp, Homo sapiens
catgagtagacccatggtcattaccaaatctggtcatttgggtactattgtaggtttaaccctagggcaatattctcgaagtttagttcagggatccatggggttccccaagactttctggagcacacagcttcttcaaatctactttcataatgatgctaagttatttgttttttcagtctcattgtctcattagtatatagtggcactgtccagatgctctatgctgtattgtgtcataaaagatgaatatagaaaaagaaaaaagaatctagctgtattctattaagctagacattaaacagatttacaaaatgtaaaataatgtcattcttctaatttttttttgctttgggaaatacagttatttttcattaaaaacatatttatgttatcacaaagtgaatatgttattttttatgaatgaaaaataaatatttaaaaaatatttta

SEQ ID NO: 236811 - DNA, 448 bp, Homo sapiens
gagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatg

SEQ ID NO: 236812 - DNA, 544 bp, Homo sapiens
  misc_feature (375)..(375): n is a, c, g, or t
  misc_feature (378)..(378): n is a, c, g, or t
  misc_feature (380)..(380): n is a, c, g, or t
  misc_feature (384)..(384): n is a, c, g, or t
  misc_feature (386)..(386): n is a, c, g, or t
  misc_feature (393)..(393): n is a, c, g, or t
  misc_feature (516)..(516): n is a, c, g, or t
agctcactccatacaaaagaaggattagaagtaggatatacagttagcaatcagcacccacgggctctgcatccatgggttcaaccacgtgcagattgaaaaggcagttaggcctatgatcattgcatctctactgaaaaatgtacagacttgatgttattccccaaacgatacagtaaaacaactgtttccatagcatttacatcacgttaggtattataggcagtctagagatggtttaagtacacggagtatgtgtgtcagtgacatgcaaacaagacaccgttttgtataagggacttgagcatctgtggattttggtaaaaaaattcatggggttcctggaagcaatccctagcagataccaagggatgnctnantttnanataagancaatatctaagaactctccagctcagtttgataaaatattacttaagcctactatgtaccaagcactttaaagtgctgagtgttaaaggcttgcttaagagtaatgtgtatagtaaaatcccnttaaatcaaagccaaacatcaaagaaaa

SEQ ID NO: 236813 - DNA, 113 bp, Homo sapiens
tgaaggcctgggtcaggaccctgctctcccagcgcagttcccagctgtctccctgctcctctactggtgatgggctaataaagctgactttctggttgatgcaaaaaaaaaaa

SEQ ID NO: 236814 - DNA, 764 bp, Homo sapiens
cagggtctcactctcgcccaggttggagtgcagtggtatgatctcagctcacttcagcctcgatctcctgggctcaagtaatcctcccacctcagcctcccaagtagttgggtctacagtggtatgagcacaaaaggaggagatcactggagatatattaaagtatggagaccaccatctgtgtgaagacagaaggacaaaccatatggcatatggaggtaaagactaccgatggcttatggattatgcaagtgattgatatttgaaataaaaatctacattgagttatcaaagataatagtcacttccattgaagaataagcaaaacttccaaagacttcattaatatccacatcagtgatatttcaagagagactaactcagcagtgtcagctaatgaaagtgaatgaagaatgtgaagattaaaagatcgtatgaatcaagaattaatttgtgaatttcatgagtcataagtgcccctagtgttttcccaggcctcaccaaggctgtaggtacaaatggtagagttgccatcatgttccagccactcttggtccccatctgcatgtgccgggtgtctcctcaaattctctttcaagttgagtcctagcaggtatactttaccagttcaacaggcccactcaagaagattcaatcctaataacagatacagcttaagctaaagcttggacacctcaactcttgtataagacctcagtctttgtacctgttttgtactattaattaaacagtaaagtttcttt

SEQ ID NO: 236815 - DNA, 357 bp, Homo sapiens
cttccgtaaacgtatgttgaattagagaattttgtgaaccaggctgtcaagttgaaaatccacccaggccaggtaagtagaaatagaagccagttttaaccagagtagaggctgtaaagtttggatttggttttgtggaaatctctggttattgctcttcagagcactgtacccagggaataatatatttctaccctgttgagcagagtagatttccctgtaaagaaagattaaagaggctgggcgcggtggctcatgtctatagtcccagcactttgggaggccaaggcagaaggattgctagagcccaggagtttgagaccagcctggacaacatctcaagactctgtctctacc

SEQ ID NO: 236816 - DNA, 458 bp, Homo sapiens
gggtttatggtgaatgactgactttatatgcctgaggccctgagccatgctgtatttatttgaaccatgtggtatcaatttaaccagatacgtttattctaagatatgatttatgctgaatgcctggttttgttctagagggatcatggaaaggaagctgaatttgccaagttttgccacttgggcattgcatgcctatgtgattaaccaccaataaaaacctgggacatcaaagaataaataagctgctctaattgccaagaattcacatgtggttgtatgcagctttactgggagactgaagtgtatctgcatgtgattctgctgtgatggacacttgtaagtttgtgcctggagtctcctggactttgccctgagaatctttttcctttgttgatacgactctgcatccttttgttttaataaactgtaaacatgagtataattgcttctctgag

SEQ ID NO: 236817 - DNA, 306 bp, Homo sapiens
tgtctcttcttgggtctgtcatactttctttgttcttctttcctttcctgggatttctttcctgctttcaagcaactccaaactaagacattggagaaaggagacaactcactgttaggatcatcctgttagggatcttttcagggaagtccctgaagttttccggatgttggcttccttacccatgaaagagaaaggatatagcctgtgccagctgggcatggtggcttgagcctgtaatcccagcatttttgggcccaggggttcgagaccagcctgggcaacatggtgaaaccctgtctccac

SEQ ID NO: 236818 - DNA, 454 bp, Homo sapiens
ttctgcagacatcagccgagcatactgagatgagaaacgggttctgccttgcagatacccagcctgccaggagattcctacccagtggtggggtgggtcccataacccgagaccactcagagcccagggaccccagaagtggcaccagcctggcctagaggaggtaacaccaagccagggaggaaggtgaagggctcagtaccccctctggaggaaaattttgaggaaccttgtttgaggcggtcatttcctaagctagccttcagtctgagccccagccccagcttctggacttggacagtccctcctgtcatcagccatgggtggccagggcagcctcaagatggctgagggtttggggatgaccccaactccctctcccacagcagggtcaggaggctcactgggaggagtgaggtgggataaaacccagctccagacacaaaaaaaaaaa

SEQ ID NO: 236819 - DNA, 95 bp, Homo sapiens
gtatcaggaatctcttttagccagagtcactattaggaaaaagaaatacttgcaactgggaacttcactttcaggcttaaagctcctgcagagga

SEQ ID NO: 236820 - DNA, 2000 bp, Homo sapiens
  misc_feature (1587)..(1587): n is a, c, g, or t
  misc_feature (1604)..(1604): n is a, c, g, or t
  misc_feature (1611)..(1611): n is a, c, g, or t
  misc_feature (1614)..(1614): n is a, c, g, or t
  misc_feature (1622)..(1622): n is a, c, g, or t
  misc_feature (1626)..(1626): n is a, c, g, or t
  misc_feature (1633)..(1633): n is a, c, g, or t
  misc_feature (1645)..(1645): n is a, c, g, or t
  misc_feature (1653)..(1653): n is a, c, g, or t
  misc_feature (1663)..(1663): n is a, c, g, or t
  misc_feature (1667)..(1667): n is a, c, g, or t
  misc_feature (1683)..(1683): n is a, c, g, or t
  misc_feature (1689)..(1689): n is a, c, g, or t
  misc_feature (1691)..(1691): n is a, c, g, or t
  misc_feature (1708)..(1708): n is a, c, g, or t
  misc_feature (1713)..(1713): n is a, c, g, or t
  misc_feature (1718)..(1719): n is a, c, g, or t
  misc_feature (1721)..(1722): n is a, c, g, or t
gaagaatgtgataaaggacatgatgattagagaaaaatgttgtttcaatgttaaatgtgctgaagctgataatactgtggttttataagagaataaccatattcttaggaaataatctaagaagtgtttaagaataaaggaccatgattctactgtgtattggttcaaaaaaagattgtgtgtgtgtgtgtgtgtgtgtgtgtagaaagaggtaataaaagcaaacagtaaaatggtatcagtaggtgaataggtaaatctgggtaaaagtatatggtgtattctttgtactattcttgtgactgttgtgtaaggtttaaattatttccaaataaaaattttaaacaatttttaaagtttaaaaagttaaaatatagcacatctcaagaattttcttagtcaaccaattataacagaccatactctaggatcatcagttttggattatttcctttgatttgttgatgaagcactaaactgaaagcaataggaaattttctttatagctgtagtttctacctattgaaggccattagcttctattaggagattgtattgaattggatacatttatttttcacaaacaaaacaaagtctctaattttcacttgtacttctagctagatgaaagagagaaagtggccatgtgcggtggctcacacctgtaatcccagcactttgggaggccaaggtgggtggatcacctgaggtccggagttccatgccagcctggctaccaaggtgaaaccccatctctactaaaaatacaaaaattagccgggcatggtggcgcatgcctgtaatcccagctacttgggaggctgaggcagaagaatcacttgaacccaggaagcagagattgcagtgagccgagattgcaccactgccctctagcctgggcaacagagactccgtctcaaaaagaaaaagaaagagagaaagtgaatttgttcatacatatcctcaaagatctttacagctgccttacatttcagattgttacctaggtcttagtttagtttactataaccttttgacccaaaagtaggaatattgccagctaggaatcagtaatgctattgcaataaaaagggaaagtgttttaagtaaagcgctctaatttggaagcattaactcaatttatatattttgttcttgagacaaaaaaattgagtgaagttaaagttggcaaacaagatcagttttggcttttgcactaacctcaagaaaaataactactgtaatatcaaatgtcagacatttagtctgcaattgctaggtgtttaaccaaaataaaaataattttatttgttgaagtttaaagaaagaaaatataaaaatcagaaacagaacttttgctcatggccatataacaataaatagaaagtttggtgatggtgagttttttctcctttaaaatttttcattatggcagggcacagtggctcatgcctgtaatcccagcactttgggatcgcttgatcccaggagtttgagaccagtctgggcaacatggagaaaccccatctgtaccaaaaatacaaaaattagctgggcatagtggcgcacacctgtgatccctgctantcgggaggctgaggcangagaatngcntgaacccnggangcggagnttgcagtgagcngagattgngccattgcantccngcctgggcgacagagngagacncngtctcaaaaaaaaaaanaaaanaaaannanntaaggaaagagcctgtaatcccagcactttggcaggccaaggcaagaggactgcttgatcccagaatttcacaaccagcctgggcaacatagaccttatctcaaaaaaaaattaaaaagtagccaggtgtggcacacgcctgtagtcccagctacttgagaggctgaggtgggaggatcacttgaacttgggaagtcaaggctgcattgagctgtgatcaggcccctgtactccagcctgggtgacagtgagaccctgtctcaaaaacaaaacaaagc

SEQ ID NO: 236821 - DNA, 409 bp, Homo sapiens
tttgtttaaatgtgtgttttaagttttgcttaatctgaattattttattaggtttttggttctcatgccagagtaaaagaaatgataaattcttttttcctcatttaacacatgtatataaaatactttgagtaacttcacatataaaaatatttagaagagtttaagctgggttttttgttttgtttggctttaaaaacaaaaaaagttacaggtgccagggataatatcttggctgcgtaacttgtatcttaccaataaaacttagtgcgttctgttttcctagaatttaagagttacaaatattgatgcttttagtgtggaatttatatttacaaaagtaattacttccagaaagttttctggctaagtcacctcttaaggagatccctgtaaaattcacccttta

SEQ ID NO: 236822 - DNA, 776 bp, Homo sapiens
atcatccatatcttggccagaaagaaaaagagcaaaatatggaaataatgtatataagactatattgtataaccttggcccactattcattagcaagggaaataaaataaggctcttctaaccaaaaagaagaaaggttttctcctgaggaaggtggaatatatatataatggataagggaaagccaatacctgccacaggatgccagtagaaaactcccagtaccaaactgtcatttttcaatggcccagaactattaaaacattttattaactgacttaaggaattttatttaaaaattttattaactgacttaaggaaaaaacactaccaattatacttctgcactatttcttaaagagtatttacagaataatctcacctcaatgttcatttatgaaaataagtaggaacccagagtgcagagatccactttaagaatgtggcactaagccaggcaacgcagcacacatctgtagtcccagctgctcaggaagctgaggtgggaggatctcatgagcctagaagtccgcggccagcctgggcaacatggcaagacccatctcaaaaaaaaaaataaaacaaaaaaactggcccagtgtggtggctcatacctataatcccagcactttgctgggctgaggtgggaggattacttgaggtcaggggagttggcgaccagcctgggcaagataatgttgcctgtctctacaaatatatacgtatatatatacatatataaaaatattttaaaataaaaatatattaaaaactag

SEQ ID NO: 236823 - DNA, 747 bp, Homo sapiens
tgcctttgtgtgctttctctctctcctgcttccaagtcaagatgtgctggcttctcctttgcccttctgtcattattgtaagtttcatgaggcctcggagccacgcttcctgtatagcctgcagaactgtgatcattccactcttctgctaatgtcatgttctggttcagggagtcctccagggatggccatacctttctctccaagagctttggcgaactctactccaatctgaacagacagaatgcaaacaaaaatctaaccaggttttgaagaagagttaaccacgttggagacataaggttactcaatgtgaagatgacaacaagggtgaagactttaatgatgatccacttccacttaaaaaataataaatatattttctcctccttatgatttttaacattttattttctctaatttgctgtaagaatatagtgtataatacatataacatgaaaaaatatgttaatcaactgtttatgttatcagtaaggttggcagtacactactagaagttaggattttggggagtcaaaatttacatgtgaatttttgactgcctgggggggtcagaccctataatccccaagttcaagaatcaactgtgtacctccttttctccatccattcatcatctgatggacatgtagaagttttgcttttttatcttaccttttattatatatttatatttaccatctctctaaaattgacttatgtgtgcttatgaatttaagattcatt

SEQ ID NO: 236824 - DNA, 573 bp, Homo sapiens
tgcctttgtgtgctttctctctctcctgcttccaagtcaagatgtgctggcttctcctttgcccttctgtcattattgtaagtttcatgaggcctcggagccacgcttcctgtatagcctgcagaactgttactcaatgtgaagatgacaacaagggtgaagactttaatgatgatccacttccacttaaaaaataataaatatattttctcctccttatgatttttaacattttattttctctaatttgctgtaagaatatagtgtataatacatataacatgaaaaaatatgttaatcaactgtttatgttatcagtaaggttggcagtacactactagaagttaggattttggggagtcaaaatttacatgtgaatttttgactgcctgggggggtcagaccctataatccccaagttcaagaatcaactgtgtacctccttttctccatccattcatcatctgatggacatgtagaagttttgcttttttatcttaccttttattatatatttatatttaccatctctctaaaattgacttatgtgtgcttatgaatttaagattcatt

SEQ ID NO: 236825 - DNA, 312 bp, Homo sapiens
ctccacacactccacccccgcctccaccttctgcggcaatgaagccacgccaccctagggggctcgggggccggatgctggcggggcgcgcactagagacacgccgcactggaagcagccctcggagtcccgtgagccagggagactggggtgcaccgcgccacgctgagtctcggtgtaaaagccgagagcgtgagcacctcctggccgaaagcacgcgaggcgctccttgcccaggaccccgcgcgccccctcagttcccgggcagctgtcggcgcgcactggctgacgcgagctctgctcccgcggccg

SEQ ID NO: 236826 - DNA, 511 bp, Homo sapiens
gagaagcttcttccttctttctgcttgaactgtcattgcttcttctccctctgtggggctatatctgaagaataggtgatattttatatacagaacagcatgagatttctccagaagcagaagaatagcaatgtccttagtgtggagtgaactagcacctgagtgatattcattacagaaatgcgtttccagaagggaccagaaatgtccccttaatggaaagaaattgctgctacgttaggatcaaagatgaaaggggaaggtaatgcgtgcttagaaggagagctttccatctcacacactgttcgtgttggctgcagaactggagggtgtcacaggcgtctaatggatatatgctccctgggcaccacacactgggcccttgaccactgctagagcatggaggaaggggtttggggggcatgatgaagaaaacctgacttgttgtattcattagtgcttccataagtcaactttcggtaaaaggctgcataataaatatgttaaatgg

SEQ ID NO: 236827 - DNA, 406 bp, Homo sapiens
aaaagctaaaaattgtaactgttaagttttgtagggagatacatcacaagggaggggaggttgcagaagggaccctatttccctctggagaagaggcagctgagctccagcagccagcctgccccctctagccctaggtaccctcggcatccacggccactcagccccagtagcctgcttggacagagcaagaaattccaggaaagagtaattctaggaagcaaattaagcaagttaagacactttgcagggggaaaaggaatctttcatcttcttctcaggttttcatgtttgaaacagaatgggagagataggagggtgtgtgttaaattaccctgttgcagctattttcaagttgtaagaaatgaacttgcaacacatagggctatttagacagtttatcaga

SEQ ID NO: 236828 - DNA, 418 bp, Homo sapiens
cagtatcattgcagggaagggaaaactgtcactaatacagatcttaggtttctttcttagatgcagtgacagttattggggtttgaaatacatcttctacacccttgccactcaaagtgaggtctgaggaaggccagcatccaaatccgtggggttctcttttgaagtgcagaatttcagctccatcttaagctcagtgatccaaaatctgcattgtaacaatgtctccaggtgattcctatgcacaatgaaatttgagaagtgttctactctagataagtagcttttaaacagtttggatcacttgctcccacctttaaaaaaagattttgagtatatagcctaatatgtgtacttatgaattgtgtagttgcttttctattaatattgcatatcattaaagcttcttgtagacaat

SEQ ID NO: 236829 - DNA, 501 bp, Homo sapiens
ccctttattttaagacttaaaactttattttaacttgtaaattcaaataaacggcaaacatttatcaaataccttaaggctgtgtcagagcatatatgtatcagattaccatttttaatcatagatttttcttttaactgtggataaacttaaaaagttattggtaacagtatatgcttatggaagaaaatatagaaaaacatgggctgggtgcagtggctcatgcctgcagtcccagcactttgggaggccaagttgggtggatcacttgaggtcaagagtttgagaccagcctgaccagtgtggtgaaaccccgtctctactgaaaatacaaaaaaaaaaattagctgggcacagtggctggtgcctgtcatcttaactacttgggaggctgagacacgagaatcgcttgaacctgggaggcagaggttccagtgagctgagattgaatcattgtactccagcatgggcgacagagtgagactccatctcaaaaaaaaa

SEQ ID NO: 236830 - DNA, 327 bp, Homo sapiens
atttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtattt

SEQ ID NO: 236831 - DNA, 407 bp, Homo sapiens
taatttccaggatgtgacaggccttttgtaatctgtaatcactttgagatggaccctgttgaagccacttttaaactgtagttgagaatcacataaaatagctgtgttaaaaacatatttttaggggaaagatggtcaaatcagacattctttcaagcagtgtactcttccacccagcacatttttttatgaaagtccttttcagatattttataccaaccaagagctttttgttgaactctgacagactctgtggtctgtgggtctggcatgtattcaaaaatgatgcttagcacacagtgatgcaacggaaatgcccttatcctaagctgtgcacgctctaatcctagcaaggaggaaacaatagacaaggggtatatggttttctttataatgtaactaaccta

SEQ ID NO: 236832 - DNA, 620 bp, Homo sapiens
agaataaaataccagtcttttatcttacagtaaattcttcaaaaaccatatactctaacaattaattatttctctggagaaagggacaggcctttcccctcgaagacagcttggtagtctccgagtcttaattatgacagataaaacataatttatagtagtccagggcttacagaaaaatgacatcatagtcgaggttctttgattcttgaagtgacctgtcagtagtcagggctctgggaggagtgccccagacaatcaccaccaggcccaaaagagtcaggacagtccctcttcctgcggagacatgccccatgcacagagctactataatacaaacggcaaaatatgtatgtatacagctgatgctcggacaggactcccccaaaacttaactgctaataccctactgttgaatggaagtcttaatgataacataaacattcaactaacacatattgtgtatgttacccatattatacactgtattcttacagtaaaataaactagaaaaagttattaagacaatcctaaggacgtgaaaatctatttactattcattaagtggaaatggatcatcatgaaggtcttcatcatctccatggtgagtaggctgggga

SEQ ID NO: 236833 - DNA, 1647 bp, Homo sapiens
ttctttaaaaataaaaacaaaacttgccaaaaactcatcataaggaacaaaagcaacagattctccagctgtggccctttaccaaaagctctggcccaagcttctacacagcaaagctgctacactccgtggactcctctctccatcagactgccactgattttgttttagaagcatacgtaggaagagccttggctttgagggacctgctgcctcccctgtgactctgtattggtaagcacagaagatcctcagatcctccgagaagttctcagcagacatcctcagctccaggcctcccttcttctccaccctgctcagcatgaacctagagctggaggcagctagccatgtctggctgcctccctgggtcctcatatgatactgagccaggtctccagggaacactgttcacatggacagagtctgaactcagtagtgatgctcctgagtgggttccacaggaaacacaccggctattccaaaggcctgctggccacaaagccttctaacaataataagtactagcagtatcactgctgtttattgcttcctgtcaggtgggaactaagtccattagcccaagttcagtagccctgttttacaaatgcagaaacaggcttagaacaattaagaaacttgatcaagaccacacaattattaagggatagagtcaagaatttcactcaggtctccctgactccaaagcctgtgctcttaaccactatagatgtctctaatgcttcggaggggaggccaccatgacccccacttacagtcaccagctgggccccggccgcccagagatcatgcagagtgaacagaactgatttccagcactgctgttccatggctgtgtgactttcgaccgtctcatttcccctctgtttctcagttccctcttatgaaagatggaggacactatacctgccatgcctcagtgggacaagatcatctataatgttctgcatggaagcaccatgaaaggcattaccagcttgaagaaaaccagtgtctggaatgaggcgacaccagtatgtagggagagcaatcgggaagcgataagaaggagattcactaggggtctgctgggccgcctgctgcagagaacgcctctagaatcctgcactcccgtcttccttcctgcagctcaaagctggcccaccctggagatggtaccagctggggctctccttccgggcctcagtgagggaggggaaggagccaagaatgggtcagtaaccacaggattctttgagttcacagagagtctgcctgctgtgggcctccaaagagttctgccagttcttcccaagtcagcttgggcttaaagtccttcctgcaccaactgggaaggagctggagaagctccacctgggatgggaagctcgacctgggatgggaagctcgacccgggatgggaagctcgacccaggatgggaagcctactttgtgttgaacttcctattttgtcactctctgcaggcccaatgaccagagaattttctctgccctttctggcaagattagtggcttcccctcacccactctacccccacctcctcattacagaacaaaggaacctggcttcttcccgccagtccagagagggttcctaattggctttccattaaagagaaaatagac

SEQ ID NO: 236834 - DNA, 409 bp, Homo sapiens
gagacggggtttcaccgtgttagccaggatggtctcgatctcctgacctcgtgatccaccagtctcggcctcccaaagtgctgggattacaggcatgagccaccgtgcctggccagcttctacttatgtgtgcttaatgtaggtcccttccaccataagtttgcgcctggtgaaaaaaaagaaaaacaatatatgcacatgtgcaagtctattcatgacacttctgagctcaaaatctctacagtgactttctcttgcttttaaagaaaaaaattgaactcacagccgagcatgctagctcatgcctataatccaaacactttgggaggctgaggcaggaggattgcttgagcccagaagtctgagaccagcctgagcaacatggtaagaccctgtttctacaaaaaat

SEQ ID NO: 236835 - DNA, 402 bp, Homo sapiens
tgctcttaggtttttagaccatatcaaaattctctctctacacacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaa

SEQ ID NO: 236836 - DNA, 93 bp, Homo sapiens
gctctcttcctgcataacagtaacccgtgcttgctaagccagaatttgaatgcattcttttgcttatcagttgaaaatttcagttggtgtcac

SEQ ID NO: 236837 - DNA, 1320 bp, Homo sapiens
ttaatagattgaagatattattaaatacattctgcattaatattatatgtcctctttgaatccaagtggcaatacaatagaatttcattttataaataacacctttcaagcgaacaccacagggcacagtacataagaatcaaaatagaacacaaatgctgtaatcaaatgcagaccccaggaaggctgattaaaaaggcatgttgctactaagaacagccgacaggttaagtatagtgggtcatagcagaaaagccagcagaacagaagggcaaactaaaataaaatggacttgcctgcctgaatcacacggacttatgacattcctttgtcttcatctctttttgaactcaggaattgcaggggagaggggggtgtgcatgtgtgttggaggagagaactaaacatagggtcattaaatttatcctcagtactcacgcatagcacaaacaaaaggaaatcataaggataaccacctgcagctggcagagatgcctacagtgtgattgtgagacaacccaacatggcttgctttgctggataccactggctttaagaaaacacaactgtgaggtaacaagtagaccccttccataatagtgagaacagatagtgctgatggccagacataggtaaaaacggatgaatggtgagaaagatgttctgtggtcctgacctcagtatagtctactctctacaggactctcctcacccaattagcttttctgctctcagcctctcacaaccacgctccttgctaatgtcaggtgtttgtggttttaaactctacctgtaattatacagcaaaagcacctgttcccttcttaagggaattaggcaaaagtaggggaggtattttggaatatactctctccccatatgtaaaactagttctaacaatgatcacagtatcatagtttaccaaattggtcatttattgatgcttctctatttaatattaagagtagaacaatataggaccagaatcataagaaaaaatttctaaatatgtatttttctgaaaaacagtaacctatattttgctgggcacgtggctcatgcctgtaatcccagcactttgggaggccgaggcaggcggatcacgaggtcaggagttcaagaccagcctgaccaatatggtgaaaccctgtctctactaaaaatacaaaaattagctgggtgtggtggcacatgtctgtaatcccagctactcaagaggctgaggcaggagaattgcttgaacccggaaggcagaggttgcagtgagccaagattgcaccactgcactccagcctgggcaacagagcaagacgccatctc

SEQ ID NO: 236838 - DNA, 695 bp, Homo sapiens
ccaccctgggccctacctacaaacttacctgattctgagcctgtttttaccttccattcaaaggaggagatacagctcttcctgttgcagcacacaccccatcactgcccatcttttcatacactcactccattgagtagccctttctgcattcggtttgaagtttcttctggagaacagtgaacatatgtcagtctttcctgtctaaaaatatatgtgtagtgagtgtgtgtaggtgggagtgtatctcttcatggactttgcatcctcagttttctccttctgtttacaaatagatgtcttggaaagatagctatgtgcggtccctgttccctcacttttcagtcactcctcacgtcactgctattcatttctagccctaacacatcgcttctctcacttccatgggatctcccttttctagagtttctacttccatgtttactcctctgctcctctgccagcttcttccctttcttaaatgcttttgttaccttgaatcccttgtcactgagtacattcttcctgggtggttgaataagcccattcactatgacagtttcagccacctttaccccccagccccagactaactaccacgcaaactccagatcatggtctgcagcttccttttgaacattttcatttgagtatccccagacttagcaaggctcacactcaacatattttaaacc

SEQ ID NO: 236839 - DNA, 471 bp, Homo sapiens
agactcaggtgaagtaatagtaatggagaaggaagtagatactaagaggctatctgtccaagaaatcagcctaaattttggaaaaacctttgatgagccaaactgtaatgcttcccatctttcttctggccaggatatccattaccaaaacttgacatgaacttctcattggagaatagagaagagccatgggtgaaggaattacaggattctaaagaaatgaaacaattacttgattccaagataggtaagtaattgttctttgatatactagtgggaaaaaaaaagaaaaatttaacctaaataaagagtttggaattctatttaggaatttctatgttcctgccactggtttaacataactcttcattttccttcactttcttttctccatggaacacaatatcatctgcagtttctatttcttctctcaggttttgagatcgggatagaaaatgaagaagatacttc

SEQ ID NO: 236840 - DNA, 482 bp, Homo sapiens
ggcaggccggcggggagtcccccggggcgcacggagcccgcgcgccctccgggaccctcccccgtccctgggccggacctgtgggcgccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgaagaagccaa

SEQ ID NO: 236841 - DNA, 899 bp, Homo sapiens
tctgcctccctccacttttccccacctatgttttgaaaagtttctgtcaccatataatatttaagccataatttactaatttgctttttaaaaaactttgatggcaaattaaaaaaaaatcatttttatgtttctgatactaggtattaccacatgctaagtggatctaattccagtcaaaagcaaagaaaaagggccctttagttagctgttcagccttgtcttgggcaatgtatgactttcattagtttttgttgaaacagtgaagagtgggcagttccttcctcactgagcttcagtcaggaacccctgcctggacccagctaggccagggccagggagggatgtggcaggaggagcctccaaaaagctccagttgacctctctgtggggcatggtggcctggctacaggatggagttcaaactccttcctttctggctacctcaaatcctgtttgaagcaaggaaaaaataaacaaatgaaaaaacacttaaaaaaaaaaaaaagaaaaaaaacactttagttttgtatttaactctcaccatggtctagcctaacctactttctttgtgcccctgatgagtctgctgtctcagcttttaaaataggaaactgagaaaatatatacacacacatacgtgcctatacacacctatctataaatacatatacatgtaaatatacatatatacatatatatgtacacatgcacaaatgctcatatacatacatagatggaaacagtgcagaagagattactcaaagcaagtgtgcaaaggaaataaaagaattgccaaatctctgggctgcaggtacaagataaggaaccatctcaaaagcattctgcaattaatttgttccgcactttactcccactcttcctcctgtttaggctga

SEQ ID NO: 236842 - DNA, 516 bp, Homo sapiens
catgagctgccctgagctttggtcgttggggaggtggctcaaatggagccagcggctgtggttgacctgccttggggagcagggctgaggggcgaagaggacatgtggatatccagccagaatgccctctctccagaggacacacagctctggatttctacccccttgctatcctctctggccattttgaacctgtaccacctaatgtagaaaaggcccgcctccagtgcccttctttccaaaacagctacacaaatgcttctgaatgccctggatacgcagaccgagtggcagtctggctaaaggcccatccagcactattgtgcccaagagccttaccgggcattccctgaagccccctcataggcagtgatcctagaccaaactcttaaatagaatcacttttgtttcctagaagagatcaaagagtggttgcttcttactttgaagatgaaattataccaagttaggttttttgctatctattgatccaaaaaatatattcgtgcaattaaa

SEQ ID NO: 236843 - DNA, 714 bp, Homo sapiens
cagtgaagtattgaagtcccccactattattgtgttgccacctatctcatttattagatccagtaataattgttttataaatttggaacccctagtgttaggtgcatatatattaaggattgtgatactttcctgttagactaatccttttgtcattatatagtgttcctctttgtctttttttttttaaactgttgttgctttaaaggctgttttgtctgatataacaatagctactcctgctcacttttggcttccatttgcatgaaatatttccacccctttaccttcagtttatgtgagtccttatgtgttaggcattctcttgaagacagcagatactcgattggtggatttttacccattctgccaatctgtatcttttaagtggagcatttagattattgacattcaacattagcattgagatgtgaggtactattttattcatcatgcaggttgttgccttaataccttgttttttccatttcatagtgttgttgaagagtgatggctaaatgtatccagcataactcacctacacttagttttctagataattgagttgggtggccccattttaataatgacaaacatgaaattctaaatgcaatatcatcttggagagattatttgattttttcctataggaattgtctccaaactgctttctagacagcctcacaaagcatctagaatgtataaatttgactt

SEQ ID NO: 236844 - DNA, 2620 bp, Homo sapiens
acacacccgggagacaccgcgaaggcagagcagcgttctcagcacagaccttgtgggcactgcctcgctttgggactactcggagccgcatcaatggtgaataaaatccttcctgtttgcagcccttaataatcagggtcagagaccagttagaagtgttcagtgtggaaaacgggaaaccaaaagcccctctgaatcctacccaccgaggttctccccagccaaggcgaggcggccgcagtgcgagatccacaccgcagcctcggaagacaagcgggcagaaatcccatgaggggcagttgaggtttgaggaaggcgaggtgaggcacctgtggcagaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgatgcacctggggcagagaaaaaaaaaaaaaaaaaaaaccgcgccgcctataagcggggcctggctcccccacagaagaaactgtcctcacatcagcgcttgcgctgcgccccagggaccctggtatccctggctcgagcccagcgtgcgcctcggcctgctaggggtaccccaaggcagacagaaggcccatgagggaaaggtgagacacctggggcagagaaaaaaataaaaaaactgcgccgcccagaagtggggcctgggtcccccacagacgaacgtccctacccatcagccctgaactgggccccggagaccctagcgtccctggctcgaaaccagggtgcgcttcaggcccgctagtggtacctcaaggtgggcagaaagcccatgaggggaaggtgaggcacctggggaaaagcgaaaaaaacaaaaacaaaaacgtcgcagagaagcagagcctgggtccccgaggaagaaagtgtcttcgcatcagcccttgcgctgggccccggggaccctggtgtcccagtttcgaacccagggtgtgcgtctggccactaggggtaccccaagtcggacagaaggcccatgaggggaaggtgaggtttgagggaggagacgtgaggcaactgtggcaggaaaaaaaaaaaaaaaaaaaaacacgccgcggagaagcggggcctgggtccccaacggacgaaagtgccttcccatcagcccctgcgctgggccccatggacactggcgaccctggttagagcccagggtgcgcctcgtgcccaataagggtatcccaaagcgggcagaatgctcattaggggaaggtgagacacctggggcagagaaaaaaaaaaccgcgccgcaaagaagcgggacctgggtcccccacggatgaaagtgtcttcccatcagcccctgccctgggccccatggaccctggcaaccctggttcgagccccaggtgcgcttcgcgcccgctagggttacccagaagccggcagaaggcccatgagaggaaggtaagacacctggggcaaaggaaaaaaaaaaccgcgcttgcagaaaagcggggcctggctcctccacggacgaaggtgccttcccatcagcccctgcgctgggccctggggaacctggtgtccctggctggaaaccagggtacaccttggacccgctaggggtaccccaaggagagcagaaagcccatgaggggaaggtgaggcatctgcggcagagaaagaagaaaaaccgcgcagcggagaagcggggcctgggtcccccactgacgaaagtgtctttccgtcagcccttgagctgggtcccgaggacgctgacatccctggttcgagcccacgctgcgcctcaggctgctacgagtaccccaaggaggaaagaaggcccaaaagtttcagctgaggtttgaggcaggagagatgaggcacctgtggcagaaaaaaaaacaaacaaacaaaaaaaaaaaaacgcgcagcggagaattggtgcctgggtctcccagggacgaaagtgccttcccatcagccactgcgcttggccccatggaacctggcctccatggttcgagcccagggtgcgcctcgggccgctaggggtaccccaaagtgtgcagaaggcctatgaggggaaggtgaggcacctggggcagagaaaaaaaaaaaacacctcgccgcggagaagcggggactgggtccccccacggacgaaagtgtcttcccatcagcccttgcgctgggccacagggaccctggcttccctggttcgagcccacagtgcacctcgggccgctaggtgtaccccaaggcagacagaaggcccatgaggggaaggtgaggtttgagggaggagcggtgaggcacctgtggcagaaaaaaaaaacgcgccacggagaagcagggcatgggtcccccacggacgaaggtgccttcccatcaggccctgcgctgagccccgtggaccctggcgaccttgactcaaacccacggtgcgcctcgggccgttaggggtaccccgaggcaggcagaaagcccatgaggggaagttgaggtttgagggaggagaggtgaggcacctgtggcagacaaa

SEQ ID NO: 236845 - DNA, 498 bp, Homo sapiens
tgtttttttaggtcaggttaagagtaagatggtgattaaaattttaattataacatgattacttattaaatgaagttgaaacgatgcacatcaaatcccaaaataggctcttatgtgaaagttctaactcgtagcttctcaaggtgctcttatataccactatattcagtggtttcagattctgtttcaagatcttgttgcagagaattgactttacatctctttagctgaactcattaactgagaggcgtaaatgctttaaagtatcattaagttagaagagttgggagtgttgggggactttgagaagacttgtggtttggggacaacaggaaaggtttttccatttgatgcatagacatcaacgaaagtttacacaaaacacagtgttactctgttattcgtgcacagttattggtatgtgaaagtattctttgctaaatgcaatacattgtaattaaataaaatcacttcatttaaaaccgcacttgaaaaatc

SEQ ID NO: 236846 - DNA, 2944 bp, Homo sapiens
  misc_feature (1512)..(1512): n is a, c, g, or t
  misc_feature (1530)..(1530): n is a, c, g, or t
  misc_feature (1856)..(1856): n is a, c, g, or t
  misc_feature (1866)..(1866): n is a, c, g, or t
  misc_feature (2437)..(2437): n is a, c, g, or t
acagtatcaccatgcctctcatagcgccacgacactagaagaaacctcactgattgctgtccctgtctacagtccaagaggatttcaaatgggcccacacggtatagctgagaacccgaatcccttgctgatgccagctcattttctttggtctcatcctcatcactcctccaagaaaactacccagtccagagggacttgcttttgctataagtgggttagatcttgagataaggaaatagcaaaatgttggtgtaacattgagtgtggaaatgtggcctgagggaagtgagtgctggcaggagctgaggaccctgttgggagggggccgtgaaaccttggcatagacctcgccagcacagctgtttggaatggaggcaggaagggcaggggaaagccatgagagagggaattttcaagatggtcagtgttctcaatccacagccatcacagaagaaactaatgaaatatgggtacaatctggagatttttaagtctctaagaagtggaatttgtgagacgaaaggcttccagaaagctccctttctgacctggcctctacccctagagggccttagccttgctgtggggaatgaaactcttcccggttgtagggttttggtgctgtccacccccagcccagccagaaatgtggcttctgtacttctgctgcagttcaagccacttttccaggtatgtcccatctgagtggagatggggctgacggcaggccacagggccaagctcgggcacggggccggtagctgggactgaggctgcactgctgattaatgggcagggaggcactttgtgaaacgtgcaataccctttgacggccttttccgggggactcgcagctttcctcgtgtcttttcagcaatatcacatttgattttacctttaaaatgtattgatgaagctgcatgattggaaaaggtgctgggggagatgaatctctcctactttccgttctgtttccattacttcaggggtgtgtacgcatgagtatacacgtgtgcgggcgtgctgtattagagagcccaatttcctttatatacgtgaactcctccccctagtagccaccattaaacatccaacggctttaaaatggttagtgagaagtacacaacataatgtcagatgtggccctgagagaggcgtactgctcactgccctgctttaacccgttggctgtttaatggtggttactaggggcaggagttcacgtatataacagtcatttttccaaagtttccagcaccaagggtcctcctgctccttaccacactgcggagccttctacatctcttcatactgcttttcttccttgattattttttgtttcaagtatttcttcctccccctttctcctggtgtctcagagttagcaggaagctggtaattaaaagaagacatgggttttgaaatgctgctgtggtagctcttccccccccttatccattttacaacagaaacaaaaagactcactccttttcttttgctcctccctcnagcagagtaatgaaagcngaatgttgtttgcttgtttttgtttttgagtccactaaatcattattgttacactgactagctgggtgaacttgggcaagttagttcaaatttctgggcctccttttcctcatctgtaaattagaaaaagtaatgcctagttcatagagttgtgagaaagtgcacaaggtaagtctaagtgccttccccatcgtaggtatgaaatgcgtgtttccttccacctctcattttacttgggtctgtagacctaataagtgttccttttcattggatttcagtttaatttaatatgttttaagcacctagtatgtgccaggtcttgagcnccagggtctncacaaataccagataggttttctctcttcaagagcagcctggtgctgaaaccaggaatgtgataaacggtcgcacaacagtgtgaaaggtgtcatgggcactgagggaatctggaagaggagcacctaggattccttggggacagggtgggagggtagaagaatgtgtccctaaggagatgacaactggtcaagagcgttaaagggtgttggcgatgggagaagggtgttctgggaagagaggagcatgtgtatggaaatcgttgtgtgttccatgggagagaaggagcgtcggccaccgatgggggatgaggttgagtgcctgagaagagtctagatcaggaacagcatcgtatgttacagtggagacttggtttgaaaactactgaaagccattaatggagtttaggagcatcatgagatgataaagattttacctgcagcacatcaagccagctctaagaaatcctgtgtacacaaattgcctctttcgaatcaatgtgaagtcagagagcccacaggccagcagtccagttctgccactaattagttttgccgcattagggaagtcncttactttccgatggtctgagttgccacatctccgaaattaaagtgttggagtaggtgacacccatgtttcctcccagctataacagcagcctatgactctgtgatgatgtcactgctttttggcgcttgtttcataattcctagagttaacttattaaaattgctgtgcaagcatgatgactgtcccctagtaaacatcaagtgttcttcttcatatgttccatatgaaaattagcttcttgggccaggcgcagtggctcatgcctataatcccagcaatttgggaggccaaggcaggcggatcacgaggtcaggagatcgagaccatcctggctaactactaaaaatacaaaaaattagccgggcgtggtggcgggcatctgtagtcccagctactcaggaggctgaggctggagaatggcgtgaccccaggaggtggagcttgcagtgagccgagatcgcgccactgcgctccagcctgggggaacaaagcgagactccatctc

SEQ ID NO: 236847 - DNA, 575 bp, Homo sapiens
attgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattg

SEQ ID NO: 236848 - DNA, 354 bp, Homo sapiens
ttgttttgcccagctttatgtttcattttagttgtaaagagagaatttcactgatgactgggtgtgtaaaattggcctttgttaattaaaaatagaattttgagcttcctcaccagaggctattgctgctagaaaggatctcacttactatttcatgttatcattttaccatctcagctgtagtcaagaagtcaggcttgcaactttttggttgccgtacatgttgtctcctaagcttctgaataaccattagattagtgcaaacttcttaaaaggaaaaaggacttttttcagggtagtgaactgcaatcgaggaagataagtagtgagcttcagccagatttagggaaaggg

SEQ ID NO: 236849 - DNA, 695 bp, Homo sapiens
  misc_feature (676)..(676): n is a, c, g, or t
agatacctgctttcatcttttgcaatgaatagaatactctcctacttagaaacaggctttttctccttgccactttattttttccttacctatgaattgcatgtgcctttgatgaaaacaatgaactggacatgtacaacggtacatgtaatagactgaatgcaacttagaagtggccactcttccagtgtacataggcttggaaatgaactaatccaaacctgagtaatttgtttatagtacctcctttcacttttgtttattggtatctacagtctctcattctttttctttaataatatctctttatatagaattttatattcagccatgactctattatttcaatagtcacattaccacttcgaggattgataccatgaaaaaaggttatctagtagttttgagtgaagatacgaggcacaccttcaataccaataagaaggtatactacaaaggtctaatgaagaaaaatacctcattttgaaggtagcacatagctttcaactgactgggcctgttatggtctttgctgtgtttgttatcacagtatctaatagtgaagtggtaattactttctttagtagaaattccaagatctaaattggtacacatataaatatttgacaacaaatgttatttaagctaaatctcatatgtcaagttctgaatcagntgcctaacaccagttcata

SEQ ID NO: 236850 - DNA, 166 bp, Homo sapiens
gttacagctgctaatgttaccttaactaacatgaggttgtaaatcagtgtgtggtgagatcaatttagtgggttaggaccagcatttttagatagaataaaataggaaacctggtttgtgtctgaccacttcatgcagacctggggctccatccagtaaattaaac

SEQ ID NO: 236851 - DNA, 712 bp, Homo sapiens
  misc_feature (600)..(600): n is a, c, g, or t
  misc_feature (609)..(609): n is a, c, g, or t
  misc_feature (633)..(633): n is a, c, g, or t
  misc_feature (658)..(658): n is a, c, g, or t
  misc_feature (664)..(664): n is a, c, g, or t
  misc_feature (676)..(676): n is a, c, g, or t
  misc_feature (690)..(690): n is a, c, g, or t
agatgatgtgactctcttggatgggccttccccggaatgggtattgtgacatattgctgagcccattatataggtgatgtgactctcttgcatgggccctccacataaggggtagtgtgacatattgctgagcccagtaggtgatgtgactcttctctatggtttgggctttgcccaagcagggattgtgatgtgttgctggactcaccacctatgtgttgtgactctcctcttctgcctaagccctgcatgcattgtgtgttgtgacatgcctggattcaacacctaggtgatacaactttatggcaggggaaccacccacagaagtattgtatcatctttccatcacttaggtgatgtgattcttttatttttcctgtttctggcatattttgggtatagtgacataccattgagttcaacacccatgaaatcggaggcttacgcctgtaatcctagcacttgggaaggctgacgtgggtggatcatgaggtcaggagtttaagaccagcctgaccaacatagtgaaaccctgtctctactaaaaatacaaaaattagcttggtgtggtggcacgcacctataatcccaactactcangagactgangcaggagaatcgcttgaacttggnaggcgagtttacagtgagccaagantgcgcnactgcactctancctgggcgacagancaagactgtctcaaaaaaaaaa

SEQ ID NO: 236852 - DNA, 658 bp, Homo sapiens
  misc_feature (555)..(555): n is a, c, g, or t
  misc_feature (579)..(579): n is a, c, g, or t
  misc_feature (604)..(604): n is a, c, g, or t
  misc_feature (610)..(610): n is a, c, g, or t
  misc_feature (622)..(622): n is a, c, g, or t
  misc_feature (636)..(636): n is a, c, g, or t
agatgatgtgactctcttggatgggccttccccggaatgggtattgtgacatattgctgagcccattatataggtgatgtgactctcttgcatgggccctccacataaggggtagtgtgacatattgctgagcccagtaggtgatgtgactcttctctatggtttgggctttgcccaagcagggattgtgatgtgttgctggactcaccacctatgtgttgtgactctcctcttctgcctaagccctgcatgcattgtgtgttgtgacatgcctggattcaacacctaggtgatacaactttatggcaggggaaccacccacagaagtattgtatcatctttccatcacttaggtgatgtgattcttttatttttcctgtttctggcatattttgggtatagtgacataccattgagttcaacacccatgaaatcggaggcttacgcctgtaatcctagcacttgggaaggctgacgtgggtggatcatgaggtcaggagtttaagaccagcctgaccaacatagtgaaaccctgtctctactaaaaatacagangcaggagaatcgcttgaacttggnaggcgagtttacagtgagccaagantgcgcnactgcactctancctgggcgacagancaagactgtctcaaaaaaaaaa

SEQ ID NO: 236853 - DNA, 241 bp, Homo sapiens
tcctccgcgccgtccccatgctcgccctccgcgtcgctctcgtccgagttgtcctcctccaagtagcggtaaccgcgcaccttgtgctggggccgcgggatgcagggctggcgcggggccacgccccgccgcagcttctgctgcatccgcaggtaggagaccgcggcggccaccagcgtcacaagcagcaccgccagcttagcctgggtgtacggagagggatgccagggacccgcggccg

SEQ ID NO: 236854 - DNA, 280 bp, Homo sapiens
aacattttcatgaacatgatctcatttaaccatcaacaaagttcttaggaggcagcacagacagtattaatcttatttcccaatgctggtaaaggacttaaacatataatggaagatgggcatgctaaatacgcaaattaaaagtctgactacactaatggtctaaaaattatctttgaagaaaccttggccttgagtgtgacccctctccagtgaccaccactccattgagacccaaacttccccttccctgctgtatctcccctccgtgtaaaggaaa

SEQ ID NO: 236855 - DNA, 729 bp, Homo sapiens
  misc_feature (579)..(579): n is a, c, g, or t
  misc_feature (697)..(697): n is a, c, g, or t
  misc_feature (710)..(710): n is a, c, g, or t
  misc_feature (729)..(729): n is a, c, g, or t
caaatgacttattatcatcaagccattgtgtttgcttatgtccatgaagtgagtgtgtcattggtgtttgttttaatgtatatacaataccatagaaatgcatgaaagacattcaaagctcgtgccatgctgatcttgggcatttttatcttaggcatcttcaggtgccagtctgggcctcgaacatccacatctggggcattaatatccactttggggcctttaatatccaagtcaggaacttgcatgtcaccttccacttttggcagagacacatccatatcacccttcactttgggtcctttcaggttaagatcaatgtcaggcatggagatcttgggggctttgatgttcatctcaggcatcttgaatttgggacctttcaactttccctctgggccttcaatattcacatctggaacatcaatgtccaccttgggtcctgagacatcaaggtcagccttgggcaagttcacatccacatctgggccctctactttgaagccaggcatgctgaacttgggcattttcaccttgggcatcttcaggtgccagtctgggccttgaacatcaacatcntgagcattaatgtccactttggggccctagatgtcaacttcatgactcttgaggtcaccctactgccgaatttcgcacgaggtataaaccactctacaggtgggaggaaagccaaccnttccaatacctantgatttaaggatgacagan

SEQ ID NO: 236856 - DNA, 178 bp, Homo sapiens
ggagcctggcacagtggcctcatttattatgctgctctgctgctcacaggggaagcccgtcccccaaagtcctcttcctcgtcctcgtgagtatcttgtccctggattgcttgtcagccttgtctgcccggagcactcagtagccggcaggctccccacctttcctggagtctgaggc

SEQ ID NO: 236857 - DNA, 282 bp, Homo sapiens
gttgcggtttctgccgctgttgactctcacgtggagataatggaacatcatttcagagtttcggaaatgggagagaaatctcccagcagcccagcagttgaagaggagctgcctcaaataccagcccaacgggaggcctgtctctggcttttatgttcaagctgggactcttggcctcagaagcctgcttctggtcttgaaagttggtcccttcccagcattatagcattaaaaaaattttttttttgccaccaataaaaccatgttcggggctaatactca

SEQ ID NO: 236858 - DNA, 87 bp, Homo sapiens
ccaaaaaaacactgtgttatttcaaaaatatcagaatgagattcttcagatcccttatttattttcccccacccccgccacacttag

SEQ ID NO: 236859 - DNA, 353 bp, Homo sapiens
agatggagttgctctgttgcccaggctggagtgcagtggcatgatctcggcccactgcaacccctgcctcctgggttcaagggattctcctgtctcagcctcccaagtagctggaactacaggtgtgtgccaccacgcccagctaatcttttttgtatttttgacagagacagggtttcactgtgttagccaggatggtcttgatctcctgacctcgtgatccacccgcctcgacctcccaaagtgctgggattacaggcgtgagccaccacacctggcctgctctttccttttgtccagtctctcagagaggctgcctggatcacagtgctaccaccccaatctgggtctct

SEQ ID NO: 236860 - DNA, 473 bp, Homo sapiens
ccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggtta

SEQ ID NO: 236861 - DNA, 470 bp, Homo sapiens
agatggggcctccaaggaagtaattaaaattaagtgaggtcataaggatggagtcctgaaccaataggattagtgtccttataggagacaccagagagcttgcccactctcatgggcacaagaagaggtcatggagcagtgagcacacagggagatagtaaccacctacaagccaagagaggaagcctcaaggctgggcacggtggctcacgcctgtaatcccaacactttgggaggccgaggtgggtggatcacttgaggtcaggagtttgagaccagcctgaccaacatggtgaaaacctgtctctactaaaaatataaaaattagccgggtatggtggcgcacctgtaatcccagctactcaggaagctgaggcacaagaatcacttcaacccaggaggcagatgttgcagtgagccgagatcacaccacggcactccagcctgggcgacggagtgaaactgtgtct

SEQ ID NO: 236862 - DNA, 364 bp, Homo sapiens
gcccaggccgctcctgtactctgggatgccttctcctgtctgcctgcccaaatcctcgctgaccttcaagttccagcgtcgggaagtgcctggccgcatttcttaaaggttttacaaggatagacatcatttcctccaaaagaacacagagggaatgttgagcgctccctttccctacttctccttctcatgattaagcaggcattgtggctgttgagattaaagccccatgcggagatgcagggcaccaggctagatggagcccaggtccccaggcagcggtgtggagaagactcatcatgttcacctggcccacctatccatttggacttttcaataagaaataaatcagttttgagaatgt

SEQ ID NO: 236863 - DNA, 433 bp, Homo sapiens
cagaatgactattattaaaaagaccaaaaaaaaaaaaaaaggatgttggcagggctatagagaaaatggaagtcttatacacagttgatggaaatgtaaattagttcagcccctgtggagatttctcaaagaacttagaacagaactaccatttgatccagcagttcctgtactgattatatacccaaagaaaaataagagccacagtagtaataagatgccctaggcagagggacataggtgttttcattggaatgtttgggcaaattgtaagggctgcagatacagtttgattcaggactcaaatagtataacaaggatcagtttttctgtttttgtttctttgcttcgtcatccccattctcaggccccatgtagatacaagatggctagttaccaatagctcaaagttctggattagagtctctttagt

SEQ ID NO: 236864 - DNA, 425 bp, Homo sapiens
ccgggctgtacgaaaaagacttattgatggaaatgtaaattagttcagcccctgtggagatttctcaaagaacttagaacagaactaccatttgatccagcagttcctgtactgattatatacccaaagaaaaataagagccacagtagtaataagatgccctaggcagagggacataggtgaaaattaggtggaagtttagaaataacacatcaatactttctgtattataaagttttcattggaatgtttgggcaaattgtaagggctgcagatacagtttgattcaggactcaaatagtataacaaggatcagtttttctgtttttgtttctttgcttcgtcatccccattctcaggccccatgtagatacaagatggctagttaccaatagctcaaagttctggattagagtctctttagt

SEQ ID NO: 236865 - DNA, 2336 bp, Homo sapiens
  misc_feature (1549)..(1549): n is a, c, g, or t
  misc_feature (1973)..(1973): n is a, c, g, or t
gttggcctactggtgaaggaaaatctcaagggaaaccttaaggaatggctacctacagtccaccttttaactgagacccacacggttgcatgaccttcatgagttggccatggctcttttccacgttcctttcatcccaggactccggctgaaggacctgccattctctgggagactgctatccttgtagcagaaggaaagggcgatggtggaatccataatggcttctaaagctgctgttttgaagtgcatgtttcacttcctgctcgcgtttcattagtgaaaataagtcacatggccaagcctgatagcagcggagtgggggtgattaattctctcacagggaggggtagaaatcagttaggtgcaagcaacaccctctaactgcgagccattggaggcttttgagtgggtaatgacataatctagtttgcatttgcggaagatcccatgcagaaacaaatgtcacactgcagctgcaaggacagtgaggagggagatggccatggtgccttggtccccagagtgacggcatgcggaggcgtcaatgcatctacctccagcacaccaggcatgatgtcaggtgcagcaggaggtacctggccctttgctacacagaccacatggtcttgctggggacaagacctagggaacagctcattttggtacagtgtggttggttcctggagagggagagggaatagcccacgggctaagcagcccactgcaggtacctaatgcaaccaggaaggtcagggaaggagatggccagccacgcggtggagtttgaacattatgtagcagttagccaggtgaagaggagatgctggggagacagggagaggccactcctggctgagggacctgtacctgcaaagactctcaggggaggaggacggctttctgtcactgtttctgtgtgtgagggaaatcagagggtaggcccggctgtcccctgcctttcctgtggggcctgactgcacgtaccccctctccccaaaccctccaggagttctgagtctctacctggatcttgattccactggcatgaaatctgtgaatctcacctcgagaatcctccctctgctgcagcaggatgggaccaacagttccctgcagtggcaagggagctgttcacacactgagcgagcagtcacagctgccctgagctccacattctcctcctcgggggactcccctggaattacctttgtcattttactttctcaacccctgtgtttcctctgatatcttacttatctctggtctttttgtccagacagctcttaagccttgggaggaaccttttcctctgatccctttttaggccattatcaagttcagggtgggagggtagagtcactgtctttccaggccttgctgcatcccttagagaccttcggagggggcactttgtgaccagtggggatgggggaaggatggcttggtgtgtctgtcctcacccactaccctctgcccacttctgcctgcccttcctctgtgtggcatatacagtactgcacccctgagcaggacattccccagtganagccccaggcccgacacttccaggctgtgtggccttgatcaagttagtttccctttcgtgattcagattcctctcaggctgcttgtgcaaactcaacataagaaagtctgcgaagctcttaacccagggcctgggccatgctagggggatcagtaagcagtttctgccacctctgttactgccgctttcacctttccttgtggaaaagagaagcagccagaaaagctgggttttagccccagctctgcctcttaactagctaagtaaatgtgggcagaatgcttgacttctctgaatctcattttttttttttttttttttgtcaaacaagatgaatgaacaagatcggtcttttttgatggggacttgaatggtgtgtggggggacagttctttgtgtgggacggtccacactaaatgccagntatccccacccattgttacaacccaaatgtcaccccccaccaagtatttctccatgtccctatgggttggtggtggaactgtccctgactgaggaccactgaactagcttaccctaaacttcactcctgctctggtgtcctgtgtgggtggaaaagtgaggacccagtggagcaggtagacaaagatcagttcaacagggccctctgctcctttgatattgggacagcttcacttcctctgaattagaagcttcttgacctccatatattgaggaaggaaggggtttctaacaaatgaagaaacaggctgggcacagtggctcatgcctgtaattcccctttgggaagcccagttccatctct

SEQ ID NO: 236866 - DNA, 799 bp, Homo sapiens
ctgctgtgtcccaccccggatccacccccggagctccatccctggctacagccgttccctcaccactggacagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacgttcagaaaggccccggcaccctcaatcccagccggggacagccttgggccccagccccgcattctccactcgagcctgccagagccaggcacccgacctccggagcacggagaggctttcacaggctgcgcccgaaggtagcccccccagtacccgggcagcctaggcaaagagatcccgaccccgaacagacagcttgtgtaccgagacatctcacacaaatggggattgccggcccaacaacgtgaaagatcagggccgcacagggtgcacgagcccaccggagaacaagtcaccaaagaaccacagcacacagaaatcaacaccacttcacaagaaaaccaagtccccccacgaaaaccgggaagagacccccccgggcagaagcccactgggccgaccggccccgactgggcaagcttggtcaggagcggtcccccacatcgacgcggtgccaaagtcgagcaccacccaacctgccagaagtccagcgacccaccggc

SEQ ID NO: 236867 - DNA, 2321 bp, Homo sapiens
  misc_feature (1640)..(1640): n is a, c, g, or t
aagtggagccctctggcagaggcagtgaagcagctgatttttcacaggcggcaccacgtttgttgaagtattgcaactgatagcattgggagcctggtgaacgagagcagcctcagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacttcagaaaggccccgccccccatcccgccgggaagccaggccccgccccgcatctccatcaccgcccagagcagcaccgactccgcgcacgagagcttcacggcggccgagggccccgcccggcgctgcagctccgccgacgggctggacggccccgccatgggtgcgcgcacactggagttggcgccggtgccgccccgggccagccccaagccccccacactcatcatcaagaccatccctggcagggaggagctgcggagcctggcgcggcagcggaagtggcggccgtccattggggtgcaggtggagacgatctcagattcggacaccgagaacaggagccggagggagttccactctattggcgtgcaggtggaagaggacaagaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatntacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgcaaaaa

SEQ ID NO: 236868 - DNA, 632 bp, Homo sapiens
gagaatcacaaagctatgttcttgagcaagaggggatggatttatttagcaagcggagggattggccttacgagtatggacagttcgcccaaaacagcaggtgggaaggcattatatctgggcgcatttgctgagagatgggtaaatgtggtgatggaagtctatcaaaatttgcctctgactgtttcagtttttccattgtagtaggaagcaaggtcattcttcagctgtgagtgaagatgagtggggacatatagggagtttgaagaaaaagggaaacagaatggcatatgggaaagagaaaaagtgaatggactggggaaatacagagattgctgaggagtatgaattgaaagttagatcaggtagcattgtggagtgtttttctctggccatgttcagtggcatgggcagtgctgactaggtggagaattagacttaactagggttgtaatcttgccaagtgagtacgaacaattgatgagggcagaggaagttggggtaaaaggaaaggagtgattgtaataactgattatagaatttacattgggcaaggaaggcagacagacatcatggggatgaaggacagaggggtgtagtgtagtataagagatcttgagtgagctggaaag

SEQ ID NO: 236869 - DNA, 127 bp, Homo sapiens
atgatgacattgtcaaatgacacatttttcagaatgtatccccatcattaagcaatgcacgactgtacttgaaaattttaatctattttcaaattttgcagtgatttcataccaacggtttagctca

SEQ ID NO: 236870 - DNA, 1414 bp, Homo sapiens
  misc_feature (3)..(3): n is a, c, g, or t
  misc_feature (6)..(7): n is a, c, g, or t
  misc_feature (127)..(127): n is a, c, g, or t
  misc_feature (297)..(297): n is a, c, g, or t
gcntannggtcttgctgtgttgcccaggctggtctcaaactcctaacctcaagcagtcttcctccctccgcctctgaaaatgttgagattacaggtgtgagccactcccccagccttaaaaaataanaataaaaaattacaaggtattatgtggcccattgaaagatgttggaaaacagttgtgcatgtgacccagctgtaaccagttataaaagtgtcaggatcattaagaaatgtactgtgtctggctttcccaagtttgggttcctgctgaaggaatgagatggaccttttctncctcccctcctcacctccctgcaagaaccaggattgtgcattttgacgggcaggctcttacctctgacaggccacagggggcatgcagagcctttctgcatgtgctttttgggcactcggataaagaccccctgtccaggcctttgtttaggatatttggcccatggagaaatgaggctggaatcacctgggagggatagaggcttcaactggaaggaggagtgacctgaactccaggttgtgggcctacgctttgttcccatgcagcacctcgttagtggtgactgaggcctggaagtcaggggccttggtgaccaagtgttgagtggacaggaggagctaagggaggtgaggggcatctctccagtactgacccctccccatgcccaaatcaatgccctctatcagctcagacacagccccacccagcagcagtgcgggtcaggaagggcaaatgcagtcggcacggatctgctccatagtctccacctcacttcgtctcgggttgaggggagtgagtccccacagcactgatatgatatcctgtcagctgagaacatccagcttgatttagacagataaggtgggacatctctagggcatggtgtgtggagcagtgccatccctctgtggcagcgagccaagcaataaaccagaatgtgcaaaacctgcgtcccagaatcaccattcctggaggaaaagcctatattgtcaagatgcccacaactaaattaacccaaacattccacccagcctcgaaaaaccagtagaactttgacattaatacactaaccctcagttctatacggaaatgtgtaagaatagccaaataatgtaacgtgcggtcattgagagagagaagcccgtcagaacaaatggaaccaagtccagaaacatgtttgtctaggcgcaagatgccagcatgtgtgtcagccagggaagcagaccaggaggagatattaagatttaaaacccagctctgtagctcaggcctataatttgagcgctttgggaggctgaggtgggagaatcacttgagcccaggagtttgaggcagcagtaagctatgatcgtgccactgcattccagcctggatgacagagcaagaccccatctc

SEQ ID NO: 236871 - DNA, 447 bp, Homo sapiens
gagaggttgagagacttgcccagagtaaagtggctgagcccagattcaaacccaagactatcagactccaaaccccacctcttctgcacacggcctgggaacatgtaactgcattcccctttcactaccggttttacccatcgtcccgtcacatgatttggtggttttgggtattgaggaggcagagaggataaggctgcagggggctggcaggatgaatcaagggcaggggaacaggtcttttcccacatgggaagatgatctggctacctcactgtctcctcaaccatattcttggctaataaaagcaggaacgttgctgcctcctttctgtgataccttataatgcctagaaagtaactgtaagataatttattacaaactggcaactttatcataaaaggccttggagcaataattgctttcattaaataaaacctataaaat

SEQ ID NO: 236872 - DNA, 2533 bp, Homo sapiens
  misc_feature (65)..(66): n is a, c, g, or t
  misc_feature (84)..(84): n is a, c, g, or t
  misc_feature (91)..(91): n is a, c, g, or t
  misc_feature (93)..(93): n is a, c, g, or t
  misc_feature (125)..(125): n is a, c, g, or t
  misc_feature (145)..(145): n is a, c, g, or t
  misc_feature (288)..(288): n is a, c, g, or t
  misc_feature (330)..(330): n is a, c, g, or t
  misc_feature (352)..(352): n is a, c, g, or t
  misc_feature (396)..(396): n is a, c, g, or t
  misc_feature (421)..(421): n is a, c, g, or t
  misc_feature (446)..(447): n is a, c, g, or t
  misc_feature (498)..(498): n is a, c, g, or t
  misc_feature (543)..(543): n is a, c, g, or t
  misc_feature (550)..(550): n is a, c, g, or t
  misc_feature (557)..(557): n is a, c, g, or t
  misc_feature (566)..(566): n is a, c, g, or t
  misc_feature (611)..(612): n is a, c, g, or t
  misc_feature (646)..(646): n is a, c, g, or t
  misc_feature (724)..(724): n is a, c, g, or t
  misc_feature (751)..(751): n is a, c, g, or t
  misc_feature (782)..(782): n is a, c, g, or t
  misc_feature (856)..(856): n is a, c, g, or t
  misc_feature (913)..(913): n is a, c, g, or t
  misc_feature (935)..(935): n is a, c, g, or t
  misc_feature (944)..(944): n is a, c, g, or t
  misc_feature (980)..(980): n is a, c, g, or t
  misc_feature (991)..(991): n is a, c, g, or t
  misc_feature (1010)..(1010): n is a, c, g, or t
  misc_feature (1146)..(1146): n is a, c, g, or t
  misc_feature (1207)..(1207): n is a, c, g, or t
  misc_feature (1232)..(1232): n is a, c, g, or t
  misc_feature (1272)..(1272): n is a, c, g, or t
  misc_feature (1306)..(1306): n is a, c, g, or t
  misc_feature (1315)..(1315): n is a, c, g, or t
  misc_feature (1327)..(1327): n is a, c, g, or t
  misc_feature (1346)..(1346): n is a, c, g, or t
  misc_feature (1355)..(1355): n is a, c, g, or t
  misc_feature (1378)..(1379): n is a, c, g, or t
  misc_feature (1446)..(1447): n is a, c, g, or t
  misc_feature (1451)..(1451): n is a, c, g, or t
  misc_feature (1455)..(1455): n is a, c, g, or t
  misc_feature (1459)..(1459): n is a, c, g, or t
  misc_feature (1498)..(1498): n is a, c, g, or t
  misc_feature (1528)..(1528): n is a, c, g, or t
  misc_feature (1553)..(1553): n is a, c, g, or t
  misc_feature (1560)..(1560): n is a, c, g, or t
  misc_feature (1571)..(1571): n is a, c, g, or t
  misc_feature (1620)..(1621): n is a, c, g, or t
  misc_feature (1632)..(1632): n is a, c, g, or t
  misc_feature (1661)..(1661): n is a, c, g, or t
  misc_feature (1684)..(1684): n is a, c, g, or t
  misc_feature (1692)..(1692): n is a, c, g, or t
  misc_feature (1694)..(1694): n is a, c, g, or t
  misc_feature (1701)..(1701): n is a, c, g, or t
  misc_feature (1714)..(1714): n is a, c, g, or t
  misc_feature (1728)..(1728): n is a, c, g, or t
  misc_feature (1750)..(1751): n is a, c, g, or t
  misc_feature (1759)..(1759): n is a, c, g, or t
  misc_feature (1768)..(1768): n is a, c, g, or t
  misc_feature (1790)..(1790): n is a, c, g, or t
  misc_feature (1807)..(1807): n is a, c, g, or t
  misc_feature (1810)..(1810): n is a, c, g, or t
  misc_feature (1834)..(1834): n is a, c, g, or t
  misc_feature (1852)..(1852): n is a, c, g, or t
  misc_feature (1885)..(1885): n is a, c, g, or t
  misc_feature (1934)..(1934): n is a, c, g, or t
  misc_feature (1943)..(1943): n is a, c, g, or t
  misc_feature (1966)..(1966): n is a, c, g, or t
  misc_feature (1970)..(1970): n is a, c, g, or t
  misc_feature (1981)..(1981): n is a, c, g, or t
  misc_feature (1996)..(1996): n is a, c, g, or t
  misc_feature (2004)..(2004): n is a, c, g, or t
  misc_feature (2040)..(2040): n is a, c, g, or t
  misc_feature (2066)..(2066): n is a, c, g, or t
  misc_feature (2080)..(2080): n is a, c, g, or t
  misc_feature (2083)..(2083): n is a, c, g, or t
  misc_feature (2124)..(2124): n is a, c, g, or t
  misc_feature (2130)..(2130): n is a, c, g, or t
  misc_feature (2144)..(2144): n is a, c, g, or t
  misc_feature (2157)..(2157): n is a, c, g, or t
  misc_feature (2162)..(2162): n is a, c, g, or t
  misc_feature (2185)..(2185): n is a, c, g, or t
  misc_feature (2230)..(2230): n is a, c, g, or t
  misc_feature (2242)..(2242): n is a, c, g, or t
  misc_feature (2267)..(2267): n is a, c, g, or t
  misc_feature (2286)..(2286): n is a, c, g, or t
  misc_feature (2335)..(2335): n is a, c, g, or t
  misc_feature (2343)..(2343): n is a, c, g, or t
  misc_feature (2363)..(2363): n is a, c, g, or t
  misc_feature (2377)..(2377): n is a, c, g, or t
  misc_feature (2385)..(2385): n is a, c, g, or t
  misc_feature (2397)..(2397): n is a, c, g, or t
  misc_feature (2415)..(2415): n is a, c, g, or t
  misc_feature (2426)..(2426): n is a, c, g, or t
  misc_feature (2436)..(2436): n is a, c, g, or t
  misc_feature (2444)..(2444): n is a, c, g, or t
  misc_feature (2450)..(2450): n is a, c, g, or t
  misc_feature (2468)..(2468): n is a, c, g, or t
  misc_feature (2470)..(2471): n is a, c, g, or t
  misc_feature (2495)..(2496): n is a, c, g, or t
  misc_feature (2528)..(2529): n is a, c, g, or t
  misc_feature (2532)..(2532): n is a, c, g, or t
tggacagaaagagcaggcctgcaaaaacttaagacagtcaagttaccaaagacagtacaaagtgnnttttatacttaaagaaanaaaggantngaaataacttgagcatgaaaataaccaaatanattggggaaagtaccaagtngaaacgaaatgaaaagtatcataattgaaatggaaagttcaatggattggtttaactaacggtcatcaaaaagagaataatagatgaagaaataaagaagttttcagactcgaaaaagctgaatgactttactacctgcaganctgcactataagaaaagttaagggatgtccttcaggcataangaaaacgatactaatggcagcngtgtgccatctggagcagccactgttatcacgccagctgcagtntggaggcacaagtggtggtggcagnagtggctgtgggagcagcagtggtnntggtgggtcccctgtgccctacatccctgaggcagctgactgcacaccccnacccttgcacaactgggcaggacccactgcaggcccggaacctcngccgtgncttcaanctcgctgtntgctgcgtctcaggagtctgtgagctgatagtgcagccaggactnntggggtggccccaggagcattgggtttgtttgcncggggttggctgaggccaccagccacccgcaccttgcctgctgccactaaggggaaaatgcagaccagtggtatggcnagggctgcatgctttatggagccaganagttggtagagtgggagcttcccaggtgcanctgcagccacccaagctgtggctgctaccagggcactcctgtgctcttgggagccaagagtaggcaggagcccngccctcccaagtgcagctgcagccacccaagctgcagctgtggacccaggaatctcngtactcttgggggcccaggaangcacccctntccctgcaggctaggaagtgcctgctcccactgtcngtgttctcctnactgttagcatctgctccngtcacagttcacaacctggggcactgtctctctctcagcactttcgcatcccagctgcatgtgtgcatgcttggagtagtgctgacatgccagccccttggccccctttggactgtggaggctgacaagcatgggnaggaggctgaagtggggctgaggacagcttggcactggcctgcaggtactccttggcatgnataacgtgggtgccatgaacaatgncaggaggcaaacaggctcttgggtggaagggagcaggttnccaatgaagccccacctgcaagctggggtggggntgaagcctngggggtgggccnccagtcttcagggaggagntaccctctntgctgagagctgaagagacaacnngatgacctgcctgcagagaggagctgccctctctgctgagagctcagtactcaacaggacaccctgnnttgnagangagntacccactgcgggtctcctctgagctgtcttatctctcngtaaagctcctcttcatcttgttcaccttncacttgtctgcatatatcattcttnctggtcncaggacaaganctggagacctgctgaatggcggagctaaaatagctataacacaaacagnnctgaaacatgncccttgtttgtcacattgcaagcaatganaagagagaagagaagagctgtgnctcttcangnagcccanacctaggaactcngagccagggctgtnacaccctctttagggctctgtnngttcctgncatctccanggttctgggcaccaccacattncctggtgtcagccgtgnaanctgcttatggtatgcctggtctanctgcagccttgcatgganctggcacccgtgccagtgcctgaagctgcctgnccatcgcctatcccccctcagccggcatgcctggctgtgtgcagtggcnggaccccangcttgctcacacaccccttgctnctcngtgcctggctnacccttggcagacangcgatccnggctcatagtgggaactgagcacagcctgccaggcngagtgggtggaacaagaccagagatncagagcaaaactcnggnaaaggcgccactggccatagaggcttttggctgatgaagtnataccncaaggatcccgtancaataccagatgnaaatntggatccacacaaagaaatggtntacaccagaaatagtaacatcgtgtatctataccagaaatagtancaacatggatanatactttatattatttaaacttctntaaaagataattgtttagnaaataaagtaatatgcagtttataatatatgtaaaagtaaaatggatgncaataagngcttaaagactaaaaggggngaagtttactattntcagattnttaaactgtacntgatgtgatctactgtcncctgaaggtcngccgtgatcngttaaagntgtacnctgtaaaccctggagccncnnctaagataacaaaccaaaagattnnagctattaaactaacaaaggagatcaaatggnntcnt

SEQ ID NO: 236873 - DNA, 2367 bp, Homo sapiens
  misc_feature (271)..(271): n is a, c, g, or t
  misc_feature (277)..(277): n is a, c, g, or t
  misc_feature (465)..(465): n is a, c, g, or t
  misc_feature (1482)..(1482): n is a, c, g, or t
  misc_feature (2243)..(2243): n is a, c, g, or t
tgagatggagtctctgtcactcaggctggagtgcaatggcgcgatctcagctcaccacaatctccgcctcctgggttcaagcaattctccggcctcagcctcccgagtagctgggattacaggcgcatgccaccacacccagctaatttttgtttttcgagtagagatggggtttcaccatgttggccaggctggtcttgaactcctgatgtaatccacccacctcggcctcccaaagtgcagggattataggcgtgagccactgcgtccngctcangtgaatgttcttaatgggatcatgggatctagaatggtgaatccttttcagaaggtggactttgcccagatccatcaaaggaatcactatttatggcagtgttgccttatgaaatgtgtttcttaggtaataacacttgaaagtctgaattactcctggatacatggactgcagaatggatgttgtgntagcaggcatgaaaacaacattaatcttgtacatctccatcagagcttttggatgactaggtgccttgtcaatgagcagtaatattttgagaagaatctttttttgcaagcagtaggtctcaatggtgggcttaaaaatattcagtaaactatgctgtaaacagatgtgctgtcatccaagctttgttccatttatagagcacaggtagaatacagttagcatgattcctaaggcctgtaggattttcagaatagtaaataagcattggcttcaatttaaaaagttactagctgcatttgtctctaacaagggtcagcctgtcctgtggagctttgaagccagccattgacttctctctagctatagaagtcctagatggcatctttttccaacataaggctgttttgtctatagtagccaccttcatcaaggtgggctaggtcttctagatgacttgctgcagcttctccgtcagcacttgctgcttgcttcatcttgcacatttatgttatggaggtggctactttccttaaaccttgttaaccagtctctgccagcttctaacttttctctgtagcttcctcgcctctctcagccctgttgaattgaagagagttagggtcttgctctggattaggttttggtttaagggaatattgtggctggtttgatcttctgtctagaccactcaaacttctttctttccctttttttttttttgagacaaggtttcgctctgtcacccagcatggaatgcagtggcatgattatggcttactgtagcctcagcctcccaacctcaagcagtccccccacctcaacccccccaggttgctgggattgcaggcatatgccaccatccctggctaatttttattttattttttgtagagacaggatcagcgtatgttgaccatgctggtctcgaattcctggcctcaagcagttgtcccgccttggcctcccaaagcactaggtttacaggcatgagccactacaccctgccaaaactttcnctatatcagcaataggctgtttcactttattttatttatttatttttacattttactttaagttctgggatacatgtgcagaacgtgcagatttgttatataggtatacatgtgccattgatggtttgctgcacctatcgacctgtcatctaggttttaagccccacatgcattaggtatttgtcctaatgctctccctttccttgctccccacctcctgacaggcccctttgtgtgatgttcccctccctgtgtccatatgttctcattgttcaactcccacttttgagtgagaacatgcagtgtttggttttctgttcctgtgttagtttgctgagaatgatggcttccagcttcatccatgtccctgcaaaggacatgaactcactcttttttatggctgcaggctgtttcactttatcactcgtgttcactggagtagcacttttaatttctttcaagaacttttccttcgctttaacaatgtggctgtttggcacaagaggcccagctttcagcccctcttggcttttgacatgctttcttcactaggcttaatcatttttagcttttgattgaaagcgagggacatgtgactcctcctttcacttgagcacttagaggccattgtgggattattaattggcctaatttcttttttttttgaaacagagtctcgctctgttgcccaggttggagtgtagtggcacgatctcggctcactgcaacctccgcctccgaggttcaagcgatcctcctgncttaatcccagctactcaggaggctgaggcaggagaatcgcttgatgaaaccaagaggcggatgttgcagtgagctgagatcacgccattgcgctccagcctgggtagcgagtaaaactgtctc

SEQ ID NO: 236874 - DNA, 419 bp, Homo sapiens
agctggcaaggacttgagaaaatgggacagtagcgtcgttttgcagataggaaggctgaggctcagaggttgcaggtcctggaacatagagctgcattcgggcttccctccctccagcaggggtgcctggggctgacggtgacctgcaggtggaaagtggcttccgcagcaacctaggggacacgtctgcagattcaggaggccctgggaccacctcgcaggttctaggtggagataaaggggatgtggggtgatgggcccacatgaggccttggggagggcctcattacagcagggaagggggctatagtgtctctggcggtgagaagtgggcagtggcggagcctggctgcagagaagttaaccaggaagggaaaaagagtaagagggagggaaaaaatcctaacaaagaagtatag

SEQ ID NO: 236875 - DNA, 429 bp, Homo sapiens
cgggcatagcccggggaagctgcagcctcttcctgattgagagatttttagttcctaatccccagctcactaattatgattattttcattattgtacatttattgagcacctctctattgacaagtttcagtctgattttattagcccatcagtggggaaagggattgaggccagggtggtgggcagagtcccaggctgggaggcagggatagataccttggctccattcctagacccctcactgtgcctccgccctgttgtgcagagtagacctcaggccagagtctgtgctggggtcaggacagcttccagatttaaaaacaagtaggtgatacatatgttaaataacttaatttagctattccacaatgtatatgtgtatcaaaacatcatgttatataccacaaatatatgcagtttcacttgtc

SEQ ID NO: 236876 - DNA, 1928 bp, Homo sapiens
  misc_feature (674)..(674): n is a, c, g, or t
  misc_feature (722)..(722): n is a, c, g, or t
  misc_feature (1162)..(1162): n is a, c, g, or t
aatactatgtaagtgatgatgtactcttctcagtgtattggcttggagatacaggatgtcagtttgtcatgttattttattagaaatgataattctaatgccttagttgtgatggtgtcctttgggtttctgcactgcaaagttgctattttttcctttgtatttaataagtaatttgtggaaaggctaaatatcctgttcctcttcaaactttttagggattttagtgccagtgataattttttctttagtcagttattactgtaatggctgcaaaatagtgattatgtaactcttatttctcttaacatttattagttggcattctactttaaaaatgagctttcccactccgccacttatcacttagactcataaattcttattttatgtgtgagaaagtgtgtatgtgtgacttacaaatgtagcttatttgtatacatggtgtttaaaccgtatgtatgatttatatatactgtaattcattttgatgtgaacatcagattgttcctcttcaaacttgctctgtgacctttgatatgtctccatcatgtttttttttttagggtgtttttatagtttggcattaccaggatgttccaggcttatcttgtagtttccctgtttcttccttagaagcagccattttcaaaggcactctgattccttttagnggggaatggtaattaaaaaacaagatcagggtgctagctgtgctcctnatactagggcatccttatttccaggccttttcagcactcagagctaggaaagaattagcattttcaagatgaaatttccatgtgtgttttttaaaatacattttagtcatgaaatcatcatgtttcttttacttccatttgaacatcacaggattcttattcctatttctctttccctattccatattgcatctccttttttttccacaatgagaacgtggctcccagaatcttgaaatacacatataacagattcagaacttttactgttataagaaaacctattcagtagtttaggatttgtttacagttttttctttgtctctttttaggctaagggtatataattcagatattgggttcagaagtttcctacagagttgttatattaagaatttaaaatatataatttggtttattgtgtctgtttgtatgcagtnttagcatttatttttccttccatgttcactgatttattttttgcatatgtaaaacatctaacagttcgaaaggcaagagtatccaaaggtatatagaaacttgtcacatctttctctgtttctttcattcctgtcagaacagatttcatttcgtttctggtttgtttttcctgtgtttctttttacataaacaagcagatgcataaacatgtatatatatcctgttgctttgaaagagcatcttattagttctgtaaagtattggcaatattgcaaatatctgaactttttatgaagtatgtcaacagggataaaattaacttttttgggaactttactttgaaagagttattttgaaagggattttttataaaatagtataggtttttatgaaacacgtcagagtgttgctgttaactggttgcactaacaatacttatatccattgttgaagaatatagggaaagaaataccaaaatttttagtaagattttgtaaaattgcaaaaattaatattaagaattcatagaggcacagaaatgtattttttgattaatgtattgtaacctgatgtaaatccttagttcttttctcatttctgcattgacatcatactatgttgaagaatatttctaaaaatattctagagttaagaaagtgttgatagcacatctatatttaaatacttagtaccacagcaagtagtttatatgacttgagaatgatactgtaggaacatactaaaagactttagaaaaagcatgtc

SEQ ID NO: 236877 - DNA, 292 bp, Homo sapiens
caaaaaggtatttccatcctccaaggacctgtctagacatgaaggctgactgtgagaggagagatttagaggagatgggtcaccatgggggtcagacccacagatggggatggggaagaagaggtgataatccttagcaacctacgtacaaccacagaagctggtgctggctaagtcaggcagaaaagaaacttagtgagaggatcgctgagtccaggaggtcaagccatgttcatgccactgcactccaacctgggtgacagagaaagaccttgtctcaaaaaaataaata

SEQ ID NO: 236878 - DNA, 899 bp, Homo sapiens
cggggtgcacgtgcaacggagacaccgcccctaaacctggggccctgaggctaacagctaacagtggccctgccgttacggccagtgtcaggtgccagctgggctggaccaggaattcccagaaacctggcaaggcatgatttggggtgggtcgtgctgagggccacaccatccgcttccccgcttctgaggccttccgacctgggctgagcccggctacccgagtcccggggtctccggctcacagacttctcggcctccgtaattgcaaacgccagctcccccagtccatctcctgtcctggatctacgtctatatcctactggatccgtctctctggagaaccctaatacagctgtcaacacaaggatgaactaactacaagaaggcctgaataggaactctcccaggggacgaagaggtttcagccttcagcaaaggatggttcatagaaaccgttcgcatagtcggccctccacggactgcaaccctagttaatattacctacagtaaacaaaaaattcaagtatagattttagtctaaagcaaataggaaatgtcgcttccctggacgttgggagaagcaaacacgaatcctctcctgaggccggaagcggtggctcacgcctgtaatcccagcactttgggaggctgaggcgggcggatcattttataactatctattaaatgtttaagttttcagtccatttttcctgtctacatggaattgccgactgcacaaagaacacatgagggctctctcaaggccatcatttccgcggagtcccatttcctgactcaaatgacaagctctcaactttctactcaagatcattgaaacatctgtgttgattatttgtaaccgggatatgctttatttattagataagagactaacc

SEQ ID NO: 236879 - DNA, 430 bp, Homo sapiens
caaagcaaaggggtgatactcttcctaccctccctcctggcatactctccactcttcttccataacatcttctatgggtttttaccttcctttttagactattagctcctagaagcataaatgatgtcttaatcattttaaatatttctttgcccaacttacattaaaaatacttggtacattaatgtgtttagtaaatgctggatgaattaataatagacaccccttaccactatacgaatggccttaatgttctttaaccttgttaaacttgtaaggaaatgctgattggtgtttgtagaaccataaaggcgtggcatagaatgggtcatctgcaagtctcagccaaatgattgtttcagtgctttgttggtggacaccgttattctttgtgtatggctggtcatactcaaaaggttaaaagtcttca

SEQ ID NO: 236880 - DNA, 688 bp, Homo sapiens
tggagtttcgctcttgttgcccaggctggagtgcaatggcgcggtctcggctcactgcaacctctgccttctgggttcaagcgattctcctgcctcagccacccaagtagctgggattacaggcgcctgccaccacgcctgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgaagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaaatttccctgtggcgaattccttgcagccccgggaatacactatgtctagaagcgggcggcaaccgcggggagctcccagacttttt

SEQ ID NO: 236881 - DNA, 203 bp, Homo sapiens
gtaactggatcagtcgtatccgaaacttcagcatcacacagtatacccatgtaagaagtctgcacatgtatcccctgaatctaaaatagaggttgaaattatttaaaaaaaataaaaataagcaaattacttatatatgcatcaacatagatgaatgcagaaactttatactaagtaaaataagacatgtacaaaacagataa

SEQ ID NO: 236882 - DNA, 349 bp, Homo sapiens
tcttttcccagagttatgaggaaataaaggggtgtagagctaccccacccaattaacaagcagtgggtctgcaaagataagcccataacaataagtccaccccctgtacatatttgtaagcatatgactggagatgtgcttacatgtgtacctgctatatttatactcacttatcaatctatgatcaacatatccagacttacctaccttccattctttcttccttttcttttttaactttttattatagaaaatttaaaacacagatgtagagagaatcatgtaaatgaactctcatgtccacatgaccagctttgtttaacagctgtgaacacatagccaatcttgc

SEQ ID NO: 236883 - DNA, 423 bp, Homo sapiens
acactagcacattttcccatgtttgtgcatacatgtgtgtttaaactacattctggatttaaaagcctgggctaactcaatcacaggtgcagccttgtttctatgaaaggagataaattcctatagagagtgagaaagggatgcggaagccatagcaaagagaagcctccctcccttccagtccctcctgttgttttcaaacattttttgttagcagttagcggaatcctaatacccacaactgataatatgctatcttaatactattactctagtttataagcttacttacaacctttgctcattatgaagagaacaatgaagcttatttttatgaatacaacatttaaaaattaggggccaaggatgatggctgcagtcctatatcagtcccaacagccaaagttatgtgtttggttgagt

SEQ ID NO: 236884 - DNA, 447 bp, Homo sapiens
aagtgctgggattacaggtgtgagccactgtgcccggccagaaagcatgatttttaatcaaacataggtttgcatactgatctttgagctataatcttttaagtgtagatatttcttactgttaacacatatcattgctaacaaaatggtaaccttctgtagaaatctccaaattttcatatcagtcagtagttaataaacattgtcaggtgctgtgctgagtatcagggcacaaatgaataagacccaacttatcatgatacaggaaaggaaccactgccataattactattacagtatgctaattacagtacctgtttttgctgttggaaatacttttggatttttttcaaggctgataaatatccctagggtgttctagctactcatcctctttttgttaattgtgtactataggccagtgatgaactggactctggagattaa

SEQ ID NO: 236885 - DNA, 356 bp, Homo sapiens
cgccagctaggcctgttttgtgccctctctgcttaagtgacagtcttgagatttcaaggtgagcagcggataaacggttaccattagcaactccttatcaatgtgacttttctctataccgtgtaacaaagcaaaatagagaaatcagttggatctgggtctgatgtcattggagccgccatctgtaacccccagtttaaaatgtttaccttcccaaagcagccattttgttctcattagcaacctttagagtaagaaaatattatggagtcaggtgttttattccttttctaggtttcacgcgttggggtttccacgttggatattttttaagggggaatttcactgatagtctt

SEQ ID NO: 236886 - DNA, 351 bp, Homo sapiens
aagaaagaggccagatttctttctttctctgtgtaaacttctgattttcaactttgctttctgcaagaggctctggtttatgaattactttctatttggaaaaaagtatttaaagatattagtatacaattgaaaatgcaggatatgcatcataattttacggtacaacttttattcattaaagctttattaataaaaatgactgtaaaacatttaaagttataatgtgtatagaaatgttaaatgatgtaattaattttaacaactgtatatatattgaaatattgaatgctcagagatttttaaggcaattttggcatggctttcagattgattaaaccattgaaatgc

SEQ ID NO: 236887 - DNA, 408 bp, Homo sapiens
tggggggtgatatggagagagaatgggcgatgtttctcagggctgcttcgagcgggattaggggcggcgtgggaacctagagtgggagagattaaaattttagtttcctgacttgggacatgttgaataaagctaatttgccagtcctgggtgggggcaaatcctcgagcttgatgtgtaaggaagggagggggcctgaataatccctgaggaatagtagaacagcagatggaacactgagaaattatttccttgaggatagatttccacgatggaaaggaaatgagaggttctgagaggcaggctagtggcttgtactatagcatagcctgcctttgctggtgtgtggcgattaggcctggtggaaccgccatcaataaatcaagcgtgatcggggtgaggaacagg

SEQ ID NO: 236888 - DNA, 466 bp, Homo sapiens
gctttgtatttccaaagcttacaacttgaggactttcctctttcttcttctccattttattttttaaccaggaagtcctgaagcaatcaaaatcattggttacttcctaccgtaaacaaccctttcatgaagtcatagcaggaaaagaaaaaaagccagcactcagttactcggagtttgtcctcccctgtttatcctgggctaggtaaacagaacattccagaagttcagatattggtagattaattcctatagtggtaactgaactgagttcccaatatcgagggtaatttctttcatcttaaggatagaaaagtgggaatttatgggtttttttggagacagcaggaattcccttttttgtcatgttctatgtaagggagggatggaccaaattcagcctgctacctgtttctgtatgacccaggtgttaagaataatgtttatatttttagatggtgagaaa

SEQ ID NO: 236889 - DNA, 1910 bp, Homo sapiens
aatgtatagtaaatttggtattaaaattgtctcaattatttgaaatttccatttctattgtttttactctgtcatcaatttctgtctggatatgcagttacctgtagctcagaatctgactaggttatcgttaaattcaaaacccacaagaggacattatgttaacaaacctggaaaatataaatggagttttaaaagaaatatataaactaccaaaatagacttgaggaattagaaaacctgaacaaagcaataaccaaggaaagcattgaacaatattattaaacaattcgctttatgaaaggttcctgtccctgataaatattgtattaggaatgtttgcttccaaggaatgactaaagggaaaagggatttataggaaacatagagggtaatctcatagaaaacctttgcagtaagtaaggctggacttcatgtaaactgtgaagtcattaaaaagcaaatcttgttcactgtatcttttaaggtttctatggctcttgttctctgcttttctccaaatacacgttttcttagcctgtatatagttgaataatagcgacccacccgaatttacccagcatttagctccagcacttactgacatcgaattatccacagctaaatgtctcttagttcaaacgcgcaaaacacattctcattggtcaccaaatgaccagtgtgtttcctctcctcaagtgcagtgtctgcttttggtctgatgagctgtgggtggataatcagggtatgtgattgattcatagtctgtgcagaggaggttgaacctgagtgtagtttgcactggtgaatttattgacatgtctgctatagctctattgatgagtctatcctgttttcaagaatgaccgtttccaaaatatgtatattggtattgagcacaaaaaaggctaacagcctgaaaaagaaaactccagtttttgaacataaatggctccagtacatgagcataaatattcattgtctcatatatatgattgtataaacaaatactataagatcatattcattcaacaacctaccacaggcaaatagtatttaacccaagaatgcagggtgattcaatactgggaaatctattaatataataaaattaatatgctattgatattgatcaaaaagtcaaatataccatctgatgctggaaaagcagctgataaaatttaacaattcctgatacgatatttcgtacacttggtttttgtacttttttgctatttccagtaaactgaacattttttcatttttataaccagacaatatatcaaagatgtttaaaacctcttaatgcagataataaatatttttatattccaagttcctaattcacgtaacgatctcttaataagtacttttaatgaagcattccattaaagtggtctggtttttgagaattattaagaaacagaatagagtttttctttgtcccacaggagaccttgtttcaggagtgtaccttttctgatgttcaatgtgaaggatcggcagtgccttttaggaatgaataattgcttttcttcagcaggtgcctttcaaaattgttctcttcacttactctaggaattgcctgtggctgtctgaactctgactcccttctctaagctgagtcaatgctctaatcatgacctttgtgcagctctcactgatggctgatcctccacctggatgttctatttcagactcagtatgttcctccctaagcctatttcaccctctgttcaaaacaatttacagcagggcatggtggctcatgcctgtaatatgagtactttgggaggctgagacaggaggatcatttgaggccaggagcttgaaaccagactgggcaacatagtgagaccctgtgtctaccaaaaaccttaaagcctgggtaacagagagagactctgtct

SEQ ID NO: 236890 - DNA, 1835 bp, Homo sapiens
tcatgaactgctgacctcaaatgatctgcccgccttggcctcccaaagtgctgggattacaggcatgagtcactgcacctggcctggagcttggattctaactcctgtgtgttttctccaaaaactgtatttcagccactattttcattgtgtcatgcatatatcattttggatcctgttattttattagtattttaccagaaatgttcatcctcattttctcaatgatcatattaaattttatttataatatcatccagtatacagtccctttcactaaataatagtctgagttcattccctaggatattttatatttactataaattatatgcacatgctttgtaaagttttcttttttgaatgttggaactaaaaaaagtcaataaatattctaaaaagtctaacttttttccccatgtcaatacactgcaggacttgtatattctttttcaaatattcataatgtgtcactctagtggtaaagtataaaatagcctattgccttgaggaacttcagatgggcacgcattttatacctaagccaggttagaagcttttaatcaagagaatatttgaaagttaaatcaagccaggcgtggtggctcacacttgtaatcccagcattttgagaggctgaggtgggtggatcatttgaggtcagcagttcatgaccagcctggccaacatggtgaaaccttgtcgctactaaaattacaaaaaaattagccaagtggtagtggtgcatgcctgtaatcccagctacttgggaggctgaggtaggagagtctcttgagcctgggaggtgaaggttgtggtgagccaagatcgtgccactgcacctgcactccagtctgggcaacagagtgagaccctttcccaagaaacaaaagaaaacaaaaaattaagtctttttcttcttcttcagagctatctaagaaatatttcgtaatagaactctagctgtttttatatttttaattatttaatttttaagcgatagtttgcttctgtttccctccttccccactttgcagtttctcaggtatagttgtttttcagagttgtataggttaaggtgttgggaactccataacccatggttcttgcctgtagttctaaaattctcacatttagcagtctgcactcatcaaacatctagttgaactagatgactgattaatcacctcgtgattcattgtgttttacttctcatctagtaaactcttaatgcagataataaatatttttatattccaagttcctaattcacgtaacgatctcttaataagtacttttaatgaagcattccattaaagtggtctggtttttgagaattattaagaaacagaatagagtttttctttgtcccacaggagaccttgtttcaggagtgtaccttttctgatgttcaatgtgaaggatcggcagtgccttttaggaatgaataattgcttttcttcagcaggtgcctttcaaaattgttctcttcacttactctaggaattgcctgtggctgtctgaactctgactcccttctctaagctgagtcaatgctctaatcatgacctttgtgcagctctcactgatggctgatcctccacctggatgttctatttcagactcagtatgttcctccctaagcctatttcaccctctgttcaaaacaatttacagcagggcatggtggctcatgcctgtaatatgagtactttgggaggctgagacaggaggatcatttgaggccaggagcttgaaaccagactgggcaacatagtgagaccctgtgtctaccaaaaaccttaaagcctgggtaacagagagagactctgtct

SEQ ID NO: 236891 - DNA, 2280 bp, Homo sapiens
aacacacattaattttatagacatggttgctgctaagtgttttacatgatgtttagagagcattcactttcctgttttaattgaacttggaagttttgtttatgtcaaaatttgcataagtttcttaatttttcctagcccttctaagatccacattgtctcaaaatccaagttaaaaatgaggtacgtgatgcatagtaatgtgtggccagcatgtgaatagttcggactttttgcatacattgagaaataaatagacatcccctgaacagtctcaactttcagcctaattcagcaatgctccttctaccctttgcttctgttgtgacgccaatgggtatatcagtgaaaaagatgaaaaattctttgccattatgggtttgtgcccctcgagaaatagttcagaggacccttgaagaaagaaatgaatggaatgtatcaggctaatgtgaaaatacaatattagtgattgttagaggacagtgttttgcctgtaacattttaagtgtaattttgtgtttgtgtgtatgctgggagaggacaaaatggtagactttggacttacaagctgattttcaacttcataaaaagttaatgttcttaccagctttgtgctaggcacacatggataagtaggctaaaccaggtctagttcccataatcaggagggttataatttaatgcacagaatgtatttttttccagtatacagtccctttcactaaataatagtctgagttcattccctaggatattttatatttactataaattatatgcacatgctttgtaaagttttcttttttgaatgttggaactaaaaaaagtcaataaatattctaaaaagtctaacttttttccccatgtcaatacactgcaggacttgtatattctttttcaaatattcataatgtgtcactctagtggtaaagtataaaatagcctattgccttgaggaacttcagatgggcacgcattttatacctaagccaggttagaagcttttaatcaagagaatatttgaaagttaaatcaagccaggcgtggtggctcacacttgtaatcccagcattttgagaggctgaggtgggtggatcatttgaggtcagcagttcatgaccagcctggccaacatggtgaaaccttgtcgctactaaaattacaaaaaaattagccaagtggtagtggtgcatgcctgtaatcccagctacttgggaggctgaggtaggagagtctcttgagcctgggaggtgaaggttgtggtgagccaagatcgtgccactgcacctgcactccagtctgggcaacagagtgagaccctttcccaagaaacaaaagaaaacaaaaaattaagtctttttcttcttcttcagagctatctaagaaatatttcgtaatagaactctagctgtttttatatttttaattatttaatttttaagcgatagtttgcttctgtttccctccttccccactttgcagtttctcaggtatagttgtttttcagagttgtataggttaaggtgttgggaactccataacccatggttcttgcctgtagttctaaaattctcacatttagcagtctgcactcatcaaacatctagttgaactagatgactgattaatcacctcgtgattcattgtgttttacttctcatctagtaaactcttaatgcagataataaatatttttatattccaagttcctaattcacgtaacgatctcttaataagtacttttaatgaagcattccattaaagtggtctggtttttgagaattattaagaaacagaatagagtttttctttgtcccacaggagaccttgtttcaggagtgtaccttttctgatgttcaatgtgaaggatcggcagtgccttttaggaatgaataattgcttttcttcagcaggtgcctttcaaaattgttctcttcacttactctaggaattgcctgtggctgtctgaactctgactcccttctctaagctgagtcaatgctctaatcatgacctttgtgcagctctcactgatggctgatcctccacctggatgttctatttcagactcagtatgttcctccctaagcctatttcaccctctgttcaaaacaatttacagcagggcatggtggctcatgcctgtaatatgagtactttgggaggctgagacaggaggatcatttgaggccaggagcttgaaaccagactgggcaacatagtgagaccctgtgtctaccaaaaaccttaaagcctgggtaacagagagagactctgtct

SEQ ID NO: 236892 - DNA, 626 bp, Homo sapiens
gataatggatatgttaattaccttgatttgatttctgtacattatatgtatcagaacattatctaccccatgaatatgtatgattattatttgttaattaaaaaaataaaattaaaaaaatcatacatgggccaggcatggtggctcatgtttgtaatccgcccacctcggcctcccaaagtgctggtattacaggcgtgagccaccatgcctggccattagtaaggtgttaaaaaataggttctctttgtaaaaattagttttgaactttatttttactttttttctttgcattctcacccagtctatttttggtcttattttgaagtttcgcacaccagtcaagatgtatatatatgtgggccatgggatatactttctgactttgttattctgtcatgttgacactctctcagtgggaatctgcattagtctgttttcacactgctgataaagacatacccgagactagaaagaaaaaaaggtttaattggacttacagttccacatggctagggaggcctcagaatcatggcaggaggcaaaaggcacttcttacatggcagcagcaagagaaaatgaggaagaagcaaaagcagaaacccctgataaacccatcagatctc

SEQ ID NO: 236893 - DNA, 552 bp, Homo sapiens
ctttgtattcacttggctgtttggcacagaaggcccagctttcagcctgtcgtaactgtcaacatgctttcctcactaagcttaatcatttttcttgctttcgacttaaaacaaaagatgtgtaacccttcctttcacttgaacacttagaggccattacaaggttattaagtggcctgtttcaatattgtttcttagagaataggaaggccagaggaaagggaaagagatagggaatggcaggtcaatgaagcagtcggaacacacacaacctttatagattgtttgccacgtgggcatggtttgtggtgccgaattacaaaagtgatatcagagatcactgatcacagatcaccataatagataatatcataatgaaaaagtttgaaataaatattgcaagaattaccaaaatgtgacagagatacaaagtgagcacactgttggaaacatgccagtagacttgcttgacccaaggttgtcacaaatgtgcgatttgtaaaaaacgagtatcttcaagtgcaataaaacaaagttcagtaaacagggtat

SEQ ID NO: 236894 - DNA, 945 bp, Homo sapiens
aatctattttaactttgatattgtgaatatcctcaagaatccccttaagtaggtcataaaaaggctcccaaatatagagaaacagcttagaaactgcttccatattcagattgttatacaaaaagcatgagcattatgggaagcactaacatttccctggctctcgatgtgattcagagaggaagtccctggcacttggtgatgctcagtacacaatgattcttctctttctccctggagctgttctttaacagaatggttcaacaagatagaatcctagaaggaaataccactggtttactgcatgagtaaaattaggaggcaattttaaaacatgacatatgcgaaaccaattaaagttaatatctgaagctgggctcatgcctgtaatcccaacactttgggaggccgaggtgggcagatcacctgaggtcgggagttcaagaccagcctggccaacatgctgaaacccatctctactaaaaatacaaaaaaaattagccagacgtggtagtgggcgcctgtaatcccagctatttgggaggctgagacaggagaatcccttgaatccaggaggtagaggttgcagtgagtcaagatcatgccattacactgcagcctgggtaacaagagggagactttgtctcaaaagaaaaaaaaagttaatatttggactcctggatatatggtcatacctggtttccacatcagactctaaaattcaacaaaacttaatacctgctgtaatactgaatgttgatgatgaaggctttatcccacataggcataaaaggccattgattacagccattatgaaacaataacatctgagtgtgaatacaacagagagcattgaaggagatcagttgatatagtgtatacaggaacttgttttctaaattaaaagataaggccaggcacagtggctcacgcctgtaatcccag

SEQ ID NO: 236895 - DNA, 616 bp, Homo sapiens
cggcacgaggcgtgcgccgcctttgcagtaaataagatgaggaaagcgaggcaccgcggggccaggtcacttgctcaggggcacgcagcaggggttctgcctgagaagccgtaagctcacgtccctaaagctccgcagcaggggctttggatccttgtgaatttcagctcctccaaggcttgaggaaagaattcaagaaaggtccagtggagcctcgtggaagcgcagagcagtgctccagcaggaggaccctcagagccctcggcaacaaggatgagactggaacaatagagacaggagggagttctaggggccgatttaagtcaactggaagctggatgttggtgggcgttttcgctttttttttttttaatgctagagcacagtggctaaaaaaggtgggctctggggccagcctgcctgggttccaatgcacttgctggctgtgtgcccttgtgcaagttacttaacctctctgtgtttcagcttccataactataagaaaaggaatattagcacgttttcccaacagagcccatggggggttcaatgagatatggaagcacccccacactgtcaggcacaggcaaatgctcaataaatgttcattattagt

SEQ ID NO: 236896 - DNA, 229 bp, Homo sapiens
gccacctgaagctctacaaggttccaaaggtgaatattaaggaaaatccctcatgctctggcagccagaggggaaaaggaacaattttgaaatatgccagaatatcgttcttaacaatgtctgccctcaggagaagatgtttaaccagagcctaatcttctggggttttctgagagcctcattgatctgggggaagggaaataccaactccagccccttctagccttcc

SEQ ID NO: 236897 - DNA, 392 bp, Homo sapiens
aaatgagttcattgtttttgacgtcctcgtcgattttttccccctcaaagagtagataattagaactttgatgaagaaaaggtcctatgttctgttttatacataatcattttctgaaccatcaagtgtaattcagcttcaatcttcagggcgaatgaagattacttaggatgtattaaactgtgtgaatttaatgttcatgacaagtgtttcataaaggaagatgctggctattatctctcctcagaaggaaattgttgataagaaaccattctgagaagtaagatttatggcaacatcagaggctagagaagctggggcagctgagcacccaggacgatcaggacaactaggacaattcagtttttcttgtgctgtcttttgtgttacaa

SEQ ID NO: 236898 - DNA, 613 bp, Homo sapiens
ggggctgtcgtggggtttaagcaagctcaggccatggagtccagtggagtcagttcgtgttcctgttgtgccacttctttctcaccctgccttcccgaacctcagtttacccatttgtcaggtggtttagcagatgcttcttcctttcaacattgtgattggggtaggggagatgaacactggtgggagcttgtcactctcgtcctttcatcctgctttgtacactctgagaaaggcttattgggcagaggctgcccttctgaggtgtggatggaactgttggtgacattatttttattaatttatttttagagacagggtctcggctgggtgtggtggctcatgcctgtaatcctagcagtttgggaggccgaggtgggtggatcacgaggtcaggagatcgagaccatcctggctaacatggtgaaattccatctttactaaaaatacaaaaaaaaaaaaattagccgggcatggtggggggcacctatagtcccagctacacgggaggctgaggcaggagaatggtgtgaacccgggaagcggagcttgcagtgagccgagattacaccactgcattccagcctgggagacacagcgagactccatctca

SEQ ID NO: 236899 - DNA, 141 bp, Homo sapiens
cacttagagcattttatttaacagaccacatctgtgcccttaatgaatagtaattaaaactcacagcagcattcccattcggtgatgaagagttattatacacactctctaaaacaggtaggctttagaccatgtagtctg

SEQ ID NO: 236900 - DNA, 355 bp, Homo sapiens
agcctaagaaaatctgtcgctttctagccaaaggacaaggagagaaggagctttgttagaaaacttttaggagccgggcgcggtggctcacgcctgtaatctcagcactttgggaggccgaggcaggcggatcacgaggtcaggagatggagaccatcctggctaacatggtgaaaaccccatctctactaaaaatacaaaaaattagccaggtgtggtggtgcacacctgcagtcccagttactcaggaggctgaggcagaggaatcgcttgaacccgggaggcagaggttgcagtgagccaagatcacgccattgcactccagcctgggtgacagagagagactgtgtctaca

SEQ ID NO: 236901 - DNA, 487 bp, Homo sapiens
ctgacctctctttggtgccctggacagcttgggggtgacaggatgaagagagcaggcaacctgagtcagccctttcattgttctgggttttgagtattctgtgtgaagcagagagcaacctagagctgtgtgggattttatgccttttctccatgcctcacctgccatattgatctgactggcaaaacgaatcgggtaaggcttctttgagctaggctcaggcatcagctgcacataatggatattacctcaaggtatttttggtataaatagtgccatgtttagaggatgcattgaccttcaagggtattggtcagaactgagattaagctcaaagttagcttcagacaagataatgagaagcgttttcctggaatattttacaatgtgctctgggcctgctgtttattcagctttatcctggtttttctaccactatccattaagaaaaccatgctgtaataaatatcttgttcacaaatgaaaa

SEQ ID NO: 236902 - DNA, 344 bp, Homo sapiens
ccaggcctaaggactactatagaaaacaaatggttgggaaaggcagtgaaaagctgttaaatgtggctaaaggaacttaaggacaggcctggtggctcacgcctgtaatcccaacagtttgggaggccgaggtgggtggatcacctgaggtcaggagtttaagaccagcctgggcaacatggtgaaaccccatctctaccaaaaatacaaaaatcagctaggcgtggcagcacatgcctgtaatcccagctattcgggtgactgaggcaggagaatcgcttgaaccagggaggcagatcacagcactgcactccaactgggcaacagagtgagactccgtctca

SEQ ID NO: 236903 - DNA, 1343 bp, Homo sapiens
gagagagtgtctatatatgtcaaccagactggagtgtagtggcatgatcacagctcactacagccttgagcttctgagcccaagagatcctctgccttagcccctagagtagctaggaccacaggtacatgccaccacacccagctaattttaaatttttttatagagacagatctcactttgttgcccagactggtcctgaactcctggcctcaaggggtcctcctgcctcggcctcccagagtgctgggattacaggtatgaggcactgtgcccagctggctctttaatctttactattagactgattttcatatgacacagtaggcatagggctcttttagttactagtgattccaaaagtgactttaatcccattactcaggatctctatggtactgtcaattagatcttcctcatttttgcaacatgtttacgtagcattaatgatattattgtttcataagtgagaaaatgaagacacagaaggataaaatagtttgttgcatcagcttgcgggcataataagcaacctttcttctctctgttaattctgttttgtaggccagtataatggctttagtgtcactgttgttaaggagtttttgatgggttgtttctattttctttttgagatgtgaactgtccagattaattctaatctataacttttgggaaaagtatattgatatacatgttagaatgtgtgtgtgtatgtgtgtgtgttgtgtgtatgtagtagatgataacctttagctttggttttcaataagaattttaaaatttattacaattagaaaatttttcctccagtttttattcagttgtcctttttccctttggaaatagtggacctgacccaattcttttttgagaattcatttcatagagcagcgtgttagaatatttttgttcttctaatcaagtgcagtgtaagaactgtagacatccataatttcttttctatcccttggttaagatattagctttattactatatttactggtcctggaatagcaaggcataatctgaggagcatagctacttcatctgtgtaataaattgctctttcactacaaacattttaatactgattttgttggtcatttaactttctaatagtggtccttaaattatgctctaaaagaagaataccatatatattggaaattaaatttgttgttgaataaaattagaattattataaaattcaacacgaccttattgctacctcaggataatttcttggcaaaaagttgatccaaactgggtgtggtggctcatgcatgtcatcccagcaccttgggaggctgagacagaaggattgcttcagcccaggagt

SEQ ID NO: 236904 - DNA, 1290 bp, Homo sapiens
gagagagtgtctatatatgtcaaccagactggagtgtagtggcatgatcacagctcactacagccttgagcttctgagcccaagagatcctctgccttagcccctagagtagctaggaccacaggtacatgccaccacacccagctaattttaaatttttttatagagacagatctcactttgttgcccagactggtcctgaactcctggcctcaaggggtcctcctgcctcggcctcccagagtgctgggattacaggtatgaggcactgtgcccagctggctctttaatctttactattagactgattttcatatgacacagtaggcatagggctcttttagttactagtgattccaaaagtgactttaatcccattactcaggatctctatggtactgtcaattagatcttcctcatttttgcaacatgtttacgtagcattaatgatattattgtttcataagtgagaaaatgaagacacagaaggataaaatagtttgttgcatcagcttgcgggcataataagcaacctttcttctctctgttaattctgttttgtaggccagtataatggctttagtgtcactgttgttaaggagtttttgatgggttgtttctattttctttttgagatgtgaactgtccagattaattctaatctataacttttgggaaaagtatattgatatacatgttagaatgtgtgtgtgtatgtgtgtgtgttgtgtgtatgtagtagatgataacctttagctttggttttcaataagaattttaaaatttattacaattatggacctgacccaattcttttttgagaattcatttcatagagcagcgtgttagaatatttttgttcttctaatcaagtgcagtgtaagaactgtagacatccataatttcttttctatcccttggttaagatattagctttattactatatttactggtcctggaatagcaaggcataatctgaggagcatagctacttcatctgtgtaataaattgctctttcactacaaacattttaatactgattttgttggtcatttaactttctaatagtggtccttaaattatgctctaaaagaagaataccatatatattggaaattaaatttgttgttgaataaaattagaattattataaaattcaacacgaccttattgctacctcaggataatttcttggcaaaaagttgatccaaactgggtgtggtggctcatgcatgtcatcccagcaccttgggaggctgagacagaaggattgcttcagcccaggagt

SEQ ID NO: 236905 - DNA, 1289 bp, Homo sapiens
gagagagtgtctatatatgtcaaccagactggagtgtagtggcatgatcacagctcactacagccttgagcttctgagcccaagagatcctctgccttagcccctagagtagctaggaccacaggtacatgccaccacacccagctaattttaaatttttttatagagacagatctcactttgttgcccagactggtcctgaactcctggcctcaaggggtcctcctgcctcggcctcccagagtgctgggattacaggtatgaggcactgtgcccagctggctctttaatctttactattagactgattttcatatgacacagtaggcatagggctcttttagttactagtgattccaaaagtgactttaatcccattactcaggatctctatggtactgtcaattagatcttcctcatttttgcaacatgtttacgtagcattaatgatattattgtttcataagtgagaaaatgaagacacagaaggataaaatagtttgttgcatcagcttgcgggcataataagcaacctttcttctctctgttaattctgttttgtaggccagtataatggctttagtgtcactgttgttaaggagtttttgatgggttgtttctattttctttttgagatgtgaactgtccagattaattctaatctataacttttgggtgtatgtagtagatgataacctttagctttggttttcaataagaattttaaaatttattacaattagaaaatttttcctccagtttttattcagttgtcctttttccctttggaaatagtggacctgacccaattcttttttgagaattcatttcatagagcagcgtgttagaatatttttgttcttctaatcaagtgcagtgtaagaactgtagacatccataatttcttttctatcccttggttaagatattagctttattactatatttactggtcctggaatagcaaggcataatctgaggagcatagctacttcatctgtgtaataaattgctctttcactacaaacattttaatactgattttgttggtcatttaactttctaatagtggtccttaaattatgctctaaaagaagaataccatatatattggaaattaaatttgttgttgaataaaattagaattattataaaattcaacacgaccttattgctacctcaggataatttcttggcaaaaagttgatccaaactgggtgtggtggctcatgcatgtcatcccagcaccttgggaggctgagacagaaggattgcttcagcccaggagt

SEQ ID NO: 236906 - DNA, 1289 bp, Homo sapiens
gagagagtgtctatatatgtcaaccagactggagtgtagtggcatgatcacagctcactacagccttgagcttctgagcccaagagatcctctgccttagcccctagagtagctaggaccacaggtacatgccaccacacccagctaattttaaatttttttatagagacagatctcactttgttgcccagactggtcctgaactcctggcctcaaggggtcctcctgcctcggcctcccagagtgctgggattacaggtatgaggcactgtgcccagctggctctttaatctttactattagactgattttcatatgacacagtaggcatagggctcttttagttactagtgattccaaaagtgactttaatcccattactcaggatctctatggtactgtcaattagatcttcctcatttttgcaacatgtttacgtagcattaatgatattattgtttcataagtgagaaaatgaagacacagaaggatgttaattctgttttgtaggccagtataatggctttagtgtcactgttgttaaggagtttttgatgggttgtttctattttctttttgagatgtgaactgtccagattaattctaatctataacttttgggaaaagtatattgatatacatgttagaatgtgtgtgtgtatgtgtgtgtgttgtgtgtatgtagtagatgataacctttagctttggttttcaataagaattttaaaatttattacaattagaaaatttttcctccagtttttattcagttgtcctttttccctttggaaatagtggacctgacccaattcttttttgagaattcatttcatagagcagcgtgttagaatatttttgttcttctaatcaagtgcagtgtaagaactgtagacatccataatttcttttctatcccttggttaagatattagctttattactatatttactggtcctggaatagcaaggcataatctgaggagcatagctacttcatctgtgtaataaattgctctttcactacaaacattttaatactgattttgttggtcatttaactttctaatagtggtccttaaattatgctctaaaagaagaataccatatatattggaaattaaatttgttgttgaataaaattagaattattataaaattcaacacgaccttattgctacctcaggataatttcttggcaaaaagttgatccaaactgggtgtggtggctcatgcatgtcatcccagcaccttgggaggctgagacagaaggattgcttcagcccaggagt

SEQ ID NO: 236907 - DNA, 704 bp, Homo sapiens
ggtttctccatgtaggtcaggctggtcttgaactcccgaccttaggtgatccatctgccgcggcctcccaaagtgctgggattacaggcttgagccaccacgtccggccagtgcagatatctaaaaagataaggactttaaaaacaacaatcttactaccattattacacctgaaataatagcagtaatccttttatatcatcaaatattcagtcactgttaaaatgtcagactgttggccgggcaccttaggaggctgaggcaggtggatcccttgaaggcaggagtttgagaccagcctggccaacatggtgataccctatctctgctataaaaattaaaaaaattagccggctgtggtggtgtgtgcctgtagtcccagctactcgggaggctgaggcaagaaaatcactggaatccgggaggcggaggctgcagtgagctgagattgtgccattgcactccaacctgggtgacagagcaagactctatctcaaaaaaagaaaaaaaaaaaggactgtcaaaattaatagctcaagactgttcagttttcaaattaggatccaaataaagctcatacattgcaattggttaattttcttgtccttttcatctgtagttctgctgttacttttattcacttgcaatttactgttaatccatggactttgtagaattttttacattctggatatatatatata

SEQ ID NO: 236908 - DNA, 226 bp, Homo sapiens
gtaggctcagggacctgtttgtggaccttctaaagtatttctccaaatgaaacaatgaaaaagttatcatctattttattcatttatgtgttgccttaattctaggtaatacctatttgccagtggaaagaatattggtgctacagaaatcttaattgtttggaaagtagaattttaaaagacatttctgccttttttcttcaaatattaaaagacttatgggata

SEQ ID NO: 236909 - DNA, 834 bp, Homo sapiens
  misc_feature (73)..(73): n is a, c, g, or t
  misc_feature (100)..(100): n is a, c, g, or t
  misc_feature (137)..(137): n is a, c, g, or t
  misc_feature (311)..(311): n is a, c, g, or t
  misc_feature (401)..(401): n is a, c, g, or t
  misc_feature (412)..(412): n is a, c, g, or t
  misc_feature (449)..(449): n is a, c, g, or t
  misc_feature (456)..(456): n is a, c, g, or t
  misc_feature (459)..(459): n is a, c, g, or t
  misc_feature (503)..(503): n is a, c, g, or t
  misc_feature (515)..(515): n is a, c, g, or t
  misc_feature (532)..(532): n is a, c, g, or t
  misc_feature (558)..(558): n is a, c, g, or t
ctgctggggagataagtacatacctagggtttccaaaagtgctacaagagtccaaaagctataaggaaaagcnaagccagcttagcaaactgcccgatgnaagcaccttgctaggcagatggcattattggaagganctaactgtggggactaaactgaaagcttggacgtttgatatggagtcttctactgagaactgtgttgcatttcttgctttgtatattcctctttgtgctgagctgtattctttgtcttctttgctgttatctttatataaatcacagtcacacttggtacaccatgtacatttntgactaaagtagaatcagtgcaatcttctcaggacctaagaatcatggtgagtggccataaatgttagaaatggaagatttctggaatgncagacatatcncacttgttccagaatgtaagctgtcttattctgctcnggctacnatnagaaactccacagaatatgtgccattcacaatagaaattttttnctacagttctgnagactggaaagtccaanatccaggtgccagccagtttagttcntagtgagcagctctcttcctggcttgtagacggttgctttctcctgtatcctcatgtggcctttccttcctgtgtgcgcgcagagagggatctccctctctatttcgtcttatttggcctctcaatttattacattagaacgtctacctttatgagctcatttaactttacctcttaaaagctctatctctaaatatagtcacatcagaaattaaactttcatcataataattttgggtgacacaatagcccatggcacaaacctctgagtttggt

SEQ ID NO: 236910 - DNA, 518 bp, Homo sapiens
  misc_feature (31)..(31): n is a, c, g, or t
acgatcttggctcactgcaacctccgcctcncaggttcaaatgattctcctgcctcagcctcccatgtagctggaattacaagtgtgcaccggaatacaaaattatatacatatttgtttaaaattactgaaacatattcatgagacaaagctaaaaagagacgtgtagaaaaatcaaacattttagctgatagtggtttctttttaaaatttgcctttatatttctataaagctaattgcagccaatcatagctaaccgaagactcaaactcctgagctcaagcttttgtaccatattgtacttaccatattgtaagtaatgcaatactggtaccatcatctcttcacttggcttccaggataccacactcactgacttgcctcctaattcactggcattcctccagggactcctgtgccagctgctcctacctccctgatccctaacatttgaatgtcccaggcctcagtccttgtctctctcccactcccttggggattttatccagccacgact

SEQ ID NO: 236911 - DNA, 497 bp, Homo sapiens
ttgagacagagtctcgctttgtttccaggctggagtgcagaggtgtgatctcagcttactgcaagctccacctcccgggttcaagtgattcttgtgtctcagcctcccgagtagttgggaccacaggtgtgtaccaccatgcctggctaatttttgtatttttagtagagacgtggtttctttttaaaatttgcctttatatttctataaagctaattgcagccaatcatagctaaccgaagactcaaactcctgagctcaagcttttgtaccatattgtacttaccatattgtaagtaatgcaatactggtaccatcatctcttcacttggcttccaggataccacactcactgacttgcctcctaattcactggcattcctccagggactcctgtgccagctgctcctacctccctgatccctaacatttgaatgtcccaggcctcagtccttgtctctctcccactcccttggggattttatccagccacgact

SEQ ID NO: 236912 - DNA, 503 bp, Homo sapiens
agagaaatttgggtgcagagacagagataagaccatgtaaagacacagaacgccatttacaagccaagctcctagaagctgggagagaggcttggaacagatgtgcctcacagcctcaggaaccaatcctgccagcaccttgatcttggacttctcgcctccagacctgtgagacaatatattgctgttgtctaagcctcccagtttgtggtgctttgttttggaggccctggcacactaatacagtatccactggactctcagtaactaaagggacgaaagtgtcctccttctccctgcatccccttattgccaaatgcatcttgggaaggctattacgagccttagaaggatgaggagtgacctaaatggtaagtttaagtaacatccagaatttgtatgtagaaaaattcagatcataaggatttatacctcagtatgctattgttcaggtgccatctttttgtaataagtcgtagaaccaataaatttgaaagaattaa

SEQ ID NO: 236913 - DNA, 558 bp, Homo sapiens
gctccctctgtttctcctatctttagttcattctcagggttattcattgtctgttctttctgggtaggtgctccctggagctctggccttagtcatcttctccattctttcctcagagttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggccccttcccacttgggagatggggaatctgaggctaagaggtggctgtgaaccccagtccagggcagggctgggccatctgtctgtgctcactgtgtcagtggccctttaggatatgcagtctaaatgtccgatggagttctgcttggtgatgccccctatccagtggctcaggctttccttgaagtgggaatctctttccctaatccagaggctctttggagcctgacaatttacttcccct

SEQ ID NO: 236914 - DNA, 407 bp, Homo sapiens
ggagatcttattaaaaatgatactgactgctctttgaatgctgccaaaaattgctccatatttcgtgttctaccccaagctgccacaagagggcattcttcccccaaaatatatgcaagtaggtagtaccattgagttctacaaatagagaaaataatatttgtaagatatttcatgagtttctttggcctggctaggaaatatttacattaatgtctgattataagatgatactttattttctcactgtgttttcttctccgattttgaattttatagggtgttaaccaatggattagatgacaaccaaaaactgtatatgttttttaagtaaatggctttttgttttgcttttgatttatgattagcattgtctaataaaattggtggttcattatgttccatag

SEQ ID NO: 236915 - DNA, 300 bp, Homo sapiens
atagaaacatatttcatatgtatctgtaaaagagatttgcatcaaaggggagcaagggaattgtgtaatggcaggtgggaaagtggagccaagagaatataaatataaatatatatatatacaatgataaatatttgagtgtgatatataataaagatgagaaataacagtataaatgaatcctgattgactgatcaaaatgacccaatagacagcacaacattgataatgctggagataagggagagaaagaaggtaaagaaggtagtgatatcatttagttgatgtgagaagaagata

SEQ ID NO: 236916 - DNA, 703 bp, Homo sapiens
  misc_feature (51)..(51): n is a, c, g, or t
gtgaaacctattatagagtcatcattttaatgcagaaacaaaaatcactancaattcggaaaggatatttgtttattgaacacctaattcatacgggaactgtgctaagtagttggcgtatatcttcacatttaactctcacaaaaatttaatgaggaataagttcagtagctttccaaggagaatgaggctttccttatacctcaatttaacaatttaaaaaaattgagtgttcaggaaagagacagctcctgccttttccacacctcgctttagctcattggtcatcaattccaagactctctcctcctggattctgggctaggtagctctgttccctggcttcagccattagatgcatggagacctaggtaatttgtgcattcacaaatgaaagtgttctaggaatactgtggaaagaaacaaaagtactgtagtctaataaggccacagatatcccttctgtatgtctagccctctaaaagacgttctccccaagaagcaaacaagggaccccattagtggagagctttcatctggccacatcacatcagagccagatgcaccatgtatgcaaacttttttagatcttttctgtctaagagagaattttcctatgtaaacagactgttttgcttgtctattgatgtgaacaaattacctctaggcttagtagttgaaaataaaatcaccaccaacacca

SEQ ID NO: 236917 - DNA, 155 bp, Homo sapiens
ttagggagaacaacatttgtagttgccatatttactgctttgtcatggatttctttccaattaagactaagtaagagagcaaagtcccatgaagatgggacaaggaaagggataaggatgagagtagaggaatggagagagggcaggaaaaagag

SEQ ID NO: 236918 - DNA, 399 bp, Homo sapiens
gttccacggagcgtcactccctctgtgacttctgggtcagccgatggggatggacagagtctggcagtgggtacaggaaccctcgccacagtgggtggccttgaactcctgaactcaaatgatccacctgctcatgcctgtaatcccagaatttttggaggccgaggcaggtgaatcgctagaggtcaggagtttgagagaccagcctgggcaacatagcaaaaccctgtctctattaaaaatatacaaattagatgggcgtggtgacgtgcatctatagcctcaactactcagaggctgaggtgggagaatcacttgaccccgggaggttgagggtgccatagagccatgattaggccactgcactccggactgtgtgacggagcaaggccctgtctc

SEQ ID NO: 236919 - DNA, 598 bp, Homo sapiens
agagtttctccatgttggtcaggctggtcttggcctcccgacctcaggtgatcagccagcctcggcctcccaaagtgttgggattacaggcgtgagccactgcacctggccctgaatcttttattatttgacttagttttataattgagtctctggacttttcttgatatactgttatagctccatatagaaatttttcagtcttatgcctctaattgatttcacttgtctaattatgttggctaatcccccacgccccacctcaatttattgttaaacaatagtagagatggtaggcatttttttccttattctttatcgtattggaagtacttctgtttttatactactggaaatacttctattttatactgtacttctgtttttataccagtttctggttttatacttagtttatttaatcaactaacaaagtatgaaagattagtgtaagtaattatatgtcaataaacctaatgattaaaaagaatctatctgtgctacttctgggtttggaggaggatggtggctacctgatcttgaatctccccactgtccctcccctctgttccaaacaataaaaaaggggagaacaagt

SEQ ID NO: 236920 - DNA, 422 bp, Homo sapiens
cagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgact

SEQ ID NO: 236921 - DNA, 519 bp, Homo sapiens
tacaaagtaatctgtgaggtaggtaataaggcagatagattaataccccaggattacaaaggatatagctaagaatgttagataaggagacaggtgtgtaattaaatagcaggtttatcatatgcttattcagccatccattaattggatgtttattgaatgtctgtattagacgttgggcttataaaagaacttcagagaaacttgtgtatttgaaaatatgagaaggaaaataatttgtagccacacctagtctattcacctgctctttgcttgcagtactcctcatataataagtacttaatgtatgtgatcttatatttgatcattacaacattcccttaaaatcactattcttaccattttacagataaagaaacaggattaaagagattttttttccacgataaaataatcaatgatatcaaaattcagtcttcaaatctcatgttcttattccactatgtgtttcttagcaattcagagaggcactttgtttcttcctttaaaaaaaaaaaa

SEQ ID NO: 236922 - DNA, 531 bp, Homo sapiens
ctatgttggtgaaagaccttgaaataggctatataatcatctttccacattaatatgattttacatttattttcaatattgctttacattaatactaaatgtaatttttttcaacttaaggaaagaaaatgtttatggtaaatcatatgtatatttaggaatgttcatcacatgttttcaattacattgtttcatgaaataacttaatggtttttaagaaaagaaaagctacagataatcatggtatctatagcttttaaaaagctgactttaaagtcaatcacttttcaatatttatccaaaaatttctgtgtttgcagagcacaatcaatactataatgcctttaaaacacatgcatcactcattttttttcaaacgtcagcaaatgaatataagtattggtgacaagctacataaaaacagcttgagcataacgtgggaaaaaagactcaagatggtttgtaagtacaggacttatgtcacaaaattgaaggatgaggataggtgaagggagtcctgatgcaatacta

SEQ ID NO: 236923 - DNA, 355 bp, Homo sapiens
ttgcatggcatgtggatggcctcctatttttaaggttcccccttccatcacagtcatttctctgaaactttctcattgccgacaatccctgttgtccttaatcactatgccagagacggtacctccacaatgcaccacagcacacagaaaaaaaataacaggcagaatcaggtttctatcttgtccataggctatggaatgtttgctgtaagatgtcacaccaagaatgacttggtaaaggcctaattcagtctgagtagagggttggatgcctagttacggaagcaaaagttattctggacaaaattaggttgcagatacaaatttgagatagatgttatccaacatttccaaa

SEQ ID NO: 236924 - DNA, 347 bp, Homo sapiens
caagtttgatcctcttaaaataacaagcagtttgtgtggaatattgaagtatattttatcatcagcgaagttaataactctgcttagtttgatattttctgtgtatatatacatttttatagctttaccaaaacagagcttacactagaccgtggtttctttttcctccttccaattactatgtgttcttaaatgtgacaaaaatacctttgctttttgagttcagtaattaagaggtttaactacttcaagctgacctccctgcaacgagtgcaaattagtgagattaaaatgagattgcttctctgtgttctctcggtttacatgcaagttttccctccccccca

SEQ ID NO: 236925 - DNA, 343 bp, Homo sapiens
ttttctttaagtatttgcccttttcttttagtttctcaagattcccaatctttttatttattattattattttttgagacggagcttcactcttattgcccaggcttgagtgcagtggcacaatctcggctcactgcagcctctgcctcccaggctgtgtccccttgccaaaaacctctttccttttctggacttcagtttttagtcagtgaaattaagcttttacacttgagatcttagaattctctcccaactcagatgttctccagtttcacctgatcactgtatagcacttgaaagggaggatagtgctaatagcctggctcttaggagacttctttga

SEQ ID NO: 236926 - DNA, 608 bp, Homo sapiens
acatttgcaaaggctttacagtttacaaaataatatcactgaatccttacaatcaccacatgaggtgatgcggtgttattcctgtcagtcccacgtacaagctgaagctcgctaacatttagtaatgtgcttgaggtcacagaggaacaaactgatagacaaagggctaaaataataacagttcccattatttcttgtttcctatacttctctcagggataagtactactgtcttgactgttttatctttaaggaatctgaaacttaggataaacaacttgcctaatttcttatgatggagatgtaatagtggttggaatttggacctattccttctgattctggagctcaccagttaaccactctgctaaactgcctccccaagaggtaaaaaatatctagtgctttcaagtccaaatcactttccaatagcaatagttgataatatcatgagctgcccatgcttccagatgggggtagatgctagtttggagggaaaggctgtgccatgggacagaagactcaatgaggagggtgagtattaccacaagctgggacccatttgtaatggtatttatagaagtctaggagcacagtattcaattagc

SEQ ID NO: 236927 - DNA, 468 bp, Homo sapiens
gatggggagaatgactgttgaacaggtctcagttttcttttggggtgataacagtgtttcagagctgtagagagggggtaattgcacagctttgtgaatgtactagatgcctgaattgttcacttgaaagtggttaatttatgttatgtgaatttcaactaaattggacaaaaagcacccctgacaacaaattggtaccttgtgctcttttatgtgcttatccaagattcctttactattaggtggaagtagtaagcatggcttccatgaacagttgtataggttgttcacagcacaaggctaaccagatgagaagctaccatcacctggtgcttttttcactcagcgtgggacaagcatctgcccagaggaaaaggcatctttttctaactcatgcaaaggtgctctgtgggcttctcggccttgataagaagagccatcaggcttacttctccgcagcctttatga

SEQ ID NO: 236928 - DNA, 260 bp, Homo sapiens
cttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcata

SEQ ID NO: 236929 - DNA, 455 bp, Homo sapiens
agagtgggtccctggttaggggtccaccccttggcctgtgccctcggacctaggtgaggacgggcatttctgttctcgtgcccaaatcttccattttccaagacgactctggccctccacgcccccatcctgtgcctataaatccccggtgccctagtgggtagaaacacgagtgggtggacattgagtgaaacacaccagaggaacacacaagcggctggacgtcgagaggaacataccggtggaagggcacaccgaccggcaccggcagacgccagcaggccatccaccagctgaatgatgcggagtttagctggggccggtcggacggaggagaacctagccgcggggcagcccactccaagggaaaactaccttcccactccatccctcttcttgcctccccgtccacctcactgagagctaccaacactcaataaaataccttgcacaca

SEQ ID NO: 236930 - DNA, 884 bp, Homo sapiens
ttagcatctcctgtgagacaggcactccttgcaggctcacatccaatcctcatgacacccctctaaagtgggtattgttagcacattttatatggacacagacagcctgggttcaaatcctcactctactatataccagctgtgcaacttcagaaaagagacttaacctctctgagtctcagtgccctcatttataaaatggaaataaaattagaacctgccccagttcctcaaaaaattaaacatagaattaccatatgatccagcaattctgcttctgagtagatacctgaagaattacaagcagctctcaaagagatatttgtacactcctgttcacagcagcactattcatagtaggcaaaaggtggaagcaagccaagcgttcactgataaatgaattggtaagcaaaatgtggtctatacatacaatggaatgtaattcagccttaaaaggaaggaaattctgacgcatgcatcaacatggatggaccttgaggatattatgtcaagtgaaataagccggtcacaaaaatacaaatagtgtttgatcttgcttatatgagttccctagagtaatcaaatttatagagacagaaagtagaatgatggttgccaggggttgtgggtagggggatgaggagttgttgtttagtgggtggagttgcagttttgcaaaatgaaaaaagttctggagctggatactgacaatgttaggcaatacatttctcacaatgtactcccattgttaagtgacacatgactgtatttgcagaggtgtggcagggttcagggagctacattatgggtatacttaatgcttctaaattgtacaggcaccaatagttaagatggtaaatgttgtgtgtattttatcaaaatta

SEQ ID NO: 236931 - DNA, 229 bp, Homo sapiens
gcagatatgcagcctttatatacatttagaaactgtatggctctattttcatcatatacacatacatacacatgcataggataatgattaagcatggaaatgtcagcagtcttagcacctgcatagaaaagtgactttgatgacagaccttggagaaagtctctcggctcaataacatctctgaataaagtccaatctttatttcaataaacttctcattttattttga

SEQ ID NO: 236932 - DNA, 392 bp, Homo sapiens
gctttttaagagacagggtcttgctctgtcacccaggctagtggcctgatcttggctcactgcaacctccacctcctacattcaagtgattctcctgcctcagcctcccaagtagctgggattacaggcacctgccaccacgctcagctaatttttgtatttttaatagagatggggtttcaccatgttggctaggctggtctcgaactcctgacctcaggtgacctgcctgcctcagcctcccaaagtgctgggattacaggcatgagccaccccacctggcccagccccttgttttttaaggatagttttgatgggcataatatttttggttggcagttttcttccttgagtactttgaatgtactgttccactcccttctgtcctgcaa

SEQ ID NO: 236933 - DNA, 1941 bp, Homo sapiens
ttggtgatgtgcacgtttctgaatttcaagattttttttctgtgtccttcagggagaataaatttctatatagtgtcaagatgctacataatgggataaagaattatagttaagtgggtgaatctcattgtgctttttgtactgtgtagcataataccaaattcctctattcactaaataaacattgtgtgaatactgtcctaaaacagcctgttgaaggatacaaaaggatatctagaaaaagcagttgaggattggtttggattgtttcaagtgataccaaaatatttattttgaggtaaatagccacagtagtatagagccaagaggtaagcacagatcaaacatatttaagggctatctaaaaataataaggaatttggacatttttctgtaggcaacagagcaggcttttcacttaggatgctgtcattgaagaatttggccatgatcaaagtagccctttatgtagttaaatgggggtctctttaggcttcatagattttgcatgtttgggtttctatttagtttgttttctctgatggacaaaggcaggggaccagattctgtattatcctggaaggactgtgggaatgtgtcaaaggagaaccgaatttgaacactgaccttgtcattaactagctgcatggcttgagccatatcacctgtcaggatttcagcttccctatttgcaaaatgggaggtagaaggctgttggaataggtaatgttaaagcttcttagaatggtcaccttttatgatttttgtgacaatcatggacaactctcgccttttgtcttttagaagataatccagactgatattcatcccaggaaatttaaaacccaaaatatagttaaacaggactctgaaatacattttcacttaaaaacaaagcaccaggaaaaaatgagctgctactacaagttaagtgactttggaatttggacaacattgagggttactgccctaatttttaaagttttttaatgctatttaaaattaaacaaatcaatgcctgtttaacatttctaatagttcttcatacgtactaagagcccaatttaattatattcccaatagagttgttaaattatgaataagcacaatttagtttgtaaactacataacgcagtgcttgggaacatactgtatcctcgaaactgctagtttcaattcacttataggcccttctaagttgagagtatcagtgctactcggctatgcttttggatgccttcctgtaggaactgaaccttttgtgcaccacaagtggctgggcctcagttatgggcagatgagtgagtctgaaggttgcaggttatgttaagcatagtggggggcagggttagagggttgtgaggggaagagctctatagaggaagacagaaatggcaaaatgtacttgatagcctcaatttgttcttacacaatctctctggttcataaatgaggacagagacattaatcttaaagtatacacgtggaagtgcttcttttaatgattttccagttagtgtgcaatgttctcatctggtgcataagtagattttattgcaaaggccagagcccctgctggacatggatgaaacctcaacatacacaaggaaagatggaaactctcttggtggagaaaaacaaaaaaaaatactttaagaataggaaaaataggccaggcgcagtggctcacgcctataatcccagcactttgggaggtggaagcttgagcccaggagttagagaccagctcggacaacgtggcaaaactctgtctctacaaaaaaatacaaaaattggctgggtgtggtggcatgcgcctgtagtcccagctacttgagaagctgaggtgggaggatcacttgagccccaggggtggaggctgcaatgaactgtgattgcgccacagcattccagcctgggcgatggagtgagacctcacgt

SEQ ID NO: 236934 - DNA, 421 bp, Homo sapiens
cctggggaatccctactgctcgcccacgctggtgcgcaagaaggccattcgcagcaaggtgatccgctcgggggcctaccgcggctgcacctatgagacccagctgcagctgtcggctcgggaggcctgtgagttgtgggaacatgcctgccctgtgtgtacctgggacacgtgcccgtgcgctcctggaccagccagaggtgggcgtgagtgcccgttcctgcaaggctgtggccgcacctccaagtgatgcctgtgcactgtgtgtgtttgcctgcatccgtgtctgtgcaaaggggactgtgtacagccgtgtatggaccagaactgtcgggcggaaggcccgtgtgcagatatgtctgctgagcagggtagagaggcttggggaggacaccaccctgggtgatgaggcctgcggccg

SEQ ID NO: 236935 - DNA, 247 bp, Homo sapiens
catttaatggtccaatttgctgactaggtttagtccaacttaggcctttaggatttctgagactagggctattcatgcttcccctagctgatgttccatttcattcattaaatgaaaatttttgtttcccaccgtgtgccaggcacagacacttgcgggtacaacatggaatagaactgtcccaaaagaggttatattctagtgggggaaggacagataataagcaactaataaaatattacaacaa

SEQ ID NO: 236936 - DNA, 387 bp, Homo sapiens
gtttcctaccatctacagagtgaagataagacttgtcacatgaggctcctgcctgtctttgtagctcttaaatttggagtataggcaaagtgaaacccaaaagtagagccaagtgtttgctatcgctacaagagcacagattcttgccctcaggcacctcaaatcctatgtgagaataaccacagtatgaagtataaatagtaaatccttgactacttagctcacacttgaccctggagagtttggtactcacagagaaatgtaggctgctgagagtaaagtgttcagagttcatttctttctctataacctatctcttctggaaaaagagcctggaaagctttggaaaaaaagttggttaactgggaatagaaaagtaggaccaaa

SEQ ID NO: 236937 - DNA, 423 bp, Homo sapiens
aaggagaggaagaaaagcagggaacaaccagttggtggaacaatcagaatacacacaacatttgtcagttaagtttaccatcttatatgggcatggtttgtggtgacccaaaataattacagtaaaaacatcaaagaacagtgatcacaggtcaccataataaatattataataatgaaaagtttaaaatgttgcaaaattaccaaaatgtgacacaaagacaagaagtgagcacatgctgttggaaaaatggctgcagtagacttgctcaatgcagggttgccacaatttacaatataatacattgtattataaaaaatacaatatctgcagagcccagtaaagcatagtgcaataaaatgaggtgtgcttgtatttatagatgatatctaaagtcaaagaatgggtggaacagtgaagacg

SEQ ID NO: 236938 - DNA, 348 bp, Homo sapiens
cagggctggcggacacagcaatgaccaagacagagatccctgacctcaggccctgggatgttcccggcatgtagtggatgccaaagttgaacaaatatgtgctatagaaaaggcttcgacacattcattaattcttccaacaaatatccattgaggtttgccgtgagctgggctctggggagatagcagggaacataatttgaacgtggggcagtgagttgacatccttgcattgaatgacttgtgttcctccagagctgacctggccccccgacagccactacgagctgtgtggcttctcctgtcccagctcctgcaccgagcctgccctgcccgacagctgtctga

SEQ ID NO: 236939 - DNA, 350 bp, Homo sapiens
tgagaccaagcagggctgtcaccaaagtcaggagtgcccaggcctccctgaaagcaaacatcccagggaaactgagaccagcttaaaaaaatcttaattggtgaccaagttttaaaaatcagtaaatctcaccaataaaccaaataactcaacgttaaaatggacagaagcctgggaagaagcagcaaatgcagagcagggaacaagatctaataaaacttcagtcacagggaaatctcaccagctcagctgagagctgtgccctttcctcaaagcagcactcctcagcctcacttacagcccaattactcttgtgttacacacagtccttagagaggtggtgatgtgtc

SEQ ID NO: 236940 - DNA, 309 bp, Homo sapiens
tcaaggctggtcgaatggagaaactccaagaaagtggtgcactgagatccctgagaattatcagtctaagcaggtgatgtgtcaacaaagatcttttaaaagtgtatgttatcatggcaaattttgaacatgcacaaaaatagaatagtgtaatgaacctccatattcttatctcccagccctcacaatccttggctatggtcaaatgtgccctaccctcatccctattcactttcctttctcctggtttaaatcatttcatgttattttaaatgacttagtaaaattttaattatgtatctctaacat

SEQ ID NO: 236941 - DNA, 490 bp, Homo sapiens
tgacttcattgttcagcccgggttgaaggccactgctctccatctcctgaatgagaaggtctagaagtgagacctggagtctgttgtttgcatctttgtttctttcctttttcaatcaaggtcaccagatgattctcttgcacactgaagtttgaagaccaccactagaaacaactttttcatctaaagcctttacagagtacagtttgctgaatttatgagcattaagaacaccccctctatttccatcttgaggctagaatttgccctggggcagttactgtggctacctcagccaccctcacccccagcctcctagacctagagtaccattgagctcctcacatcaggagctcgtagcatgcctgggccatggagaagctccatcctgtattatttcaaagtacctcctagtatcttccccatcattagactggacatcgggattgctactttataaataaagtcgtgttctgtgcagtacctctaa

SEQ ID NO: 236942 - DNA, 388 bp, Homo sapiens
tggttttttgtaaagacagggtcccactatgttgcccaggctggttcttgaactcctgggctcaagcggtccttccacctcagcctcccaaagtgctgggattataggcatgaaccatcacacccaacccttaaatttgttaagtttattaattatcttgctgtcccacaaaagttctctgtgttcctacttcatcgaccctgtgaaaagcagccctgtgcttcatactctagatggcatctctcagcctctgccccatacatcttttacttggctatcatgtggatataaattaaatcctgtgaatacgtaacatctcataggatgtagaatgcagaaatgcagtaaagaccatacttctgtgcctcttggctattgttgctgtcaa

SEQ ID NO: 236943 - DNA, 524 bp, Homo sapiens
cagatcagaactcagctgctgtatgccatctggggttatcttctcacttgcacgctcatgaccagtgtaggctgcatcttataagtaatctggctcacagttagctagacatatattagtctgatggaacaaaatccgattgtagctttgaccactatgaggaccactgtcatataaggtcttagataccaacttgagtaaattgcttaaggactgggaatagatccagattcctccaggtttagcttcaagttgtgatcagttttcgtgggatgcaaggagagcagcgtcttaagaattctaagctttcatttatcaatcctgaggtagttaacattactatttccagtaatgttcactgggccagtttacttttgaagaaattgaatctcacggtttaagtaaagtaactagctcaaggctatatagttataactaagccacagagcagggaggctaatctaggcctacctcatgccacagcctgagttcttagttgtgatacaaaacaaggtaaaggggga

SEQ ID NO: 236944 - DNA, 578 bp, Homo sapiens
cagatcagaactcagctgctgtatgccatctggggttatcttctcacttgcacgctcatgaccagtgtaggctgcatcttataagtaatctggctcacagttagctagacatatattagtctgatggaacaaaatccgattgtagctttgaccactatgaggaccactgtcatataaggtcttagataccaacttgagtaaattgcttaaggactgggaatagatccagattcctccaggtttagcttcaagttgtgatcagttttcgtgggatgcaaggagaaaatgaataggaatgaaataaatagctgatatttgaacatttttaatgccctaggcagcgtcttaagaattctaagctttcatttatcaatcctgaggtagttaacattactatttccagtaatgttcactgggccagtttacttttgaagaaattgaatctcacggtttaagtaaagtaactagctcaaggctatatagttataactaagccacagagcagggaggctaatctaggcctacctcatgccacagcctgagttcttagttgtgatacaaaacaaggtaaaggggga

SEQ ID NO: 236945 - DNA, 1003 bp, Homo sapiens
atgtgtgtgtatatacacgtgtgtttatacacgtgtgtgtacatatacacgcgtgtgtatatatacacacgtgtgtgtgtgtatatatatatactaatcagaattctcttgatatcactatgtattcatagttttctgttcaactaattataatctgtcattttaccaaatctcaaattatcccaaatttggtcagaagtagcctcttcaggttgtctcctgtgtcgttttggcatgttcccatcatttttacagcaatttattctgggcacaacaggattttccaaggtcatcttgtacttgccttgccccagctctggaatcagccattcctccaccttttagtgaaattggcagttagaaatcaagatttgtgcatgagatgtgcttattattattgagatgtctcaccctactctttctcaatagataatgctagggggctttatgtgtgcatacacacacacacactcacgcatattttaaatatacacccacacccatgcgcccctctgcaacatcttcctcacctcacttgagcttccatactccatacgtgggcttcccctctctctggaggagaccatcctcatctcacatagctcttgaagttttggctttaggaccaaattgagggaataagaatggtcattgcagaaatcctgtaaaaattttaaaatattaaatttaaaaattacaattttatcacgcagaaacaactatatttttggtggaagtttttttttttttttaatgtagtgagcaaattagtaaagctgaattgaggagggggtaaagtgttatgcccaagacacagaacttacattttgaaagaattaaatttgaaatgcataccgtatgtttttctattatacaatctccttgctactgtaattgctatttaataagagtgcatcagagaaactgtatgaatggaaacctgaccattaagcactgaataccaataggatatttttactaataaagttcaaaggaaaaatga

SEQ ID NO: 236946 - DNA, 731 bp, Homo sapiens
tgaaatcggggaattctggttaatcttgtctctcgttcatattcccacgtcttcaaaagtgccaggaccggtcccacctccaggggtgtcagtgcatttaagagaatggcaagaaggcatagggcgatccaggcctcgctccggggcccggggttgggatcccgcttcacgcgcccccactggagaccgcaagcctgtttttaaacaggtggagagcagcgtgagcccagagctaaaggaacgtgtaaacccaagccgcctcgattccgagttttgcgtcctgccgctcacctccccaccctctgcgtttggggttccgttcttggccttgcagaccctgcgggcctgctcccgagaggatgagactgggggaagcagggccgcggggcgggtgaggtatgagctgcgagaggtgtgggccgcggggcaggcgagggacgagtgagccgtggaccctggatgggcgagccaggagcgcggggcgcgccccgtcaggccgtgcaggcgagcaggtgctggaacaaaggctgcggggccgccaggctaccgcggcctttgatgggcaaggacgtctcctcctggggctcctcattcgcatgcaaatccagcgctggtccccttttctttgtaggcaaacagaaggatgtttgtgtgtttgtaggaacgaagcctgcttgaacaagccttcctcaataggctgggtctcgaaaaataaaccagttgaacaaaca

SEQ ID NO: 236947 - DNA, 456 bp, Homo sapiens
tcctaacaattaatggtgattccacatatgtatttccttctattctttcttattaaggctcagctcttccagaagttttcagaagccccagggttagctaagcccctcctctttgctccattagctaccctgctgccagccccctacttactcacacacccttattaaatcaagtttacctttttatgtacctgttgccatagctgtaaagccaataatataataattaacatttactaaacatgtatcatgtactgacctctgtattgaatgatttccaatctgtgtctcaaggaattctcagctatcctaagtagatactattactgtcactgttgtacagttgcagaaaccaaagcttaagaggtgaaataaccaggcgtggtggctcatgcctataatctcagcacttcgggaggccaagacaggaggattgcttgaggccaggagttcaag

SEQ ID NO: 236948 - DNA, 425 bp, Homo sapiens
ttttctccctgttgcttgacataatttctcagaggcccaaaactaaactctcctaattctctcaaaaaaattttttgagacagtcttgctctgttgccctagctggtgtgcactggtgcaatctcacctcactgcaaccccagcctcccacgtagctgggattacaggtgagaaccaccatgcccggctaatttttgtatttttagtagagatggggtttcgtcacattggccaggctgatcttgaactcctgacctcaggtgatccacctgcctcggcctcttaagagtgctgggattacaggtgtgagccactgcacccagcctacttctttttcattaggagagactgatttctctctctagccgccagctccatgggcaccgatgtgaatgcacctggtggggtgcggtgttgggtgttat

SEQ ID NO: 236949 - DNA, 674 bp, Homo sapiens
gggaaacgggaggtgatagaagaggcgagatttggggtggaggtgcagaccgtgggaagcctggcgggccatggtgaaccttgagtcttattccaagtggaagagagaggcctggagggtcctgggcaggtggtgctgtgatctgacggggccttcacaggaccttgctggcaactggatggaggacagacccacagccacaggggcagggagcccagcgtggaagcggtgggggtggagggacacggttggcttctgggtgtgttttgaaggtagaacctgtaagacttcctgcagaattgtatatgggaatgagagaagaatcaaggacctggcttgagcgatgggaagggtggcactgccattgaagggaagggacagcaggaaggacgggcgagctcagtgggcaatggcatcagggcatcagagcagagccacgaagctccagggaggccatcaggccaggagggcaaacttgggagtcctcaggagatgactgtgaagtctcagggctgcctgaggtcacctgttctgccgtcactcctgggtctgcgtggctgggtccttgttgctcgggctctgccctgaggtcctgcccagcctgctccacctcccgctctccatgtccgttctgctgtgtggcattcgccactccaagcaccatctgagattgt

SEQ ID NO: 236950 - DNA, 136 bp, Homo sapiens
aagaaattgatagaaggtaataaaactaattgttctcaaatgtttaggtcccgttccaccctggtgagataaaagacatcagcagccacaatcttcactggttacctctgatgaattaataaactacatgtttaaa

SEQ ID NO: 236951 - DNA, 485 bp, Homo sapiens
catttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttgaaaagactcttctttatcacctcaaaactatgctgcatttggtgatgttggagcggccg

SEQ ID NO: 236952 - DNA, 403 bp, Homo sapiens
atttttttttaattaaacaatgttggtgaaatatatttaaacgtaaatcacaaattcgaagtcttccaaatatttatttactaatgtggaagacatggaaactacagtaatctcatttaaaggaagttactttgatgtgcatttgcttttggcggggtatgattgctgacctgcctttgagggcaacttcctttggctcaggtaagcaggcaaacccgtttctccaaggcgattccaaccccacgcccctcaaaaccttaaatcttaaattgagttattgggtgcaggtcctttctcccacagaacctcccagcttccggaatagaggagcggggcagaaatatcctgctttttatttcagagctgacgtttgcaatcctagtgcactagcggaaaaaaaaaa

SEQ ID NO: 236953 - DNA, 469 bp, Homo sapiens
gcacttaactgtgcgtttcccaaatatgcagttttgctacaattttagagtctgctggctgcccacaccatgcttaaatttgaggggcccttccaaacagcaactctgatttctttgaaaataaatgtatctttacagttaacaaagagcaaggggggcattttctgggttctagttttatggggcccagaatttaatggttcattaacaatttaatagatatcttcttcactcatttcatatacagccacattcctttagtcaatttttgtgttgttctcatccatttaaaaacaccccaaagtctcattagaagtttcatgtcatcatctaattcatgtgaaatatagcccatggtgtcttcaggagggtccagttaaaataatttacatcagcactgggttgtatagtctgtctgataaacttacttgaaattaatcaaataaagttatcttgaaaccctaacaca

SEQ ID NO: 236954 - DNA, 432 bp, Homo sapiens
ggtcaggagattgagaccttcctggctaacatggtgaaaccctgtctgtactaaaaatacaaaaacttatccaggtgtggtggcgtgcacctgtagtcccagctactcgggagactaaggtgggagaatcgtttgaacccaggaggcgaagattgtagtaagctgagattgctccagtgcactccagcctgggtgacagagtgagactccatctcaaaaaaaaaataataataataatgtatctctcttcctatattaagataccttaggtagctagctctacttatttcaaaataaaattcatgaccaggcatggtggctcacacctgtaatcctaacactttgggaggccgagatgggaggaccacttgagctcaggagttcaagaccagcctgggcaacatggacgctatctctcaaaaactcaaaaaa

SEQ ID NO: 236955 - DNA, 430 bp, Homo sapiens
  misc_feature (132)..(132): n is a, c, g, or t
tcagttctcagttcctgcagacaattctccattccagccacaagtgaaatgatcctgccctcagcccaacttcgaggtgcatcttaccccttctcaaaaccagctcccagggaaaaaaaaaaaaaaaaaaanaattgtcgcgcggccgctccaacatcagaatggtaacaccagagagctaggacctgtcacctgggcctccccgggagagctgacaccgcggcctctgaccccacctcccgggaagttcagctgctcagaaccacaaagcaaaacaaaggggcgcggagaggaagaagccgcagtgcctcccaatcaccgccggcgcccgagcccgagcctagctctcccgcggctccttgcccggtcctcccggctggccgcgcaccaaggcccaagcagcccctggtccctcgtctccccgcggccg

SEQ ID NO: 236956 - DNA, 641 bp, Homo sapiens
tggtggtggtggtaactgtttttataaattaactattttccagacattgtgagaggcatttaacaaacattatctcatgtactcctgacaacctgaggaagtagttactgtaatcatccccattttacatctgagaaaattccttaaggaagttgcccaaggttatagggcaagtaaaagacagagctgagattcgaacccagagagtctgactcaagaacctgcaatctaaaacaactatttgcagccttctcaattacaccatgaattcttcgtaattttttttttttttagacagaggtttactctgttgcccaggcttgggtgcaatgtagtcctcatagctcactgccgccttaagccttgacttcctaggctaaggccatcctcccatctcagcttcccaagtagctgggactataggcgcataccaccatacctggttaatttttagtagtagtattattatttgtagagatggggtcgtgctatgttgatggtgctgatcttaaactcctggtcttaaatgatcctcccactttggcctcccaaaatgctgggattacaggcatgagccaccatgcctggccaattgttagtaattctgattgactacacttagtgtattcagagagagacat

SEQ ID NO: 236957 - DNA, 381 bp, Homo sapiens
ttttagtagagacagggtttctccatgttggtcaggctggtctcgaactccagaccttaggttatctgcccacctcggccttccaaagtgctgggattacaggcgtgagccactgtgcctggccctaaaccatttttatgatggctgattttaaatccttgtcagaaaattctgatatctgtgtcttggtgttagtgtctcttgactgtcttttcttttttttgagacggagtttcactctgtcacccaggctggagtgcaatggtgctatctcggctcactgcaacctctgcctcctggattcaagcgattctcctgcctcagcctcttgagtagctgggactacaggtgccagccaccacagccagctaattttttttt

SEQ ID NO: 236958 - DNA, 396 bp, Homo sapiens
tggtggtggtggtaactgtttttataaattaactattttccagacattgtgagaggcatttaacaaacattatctcatgtactcctgacaacctgaggaagtagttactgtaatcatccccattttacatctgagaaaattccttaaggaagttgcccaaggttatagggcaagtaaaagacagagctgagattcgaacccagagagtctgactcaagaacctgcaatctttttttttgagacggagtttcactctgtcacccaggctggagtgcaatggtgctatctcggctcactgcaacctctgcctcctggattcaagcgattctcctgcctcagcctcttgagtagctgggactacaggtgccagccaccacagccagctaattttttttt

SEQ ID NO: 236959 - DNA, 1753 bp, Homo sapiens
  misc_feature (262)..(262): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (275)..(275): n is a, c, g, or t
  misc_feature (1125)..(1125): n is a, c, g, or t
aaatgccaacaaagcatatgccaacgaagcccctgcttctgccttcaaatgagagtacctagaggaattgtttcaaatggcaggttatctccaaccttttctcctctcttcagttttctagatactgtgcacatccactctagagttccttttttcctccctcctccactactgattctgctcagaagaatcttcatcagtaatgcccaatgcctgggcttttctttggggtcctttagcccagacctgagaaggttcttgnatangnagttntngatctggcacctttgttactatcatagttataactatttatacgtttctattcttcaacaattactgttttaacttttgctaaataagttactgtttacttataaatttaaaatgtactttttgtgaatagttctcacaggggaaaatagttcaataaaatgcagtttttttcattgagcagatcagctgggttcatgagttttggaattggcagatgcacgggaacttgatcttgttcctattttaaaactttgtttactggcaggtatttgactgttaaaaaatccattggtgagtttaatgatctgtttaaatgtgtgcagtattgctaggtagcctttgtacattaaaaacagataacctgatagtagttgacttttctaatagtttacttaccatatcactttcaatttatgaataatttctaaagttaccctgttccatggccacagctcatgccactaaagccaatcagctgtcttgaagatgtgccatttgtcgtgaggggaccaagaaatagggtgaagagatcagcccaaatccatcactagccactggaaaaaatgattcaaaatgcattctccactgagtctgaattacattatttttagccaaaggtctttgcaacatttaaagaaataggggtaggtatatcatcatgtttaaaatgaattgtaaatatcaaaattatacagagagtgagattttaaatgaaatactatatagcatcatataattttcaaagaggaatcatcaaaccaaatacactgtagccctaagatttgaagtgaccaagacaaatcaagaagctctaatgcttctgttacatgtgtctatgtggacagtaanccacttacttgggggatccttttttggagtaaatatagttagatttgtagcctatttttagatatctgagcctgaatagaaagtaatgagatgagatctgtatgttaagtatttcacagaaagattccctgggctaggagtcaagtgttttctttttttaatggaaggaggcatatttgaaggtaaactactgtaaggctgattggagtcttggcaaggttagattgatcatcttagaaaacctgtgtgcagaatggttaggcaatcaaggatatggtatattttgtggacaaccaacctaacatattagcaccagtttggggaatgacttaagagttcactgggctgggtgtggtggctcatgcctgtaatcctagcaccacaggaggaggccgatgtgggcggatcacttgaggtcaggggttcaagaccagcctggccaacgtggcgaaatcctgtcgctactaaaaatacaaaaattatctgggcatggtggcgcacatctgtaatcccagctactcaggaggctgaggcaggagaatcactcaaacccaggaggcagaggttacggtgagctgaggtggtaccactgcactccagcctgagcgacagagtgacactctgtctc

SEQ ID NO: 236960 - DNA, 456 bp, Homo sapiens
tcaaaagtgtttttccatgtttcagagacagaaaaggggagaaaaagaagaagaaaagggagaggaaaaggtaaaagaaaagaagagaatgaattgcagctgaggaagtggaagagcgagaagcgcttccagataccagacttaacaggtggatttttgggtttgctgaagaagaaaaagaaggagaaggagaaggagaagaagaagagaagtgtgattaacaagaaaaaaacttatttgggggctatgaacaccttgaatatttaacagaatatcagctactcatctgtaaccattcactacatagctaaacttttagtaataatgtaggtattctctggccaagagaaagataggatgtgtgtgtgtgtgtgtgtgtgtgtgtgtgtgtgtgtgtgtgtgtgtgtttaacagaagaaaatggaaagaaaataaaataaaggatattttggagtc

SEQ ID NO: 236961 - DNA, 230 bp, Homo sapiens
aaaaaaagataaaaagaaaaagaagtacatgcagacactttggaaagaaagaagtaaacctgtcttcatttgcagacaacatgagtatctctatggaaattactatggaatcttttaaagctaatagaaataaaagtgagctttacaggctctcagaatagtaggccagtatacataaattaatcgtgtgctggacaaaatgaaactatggtgcaaaagcactattttta

SEQ ID NO: 236962 - DNA, 384 bp, Homo sapiens
tggagccaaggctgtctttccagtaggaacgggtgggtggagcagagtgaggtggaacagggattttgtctcatgcgtagacaaaggtggcctcgtacacctccccaggccaggattttgggcggttccttctagtgcctactgttcttaggcacacagggccctgccaatgaccgggggcgccaggggctacaggactgtgcctcaaatgcactgcagcagagactggctgaaaggagactgagaacatgttcaaaaagagagggttaaacccagagtgaattcgattaaatacgccccttcagcacacccacaccatcattagtaaaacctcttctagaatatttgacaatattaaaagccttgaaatttgtaaactcttta

SEQ ID NO: 236963 - DNA, 398 bp, Homo sapiens
cgaggtcagaagatcgagaccatcctggctaacacggtgaaaccccgtctctactaaaaatacaaaaaattagctgggcgtggtggtgggcacctgcagtcccagctactccggaggctgaggcaggagaatggcgtgaacccaggaggtaggcttgcagtgagccgagaccttgccagtgccctccagactgggcaacagagcaagactccgtctcaaaaaaaaaaaaaagtgttatttcaatgtttgatattttaattagtttaatggtcttcccaactcctattctgagacatcagtaattattatccatgagtcccagtcacatgccatcaggaaaaaaggtgtggataggagacaaggtttctggacataacattgatgtaccacttccctga

SEQ ID NO: 236964 - DNA, 497 bp, Homo sapiens
tcaggtgtgtgtgagtgtgtgtgtgtgtgtcacagagagagagacagagagagagagagagagacagagagagcacaataggtaactggagtcctcctatatgcattaaataaactgagttaatagttgtaaagcttgcaacaaagaaaactccagatgcttccctggggagtctgacccgccatttaaggaaaatataatagcagcagttctatcacaaaacctgccagaaagaaagaataacgaaaatcattcccaacccattttatgaagccagcattccctgatgccaaaagcagacaaaaataaaataacactctagactaatatatctcaggagcatagatgcaaacttcctcaaggaaattttaagcaaattgaaaccaatatgcaacatgtataggccaagtgggctttattctaagaaagcaaggaaatggtttcaaatggtttaacatttgaaatttaattagtgtaattcaccataagaacagatt

SEQ ID NO: 236965 - DNA, 373 bp, Homo sapiens
gttattagttcctagggaaactattgggctgctgagagattagtttgaaaggaaagcagaaggcagatgtggctttgtgtgccgtgtcagggatttataccttgacctctgtgctatggagtgatgtcatttctagaaaagtttcaagttacatggttttaaggaaatagtatcatttttaaccagatgctcagtccatcttgaggacgtcatcagaataagtcatatagaggtatttaagatactaggatatatgtctagtgtaatatgcatacttgtaaataacacacacacacacacacacacacacacacacctgcttcatttttgttcccaattacgactagaaagctaattaggaaataaaaacttt

SEQ ID NO: 236966 - DNA, 1235 bp, Homo sapiens
  misc_feature (1235)..(1235): n is a, c, g, or t
agtcattggtcagtattgggtatcatcatgttcttaccatcttttttctggagttttaatagttgttttttaaaaaaatctctgttttaataagccattttgatgtttgaaactaccttggataagcatatcaagacccttcagagattctaaaacatgttcagcactttctggtacaatattctcaaagaaccaggatacatcttatttctcaaaatgaaacaaaaatgtattagacattacccctgtgatttcaagcccacagtctgtcactttgaagtatttgtatccttttacaaaagaaaagccaaatgaagatctccctgaaaaaatattttaatagaatatgtctttatttcagtatcttaaatagtgaagatggagaaatagtcaataatgaagagcatgaatatgcatccaaaaaaaggaaaaaggaccattttagaaatgacacaaatactcaaagtttttatcatgaaaaatggatctatgtccataaagaaagcacaaaagaaaggcatggctattgcaccttgggagaagcctttaatcggttagacttctcaagtgcaattcaagatatccgaaggttcaattatgtggtcaaagaggatttaggcagagggatgacagctgcatggagatccatttatgacccaagaggtaaagacaagaaaatggggcccagagagatgggctgaaggtcacaatggaatcaaggacagagaccaaaaacgtagctgtcctgacagccgtgaagagcttcttcattacgactttatttcctaagtctataaactttgattttcctctgatgtaaattaagtgactttcttaaatgcatcatatgactttttaaaaaattttttaaattatacttttaagttctggtaaaaaacaacaaaaacaaaaaaaaaaacaaaaaacaaaaaacaaacacacgcagaaaggacagccaaagcagacaaacaaggaatcgaggcggcgcgctcaaaaaaatcgacgcggagcaaaacagacacgcaccaccaattgcagaagtgacgggacacatagaaggagctaataaaaagaaggcacggggtgacacaacagccccggagaaacaagccatcgccgacaggagaagacccacacgtccgggcgatagccgacaaccaccagcaatgacgcgggaaaacaaaccggccggaccacgcaccagggagaatgcggagacaaaataggcggcaatn

SEQ ID NO: 236967 - DNA, 378 bp, Homo sapiens
ggatctttggcggttcaatatgaattagtttacgttttaaatatctgtttttccattatgggtttaaaaattttctgtttttcctatttgttaattatttaattagttatattaacaaagcaatatgtgtctgttgtcaaaatcaaacactgtattaaagtatagaaagagtgaagttcctttttcattttctacctactcctatctcaccccctttctcaaggcaaacactgtttctgtacttacaaagatatggaagatggaattattttctacattgataagttcatactacaaatattaagtaagttacttatcccatttagtagtatttcaagacttttccctgcattcgtttctatagatctaagaagttat

SEQ ID NO: 236968 - DNA, 2419 bp, Homo sapiens
tgagatggagtttcactcttgttgcccaggctggagtgcaatggcacaatctcggctcaccacaacctccgcctcccaggttcaagcgattctcctgcctcagcctcccgagtagctgggattacaggcaggcgccactacgcccggctcattttgtatttttagtagagacggggtttctccatgttggtcagggtggtctcgaactcccgacctcaggtgatccggccacctcgatctcccaaagtgttgggattataggcgtaagccaccgcacccggtccaagaaccagtgttaataaacgtacagtagaagtggggtgggggcagggggaagctactgatcacaaacgagaaactaccacacacaaattaattttacagctttgatttagtctctcgggaccccacatctgaagaggggttaggcagcgaagtgtttcggtatggggcttgaggatagtgattttgggattctgagctactgagctcctctgagactctggggcactgctcacttgtaagcacaagggggctttgcttgacggtaatttaggtcaagcttccttgaatttcgatgaggcagctggagtttcttgaaaatattctcagctagattcagaataattctttctcctcttcgcttttgtggggactttatctcaagtgtctgtttctgtctcactggaagacttaatttaggggtccttcagacccctaaattcagttgaggaaatgacttctgctgcaaatagagacctctgctttatttgtcatggagaacaaggaactcaaatgagagatccaaggcatccttgttttcatgcaaatggttctatcagctcaacagaaggaaatgaaaaaaaacataggggccaaaaaaacagagaagaattatctctgcacacagagtatcagctgatctttaacaatgtcttctaagagctccattctaaacattatcagttttccaaatgtaagcgcatgtgagctgagctagctatgggatatcgcacacttcaaatcccttataaaagtcatgagaaggctgtactccctatgtctcaccagcagacaggccaaatctctgaatttgatgtcctgctgtgaacagccatgaagaacactcttggtttttgtagggaggatttctattttcaattatgggctttttttgggggaagtggggaaagtactgtatccttagatgaccacggttgctgtggccaagtctcaaacacttgtttcagcagctggaacactaaataaatttagtctttgtcttctgggtctttggtaaagagctagttagaatttattcaagacatgagagatatgcctggcacaaagtcagacagtatatattatgggtttctgttgtcccccttgagataaaattacagaagggggtggagggaaatgagggggtctcttggcccccaggactctggtgtcattttctcctataaaccattttcaggactctcaatgacctagaggctctctgaacaggcataggctgtgcctgtctagataggtccccactgctatgttggtaaccacactcaggagatgtgaaatctttcagtcactttttccattattgtattcagtctggaggcttctcacagtcctctgtagggtgcagaaagagaatctctgctctctgtcagactgctaccctgatggggaatgccattacccacagggaagcagcaacacagcattcttacactacagacctgcagcttgatatgtgagtgatttaaaaacatacattttagtacaatgtatggaatggtaagaaaacactggtgggttagacctttggcttacatgcactattactgtgtggccactggttatctttgaggatagctgttcatgccaaagcgttattttaacttttctctattactttatgatctatgaggccatttggggtctctctaagaacacagctcccatttataacactatttcaatagagaataagctctgaaaaaacactgttttgaataaagctcacatttcccagaaaatagccctagtgtgattcaaataggcatggcattgtgtagcgagaagccatgaaacctgtgggagcacgagctgagcacacagggagaaccctgcatttggattcactggcaaagaccaaacttgaagctatagctctgggtacctctcaattatccctactggctgaggcaacactttaatggtagcctgaggcgccagccctgtgagacatttgacaactcacagcacaacaaccctcctatgagcgggattcctcgtctgggcgcagtggctcaagcctgtagtcccagcaccttgaggggtcaaggtgggaggatcagttgagtacaggaattcaagaccagcctgggcaacatagcaagacctcatctctacc

SEQ ID NO: 236969 - DNA, 1306 bp, Homo sapiens
cagtgacggaaatgtgaaagagcttttgtgtgtctcacatggtcattgctcaataaatggcagctactgtttttactcgtaaggtgatgatttggatgcacagaacatagattcccctgatgtctggctaacttatacaccttacattcacacctgccttctgaggtagctgctgttactataccctttccataggcgaggatggcaggcatcagaaaaggccaaccactcttccatagttgcacagagactaaacatgggagcctggacttgaacccaaggctcactgtgagtttggggccatgcatccttgccccttgtctttgggagacctccacgtaaaggctggcaaggcagatgtgtggaaatttggaagttggtggctgcgtgctggtgcagtgcctttggaggtatttcacaaaccattagcagtgtcagtccttgggctgggggtggcattttgtaccggattcagtctctgcacgataaaccatattgccctgttgcctgccatcagggaaaaggaggttgaaagccatgggaatgaggattcttaatagttataggctgcttgcctctgtctgccgtttagtctaatctcaggttcagttgatactattgattagtctcttttcaaaaccttgtgaggcctatggggcttctctgtgtggggtaaaatggtattcttctcatatgtgaattgagaagaaaaggtgaaagtatacaattaatttgcctgcactttcttgtaaattgtatgctggatttctgtgaaatgctgtatggaacaatattccaagcaaattattgttatttactgtgacttttgcctgcatatttaaagtcaacaattatgggtttttttttttcttcttaatggcctttgtacaacatttttagaaacttggtcaggtgtcactaagaaaacttgtgctttggctctgggatttttgggaaacaaattaacaatatcaaaagtaacaataaagtcttgtttccaaaagaaataacccaatacaggccggcctggtggctcatgcctgtaatcccagcactttgggagactgaggtgggcggatcaactgaggtggggagttcgagaccagcctggccaacatggagaaaccctgtctctactaaaaatacaaaattagccaggcatggtggtgcatgtctataatcccagctactcgggaggctgaggcaggagaatcacttgaacctgggaggcggaggttgcggtgagccaagatcacgccactggactccagcctgggcaacaagagcgaaactccatctcaaaaaa

SEQ ID NO: 236970 - DNA, 411 bp, Homo sapiens
cacctagtcctctgaaatttctaaataagccagtgctgaaggatctagcccaacttctaccaaactttgttaccttttccccttcagtggtaggaatagacatgatttatttagcaagggtgagtgcttttgttgaattttagtttggggtttattattacacaaactaaagacagcggggcaatttggaaagataactaggcagctgcatgacttcaggcaggtgtcctaacactgtactcttaaagtgaggggagtgaactggaagatatcctgtgtcctcatagtttgaacattctgtggttcgctcatcaatatgactacactgtatagtcatagcacacatttgaggtcttgaagaagagagatgaggcttgttctaaaaagcatccagagtaggtcttgaaaaag

SEQ ID NO: 236971 - DNA, 473 bp, Homo sapiens
agggaccaaaaggagaaatattttggatttaaaaattaacaagactgtccaacaaatagaagatacagagacaaatgattcaataaggcaagggtcaaaagacttgaacaggcacttcacaaaagaagataatgcccaactaagcacatgaaagagtgttcaacattaaatatcagggaaatgcgagttaaaactacaataagacagcagttcataccccttagaatggctaaaatcaaaacaaatgatcataccaagtgctggtgggaatgtgaggaacctggaactctcatgcactgctggtgggagaggccaatggcagaaactctttgaaggactctgagagtgtcttataagtgtacatctaccctataagcaagcaattccactgctaggtatttgcccaagaaaactatgtttatacagacttgtataagaaaaatatgttcccaataaaattgtaaagaatgaaa

SEQ ID NO: 236972 - DNA, 215 bp, Homo sapiens
ctgcttttaagttaccccggcgggaactgatataagcagattgaggtataaattttaatttttttgtttatcttactgctgatatgtttcctaggaaagggtgaattgttttcatttaacagtaaaaccatcattgtactatgaaatctaatgaagccttgtttatcttgtttttaaatatttttcatgtaatttttggtactattttgaaatca

SEQ ID NO: 236973 - DNA, 218 bp, Homo sapiens
ctcctctctactcccctgcaaaacttgcctttcccttaactattcctacgctattgggctgagctaacttttgaagacatttttggctacagtcagggatttccaatcttctggcttccctgggtcactttggaagaagaattatcttgggccacacataaaatactctaacactaatgatagctcaggagcaaaaaacaaaaacaaaaaaaaaaaca

SEQ ID NO: 236974 - DNA, 242 bp, Homo sapiens
ttaggggaaaggggctgggaagaatggttgcaatattccatacttatcatggaaaacatattttcactaagacggaaatctttgaagcttctttgttctgttttgctagtcatacctccatgtattcattattcctatctcaaaccactttaattcttggcccagaaactacttttaatttaatagacatggcaagtggcctgaaaaataaaagtaattctttttttccataccatatttta

SEQ ID NO: 236975 - DNA, 337 bp, Homo sapiens
cacactgtcttaattactgcagctacatccttaccctttaagttgagttatgtgggctgggcgtcgtggcacatgcctgtaattccaacaggccgaggcgggtggatcacctgaggtcaggagttcacaaccagtctgaataacatggtgaagctctgtctctactaaatactaaaaaattagccaggtgtggtggcgcattcctgtaatccgagctacttgggaggctgagacaggagaattgcttctacctgggaggcagaggttgcagtaagctgagattgtgccattgcactctagcctgggcaaaaagagtgaaactccatctcatcaaaaa

SEQ ID NO: 236976 - DNA, 1796 bp, Homo sapiens
  misc_feature (1203)..(1203): n is a, c, g, or t
aatcaaacatagacaaatgggattacattgagctaaaaagcttttgcacagcaaagaaaacaatcagcagagtgaagagacaacctacagaattggggagggggaggaatatgcaaactatccatttcataagggattaataaccagattacataaagacatctaacaactcaatagcaaaaagccacaaataatttgatttaaaacagggaaaatgatctgaatagacatttcacaagagaagacatacaaatggccaacaagtgtaggaaaaaatgttcaacatcattaatcgtcagggaaacgaaaaccaaaacctcaatgagatattatctcacctgttaaatggctactttcaaaaacacaaaaagtaataaatgttggcaaggatgtggagaaaggggaccactcatacaccgttgctgggaatataaattagtatagccactatggaaaatagtatggaggtttcccaaaaatctgaaaacacgcctaccatatgatccagcaattccactgctgggtatatacccataagaaaataagtcagtacatcaaagagatttgcattctcatgtttataacagcagtattcacaatggtcaagatatggagtcaatctaaatatttgtcaatggatgactgttaaagaaaatgtgatatgtatacacagtggaatatcattcctccacaaaaaaggaataaaatctgtaatttgcagcaacatgaatggaaatagagtcattatgttaagtgaaataattcaggcacagaaagacaagtatcacacgttctcacccaaataggggagctaagttgatctcaaggaggtagagagtagaatgatgtttactagaggctgagaagggtagggagaagggagggatgaatagaggttggttaatggaaacaaaaatatagtcacacagaagaaataaattctaccatttgatagcacagtagggtaactatagtcaacaataatttatttgtatatttcaaaatagctagaataaatgatttagaatgtttccaacacaaagaaatgataaatgtttgagatgatgatatcctaattaccctgatttcatcattacacattgtatgaaaatgtgtcaaaatatcacatatatccctaaatagatacaatgattatgtatcaataaaaattaaaattagaaaaaagcagaagaggaaggcagnagagcccttcagaagtatgtggaggagaaggtgaagcaggagagataaggtagaaaaggagagcagagcagagagaagtgttagaagaactctacctaccatttctatgcaggcagactctagtagctgggaatgacccccaggcaatagccagcaaggaaacagggacttccgtccttccattgcatacagctgaattctgccaatatctttttcttttctttttttctttttttgagacggagtctcgctctgttgcccaggctggagtgcagtggcgcaatctcagctcactgcaagctctgcctcccaggttcatgccattctcctgcctcagcctcccaagtagctgggactacaggcgcccgccaccacgcctggctaatttttttgtatttttagtagagatggggtttcactgtgttagccaggatggtctccatctcctgacctcatgatccgctaacctcggcctcccaaagtgctgggattacaggcgtgagccactgcgcccggcctgatccatgaaaattgagagagaataaatgggtgttttaaacaaaagaaaataaaaattctttatataaaaagcc

SEQ ID NO: 236977 - DNA, 460 bp, Homo sapiens
caacctcaggtcccctggaggagtgttaggtgccgtcgtggtggactgggctgggcaattccctggtctccaggctgtgtgctctggcatggtcaggggaagggcaaaaccatgctgggtgggcttatcctcatgctccctgatcctctctgctctcttttctcagcaattcttcactatcttcttaccacttcaatgtttataaacagactttaaaactcttttgcccagcctttctagttgtccttagtagaagattggttcaaatgcattcattaaccattactggaagtttgaagacatctaccttttacaaccaacatattccttaagctgccgtgtcttttggcattttcagcatgactatatgtttttgtaatgtattatttctaatttgtcaagaatttagacaaatcagagtgatttgtcatactgagccctattaatatttcacaagtca

SEQ ID NO: 236978 - DNA, 479 bp, Homo sapiens
ccgtctccattaagtactaatgatgctttctcgcacatggccgaattttgggagctttgggaaagtgaacttgcttattctacgagagggaaatgaaaaactgcctggttgagaggggatggggtggagagagaagggttcatgatgggagtctcatgtccattgagggatgggtgcagagaaaagttctgggctctgcctcattatttcagagatgaaaccagagactggtgcaagcttgcccagcaagttggtggctcaggcaacttgaaagttggtggctcaggcaacttgaaaactgagttttcatgtcccttgagatctagcagtagctttcctctttattgttactattgactatgcctttctagcaggggatgtggtaagaggagagcctcaagtttgcttcacctggtgcccaggcatgggtggtggttgatagaccaattccaaaaatgaataaactgataactgggaat

SEQ ID NO: 236979 - DNA, 443 bp, Homo sapiens
cctcactcaaatacaaatagacagctgaggaatcatattcaattaagaaagcttccaaaatgaaaacaactgaaatacgtagactataagctagtaaacaatattgtttaaaacctgcagaagaacgagagactgaggagcagaagaaaacttaaaaacgaggctgggcgtggtggctcacgcctgtactcccagcactttgggaggccaaggtgggtggaacacgaggtcaggagatagagaccagcctggctaacatggtgaaaacctgtctctactaaaaatacaaaaaaatagctgggcatggcagggtgcacctgtaatcccagctactcaggaggctgaggtgggagaattacttgaacccgggaggcggaggttgcagtgagccgagattgcaccactgcactccagcctgggagacagagcaagactgtctcagg

SEQ ID NO: 236980 - DNA, 328 bp, Homo sapiens
  misc_feature (26)..(26): n is a, c, g, or t
  misc_feature (31)..(31): n is a, c, g, or t
tttcgaatttggggttggggcccccnccaantgggaaaagagtgagaccctgtttcaaaaaaaaaaaaaaaaaaagtgtccctttgctttactcctgctctccagtgattctacagcatggaataggccactgacttactcacatgtatagttctcatctgtccattttaataattgcaactagagctctttttgaactttctctcttgttcttcaagcatacatcaaacctgagtttagagggtatttgcgtcctagtttcatgagattggcaagtagtttttagagagtatgtttgtgccattcttttctttttccagctgacgga

SEQ ID NO: 236981 - DNA, 693 bp, Homo sapiens
caggtgcccaccaccatgccaggctaatttttgtatttttagtagagatagagtttcaccatgttggccaggctggtcttgaactcctgacctcatgatctgcctgcctcagcctcccaaagtgctgggattacaggggtgaaccactgtgcctggtccctttcacattttttgtagtgcagttatgctggcaactgactttatttggcatttgtttgtatgaataagtttatattttaccttccttcatagttcttttccttgatgggcctattaaaatttttttttcttttgtaagccacttcaccccttccctatgggtttgtttttatttacctctacatggctgactttggacagaaacgttaaaagttctacttgttgttttcctgaagctatgcttctatttctggactcatcgccaagtcacctgaaggcaatacaaatgaagtatctgggccacatgcagtggctcacgcctgtaatcccagcactttgggaaactgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgtgtcactaccctcaagcctggacaaaagagtgagaccctgtttca

SEQ ID NO: 236982 - DNA, 488 bp, Homo sapiens
gcaagctgagcaaatccctgagaacaaaagggggagaagacctgacaagggaggggaaggagtgagtctattccttccttgcacagcaactttaaccccttccatgcctccccagcagcaggagggcaggcagggtttccagacagggggtaatgaatgcatctcaggcatgcacgggcttccaggaactgctgtgccaccaaagccaactttccataggggagccctccctgggagcagccacagctggagatgccatttgtccttcatagacccagactcatggcatcaaagccccccaccgctccacccccaacaaaagccagaagggagctgcattccatccttctgccagtcaggaagctgaagcctagaaatggggaggaacttgcccaaggtaacatagctttcgactcacaggaaggggcctcgactaggacagtgccagacacagaaatgaataaagtgtgttcaatgaccggaatcaa

SEQ ID NO: 236983 - DNA, 709 bp, Homo sapiens
aaacccactgcaggttcaggcgcgcgtggccagcgcattcctagtccgccacactgctacccagacagaacatccactgcttccacattctccccaggctgcaaagagttcccaggagactttcttttcccccctcaaagctgtgcacttgggcctggtttcacctgcagagaagtgggtaatggctgatagaggaagaagcgggtccctaagacagtcgcctctgctccacagtgccatctagaggaaagacaggacatacgctctgagaagcgcaaggctggggtgttaataagcaggcccttgggaaatctggagtgccctgttcccctcattatgatcccgatcccaggcagaaatgcctgtgggctatcactacaaaaggaaaacaaccaaaaatgcatccaggattaaaaccaccgttcaaaagcacatcattaaagcaagctgtgacccagatgtttgttttggtgtgcttaagagtttttcaagcaattgaaaagagtggaaaaagtgaaacaccaagaaaaaagaaaaagaaaaaaaaaagcagagcaaggaatgttgtgggatgattctctgtgagccaaggaggacctttttatttaaaaatctgtaagcttgggtgttgagggagaactactacaaaactagacttgaattatcattggagcaggattttgaaccgcggtgcgcgtggggatcctct

SEQ ID NO: 236984 - DNA, 315 bp, Homo sapiens
  misc_feature (22)..(22): n is a, c, g, or t
gttagaggatccccacgcgcancgcgcgttcaaaagcacatcattaaagcaagctgtgacccagatgtttgttttggtgtgcttaagagtttttcaagcaattgaaaagagtggaaaaagtgaaacaccaagaaaaaagaaaaagaaaaaaaaaagcagagcaaggaatgttgtgggatgattctctgtgagccaaggaggacctttttatttaaaaatctgtaagcttgggtgttgagggagaactactacaaaactagacttgaattatcattggagcaggattttgaaccgcggtgcgcgtggggatcctct

SEQ ID NO: 236985 - DNA, 481 bp, Homo sapiens
gactcggctgatcaaatgcttacttcttatccatctgagcgcaaaagacacaaggtttggtataagaaattctttcaccatcttctacacattacagtgctgaactcctacatcctgttcaagaaggataatcctgagcacacgatgagccatataaacttcagactggcattgattgaaagaatgctggaaaagcatcacaagccagggcagcaacatcttcgaggtcgtccttgctccgatgatgtcacacctcttcgtctgtctggaagacatttccccaagagcataccagcaacgtccgggaaacagaatccaactggtcgctgcaaaatttgctgctcccaatacgacaaggatggcaagaagatccggaaagaaacgcgctatttttgtgccgaatgtgatgttccgctttgtgttgttccgtgctttgaaatttaccacacgaaaaaaaattattaaataccgatcatcatac

SEQ ID NO: 236986 - DNA, 486 bp, Homo sapiens
gaattatgggctaatgttgttaatggactaatgtaaaaatatattgataataaaattttctgttaatttggttttttaaaactttattctgtctcctaagagaactattttgagatttacatatagaaaaactatttcctgcctctccctgatgtaacagaattgaaatactttaaatatgagtttcttaatattatagttaatatttatgaaagaatatttaattaacatacagtatggctttgtttttgtttttaattttttgggtacctttgtcccctgactccactagatattttctttaatgcacagagaaagagccaagtttttccttcctgggtctgtgctgtagaatacaacaggaatgggccaggtgtggtggctcacgcctgtaatcccaacactttgggaggctgagacaggaggatcagttgagcccaggagttcaagaccaacctgggcaacataatgagatctcatctctac

SEQ ID NO: 236987 - DNA, 500 bp, Homo sapiens
cattatccaagtgacacaggaagttgaaccagtaagcaggagtcatcataatatgaaaacgttccctgataaacagacgaataacattaggtttcacttaagcaccctctccacctaacacagacgggtcagggtctttgctggtgacttctcactgcctcttgaggctcatgaacactacacaatgcaggagaagcacaacagaagctaacagaaaagtgtaagtacaaatcctgtcaaaaaacatgatttcataaggtctgtgaaagtgatgttgaaagacctcacaagtcacgtggaaaaccactgacaaatcgggaaccaaaagagattgtccagtgaacaatggaagaggagaaaataaaaataaagaataaattgtcacatctaaagagaattactcgaaaaatcaactgacgaagacctaaaatatgcttttaaaaatgacctagtcaattagtgttgttactaaaataatacttagatgagggagcactttg

SEQ ID NO: 236988 - DNA, 644 bp, Homo sapiens
cggcgcccaggagtcaggctctacccaggtgctgctggcctgcacagctccacagggctgagaagccacagctgggaccccgaggtgcaaccggccccctctggcaagcaccctctgagcctcaggtgattcctgcaggcatccacaagcttcaccgactgagtagctagtgtctgcggagactgccagcctcagccctaggcaaaagcgtgtttccctcgagtgggcactccgcaccgggcttccctccaaggccaaggcagtgcgtgtgggtggcagcagctccacaggctccagacaactcgtaatgaatgatcataggctcttcatgttatcaaataccttagagataaggaagtgaggtccccaaacaaataagccatgcatccagagctggagttttttcaaggctctggggacactgtcatgcagggtgggtatatccctaagttcctggggtgcctacactggggcaggagcagacacatgtataaataaagaaccaaggtagttaaaagttatgacagatgaaggaaatatcataaaacagagagatgtgacaaagagtaactgggagctgaggtgaggggcatattttagctggggcagtcagggaggtcctctctgaggaggtgacatttgag

SEQ ID NO: 236989 - DNA, 469 bp, Homo sapiens
gcgttttcactatagctgtagaagattctctgtgggactgatgccccctgccagactctccatttatctgcttctgatctggattcagtggggacatttctctggccagagggtgggagctctgaagggcccctggggagccctaaaggagcagcacggggggttgtcgggggaaccagagtcagtcccctcttctaagccctgggttggccctcctcactgccacaggatctgtaacacctgctgccatgataaagaagaaaagaacagcactcagaggacagaatacaaggcagatctggaaggcaaagaactttgaacagatctctatctagtatttattaatgcattacaaatttgaaaagcccgtgagatccctgaagggagagaccttattttcctgtgtcctagagcttggcacagtcagtgccaagtgagtgttgaataaatgaaggaatgaataaacaaa

SEQ ID NO: 236990 - DNA, 310 bp, Homo sapiens
agtcacggtggcagcattgagagttggacacccgggtccttgaagtgatctctaggccccagcccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaaggg

SEQ ID NO: 236991 - DNA, 561 bp, Homo sapiens
ttataaacaacagaaatttattctttcacagttctggaggtgaggaatctgaaatcagggtgtgggcagggccacactttctctaaaggctctaaggaagaatccctgctgcctctgcctagcttctggtggaccccagcgattcttggtggtccttggcttatagatgccatcactcccgtctttgcctccatctgcacatcagcttcttcacagcttcacgttcttctctatgtgtctgcatccaaatctcgctttcctttctcttacaaagacaccaagtcagtggatttagggctcaccctaatccaagatgatctcatctcaacttgattacatctgccaagatcctatttccaaagaagatcacattcataggtaccagggtaataattcttccagtttggcccagggaagccaaaatattggatacccctggtatatagctttcaatgttagattatctgctgctttaaagactaaacttgataatgtttaatggtaacattttatttgtctcccagaattctgccatgtgagaggcaaatagtttcaaatgat

SEQ ID NO: 236992 - DNA, 2096 bp, Homo sapiens
tagataggggatagacaaatctcccatgcagaataattccaaacaatttatgtagatatcccactcttaaggaggtatagtataactctctagtccttatgtgtgggttttgtatagtgacatccttccaaagagtacagtatagaaagggggaaaaagaggaactttacagtggaaaaacttgacaaacactactttagctaggtcaaggttaatatcaacagtgataaatcatgttgatagtatgtacccttgatatgatgttatgagaatggtacctttacctttgtggtcttcctcccaacaactcataaaccccgtctaatcatgagaagttagacaaatcccagttgaggagcattccacaaaataccttaccaatattttcctcaaaaccatcaaggccataaataacaagtctgagaaacaataggaaagccagagaaactattacagccacaaggagcattaggagacatgactaaatgtattacggtgttctacagtatgtaaaaagtaaggaaatctgaataaaacaccaattttaattaatgtataatattaatgaaccaatattggtacacttttattaactaaaatccatatttattccgattagtttttacctaatgctgctcattgttttttaatccctattagatggggagcacccacagggcagggattgtgtgtgtgtttcatttacctaatgtgatgccaaacagtaacgggtacttgggaagtatttcttgagtgactactggaaagaagtcttagagtttatagtctgacttaaacttccccattttaggtgagaaaattgcttagggaggcatatgtgtcttctccaagtcccatgggtaattcatggtatagctggtattagacaccacatcttatgatatccagttgctattatctctttgaaactaatgaaccttaattttcttttttttttgagtcagagtctcgctctgtcgcccagactggagtgcagtggtgcgatctcaatttactgcaacctccgcctcccgggttcaagtgattctcctgcctcagcctcccaagtagctgggattacagatgtgcaccaccaggcttggctaatttttgtatttttagtagagacagggttttcccatgttggtcaggccggtctggaactcctgacctcaagtgatccactcacctcagcactttgggaggccagcgcaggtgggtggcttgaactcaggagttcgagaccagcctggacaacatggcaaaactccgactctaccaaaaaaacaaaaattagctgggtatggtgacgtgcctgtgatcccagctacttgggaagctgagatgggagggtcactggagcccaggaagttgaggctgcagtgaaccgtgatggcgccactgtactccagcccaggtgatagagcgagaacctatctcaaagtaaaaaataaagggtaaaattcaacttaagcctggataacagggtgaaactccgtctctacaaaacatacaaaaaaattagccaggcgtggtggtgcatgcctgtagtctcagcctcctgagtatctgggactacaggtgcctgccaccacgcctggctaatttttgtatttttagtagagatgggattttgccatgttggccaggctggtcttgaactcctgacctcaaatgatccgcctgcctcagcctcctgagtagctgggactacaggcacacgccacgacgcctggctaatttttgtatttttagtttgagaccagcctgcccaacatgacgaaacactgtctctaataaaaatacaaaaattggtcaggcgcagtggctcatgcctgtaatcccagcactttgagaaactgaggtgagtggatcacttgaggtcaggagttcaagaccagcctggccaccatggtgaaaccccatctctattagaaatacaaaaattagtcgggcttggtggcacatgcctgtaatcctagctacttgggaggctgaggtaggagaatcacttgaacccaggaggtggaggttgcagtgagccgccaagatcgtgccactgcactccagcctgggcaacagagtgagactctgtc

SEQ ID NO: 236993 - DNA, 390 bp, Homo sapiens
acgaacaacagaaaaaaacctccctttcatagcatagaattgggcagggttggaataaacactaacatgcactactaggagttgattataggtctctgagagccaggagactgaatctgcctagttcaatgtagtgcagaggagtgtttcaggttttgtggatcaggccgtcactattgcaactactcagctctgctgttgtaacgctcaagcagccatagacaatatacaaacaaataggtgtggctgtattccaacaaaacttgatttatacaaccaagggtggctggcttacaggccgtagtttgcccatcttccccctcttccctcccccgccattgtactaccagccaagcacatagtgagggctcaataaagattggtggattg

SEQ ID NO: 236994 - DNA, 431 bp, Homo sapiens
cagtgggtgcaggagaccctgtatggaagcactgatgagttagctcctctgtgcaactaagcacccaccttagataaatcacataaatcacctgttcccactgctccagtactaagcatgagcagtcagggaaagaagactatgaggtcaactatggtttaaaagcacccatgatgcttcctgggaaatgcaaagcttgagctgggccagagtgaatggccaagggcccgagttttctcagcaacaactgctaggccattttatgtgccacggaggttgtgagatgcagcagaaccaaagaggaaggcatttccctgacctaacagcctaatacagctcccacctgcaaagccaaggtgagtcaaaacactgctcttcagaaagcaattatttgaaaagtcagtaaatgatctgtcttgatctgcctttca

SEQ ID NO: 236995 - DNA, 1046 bp, Homo sapiens
tgacgattcaacaagtgaagcaccacaagaaacaccagcaaaagaagaagcagagaggcgggaaataatcttcataacaatagtcacttatagaagacctatcagcaaatggactgtactgttcacatacagatgctcatggtaggatgtgtctaagattccaatggagtgaaattttcctgtggcaggccagatggaactaacctagaagaactcaggtggtggcaggttcaggaggcttaggactcaactcttacttaaactttgattagctatggtgggatggatttgagcagaacaagatgggattgcagatgtgctttaggaggacttgcctagcagatgtagcaaagtctgaaaggaagaatctgggagtccggagtcttaagcctggaaaaccagaggaatcgggcatcattgacagaagtaggaaagtcaagagcaggcttggatgatgcagagcttagttttctgtgtgtttggaatcatcaggcagagaggtctagcagatagctagagatgtgggttagcagagtgttgagggctggagaggaatgtgtgtagagagattaactggagcccagcaagaagtgaaaacatggagggaagagttcagaaccaaggacagagccctcggggcacctgcatttaaagacaaagggtaggaggaagacattgatcaaggtgctggagcagaatcaaacaggtggaagatgagaagtcaagagccatgaatgtttcaaggaggagagcagagctagagaggtggaggaggaccgggattgagaggaggctattgaacttatcattcacaaggtcactaatgaagttcagaagagcagatcaacagagcaatgacagcagaagccagaagagaagagttaagaaagagtagacagatggcagacagcaggtgcaggagaaacaaacagtggcttctccatgctttgaattttcccttctcccttactccctttttttcccctattcttcctttcttttttccctttatttactcattcattcaataaacttttattgtgtgt

SEQ ID NO: 236996 - DNA, 487 bp, Homo sapiens
gccactctggtcctctttctaatactttaaatgatatcatgctccctgctgccaaggaacccatatttcctttcattttgggcacttatctcagtttatatttgtatgttattggtgtgattatttgatttatgtctgccttcactccctaaactgtaaattccactagagctaggactatgtttggtttatcagcacctaatagaatatgtacttgataaatatccactgaatgactcactggataaataaatgaatgcaaaactgcaatctcacattacatccactaaagcaaagtgcagatgaaattctaaattttaaatgtaaatcaaaattaatccatcattaaaaattataggttattcaggtaagttaatagaactcaggatgtgaacagacttttaaaatattttagagtgactcatagaaaaatgatgtactacttataattgcaaagaaataaaaacttaaatgtctaccaattgaa

SEQ ID NO: 236997 - DNA, 375 bp, Homo sapiens
ttggaaagctatccaagctcggcgctatctttaaaaggaatgagttgtggctcctaactagcttgccgaggagagcgtagagtgacacgggacgggggcccagggcactgaggccaagagttcccgagtcacgccagtgctcgcccctttggcctttgcctaaaatcctgcgatgcctcgctgacaaagcacccagtgccagagcctgcggcccagcgaagctgctccctggaaacacacacacacacacacacacacacacacacacacaaaagggggtggggagagggaaaggtttaggtttaggagaggaagccagccagccagccctgcagatgcaaccgttgcaatttgggtctcttctgtcgtcttctc

SEQ ID NO: 236998 - DNA, 634 bp, Homo sapiens
aatttggatcccatataaaaatatgtcccagctactgctcactctgtttttcactttgggtttacctctctagacttaagggtgttgtacagagaatagaaagagagaggggccatttaaacaacacccttaagtatagagaggtacccaaattttgctagctaagactagaaaattcacttcatctcctgtggctagtggggcctccacatacaaggctcccagagaagtcagctgaatgttggcttggagcccaatagaatcacttagctttggtggcacttatttagggtggagggtggggcatagtagatgcaattgaaagcctgagaataatggcataaataagcccatgaaaagatgttcatcattagtcacttggaaaatgcaaatcaaaagcacagtgaggtacttcttttcacccattagaataatcaaaagagacagtactaagtgatgacaaggatgtagagaaattggaactagtgggtgggaatataaaatggtgtagccactttggaaagtagctttagcagtttttcaaaatgttaaacaaaattgtcatatgacccagtaattcccctgctagacttccattcaagaaaaaaaatgaaaacatatgtccacataaaaa

SEQ ID NO: 236999 - DNA, 801 bp, Homo sapiens
ataccaacatttctgctgcactgttttgtcacgcagcctaaccctagtatagtgtggaaaggcactgtataagggtgtgaatacccggaggtggggctctttgaggcctcttgaaggctggctaccccttggtcacacctctgcagtgccaatcagtttgctttctgtaatttgtcccatgaagttagagttctagaccagacttctcagagttgttacttttctttttctaaactgaaactcagttttcactattacctctttataaaaaatatggtctgtttagaaatctgagaaaaatatttcattataaaatattcataaaatttttgttttttgtgaaagttatcatgaccatttgcagtaagaagacctggttgtgctctaaagctgaaatgtcatttaatttcaggtacattcaagtaaactttgcagaaagaaaatgggtttcatttagctgctcattagggggagaaaagtctgtgataggcttttaataatactgaagtttaaaatggacctggaagactacacttctgtttcacaattcttgctgttctcctcagctctttttgatagaagcaaaatcagctttctaagatagtgttgtatgttttttactgagcaatattctgactcggtgtcctctagctcactaggttcttcctgtagtaaagagttataaaagtgaggctggacgcggtggctcatgcctgtaatcccagcactttgggaggccgaggtgggcagatcacgaggtcaggagttcgagaccagtctcatcaacatggtgaaatccca

SEQ ID NO: 237000 - DNA, 683 bp, Homo sapiens
gctgaacatagacccttatcagtagttctgcttttgccctttgccttgtcatctttgttggacccttatcagtagttctgcttttgccctttgtcctgttccctcagaagcatgtgatctttgttctgctttttgccctttgaagcatgtgatctttgtccctactctctgttcttacaccccctccccttttgaaacccttaattaaaaaacttgctggtttgaggctcaggtgggcatcatggtcccaccaatatgtgatgccacccccggtggcccagctgtaaaattcctctctttgtactttctctttatttctcagccagctgacacttatggaaaatagaaagaacctatgttgaaatattgggggcgggttcctccaataagtcccatgagccacttttcaaatgctcaatatctatatgtggctggtgacaactctagttctatcagttttcaggaaatacaggggctaaaaaagcacattaataccaccaaaagaaagcaatcaacaatatccacaatgtggaaaactacagggaaagctacaaagtttcttcaacaaattgcaagaaaaaagatgtggccaagaaccccttgacactcattgaggggttattcctgcagagtcagggggctgccaccaagatgtgaggagagaaaaaagggaggtacaggcc

SEQ ID NO: 237001 - DNA, 737 bp, Homo sapiens
gctgaacatagacccttatcagtagttctgcttttgccctttgccttgtcatctttgttggacccttatcagtagttctgcttttgccctttgtcctgttccctcagaagcatgtgatctttgttctgctttttgccctttgaagcatgtgatctttgtccctactctctgttcttacaccccctccccttttgaaacccttaattaaaaaacttgctggtttgaggctcaggtgggcatcatggtcccaccaatatgtgatgccacccccggtggcccagctgtaaaattcctctctttgtactttctctttatttctcagccagctgacacttatggaaaatagaaagaacctatgttgaaatattgggggcgggttcctccaataagtcccatgagccacttttcaaatgctcaatatctatatgtggctggtgacaactctagttctatcagttttcaggaaatacaggggctaaaaaagcacattaataccaccaaaagaaagcaatcaacaatatccacaatgtggaaaactacagggaaagctacaaagtttcttcaacaaattgcaagaaaaaagaaaaaggagagaagctggtgtaggcaaagctagagggtgtggtggcctctcattctgtggccaagaaccccttgacactcattgaggggttattcctgcagagtcagggggctgccaccaagatgtgaggagagaaaaaagggaggtacaggcc

SEQ ID NO: 237002 - DNA, 722 bp, Homo sapiens
ctttttcttctttagtttttaccaagttgcactgaaaatagctcagtgactaattgcacttctaagagtgaggaccctagttaaaattaactctaaaaatactgaatttttaacctaaaccttttatttctaatcaacagtattatttatgagtaggttatagattactttgaaacggaatgtgtctcagaactttgctatcgatatttttaaggtctggtagggaaaagataataggaatgagatttatcagtgaataggggactgctttcccagtttctcggtcgcactggtgtattcaccatggaagcatcttatgaaatatgtacataaactactaatatcccacattacaggttgactattctttatctgaaatgcttaggacctagaagtatttttggattttggtttttcagagtagggatactcagcctacattggtaagtaaagaatgtgaggtgacaggctgggcgcgatggttgacgcctgtaatcccagcactttgggaggccgaggcggatcacctgaggtcaggagttgaagaccagcctggccaatctgtactaaaaatacaaaaattagctggacacagtggcacgtgccagtagtcccagctactcaggaggctgaggtaggagaatcgcttgaacctgggaggcggaggttgcagtgactcgagatcgtgtcactgccctccagcctaggcaacagagcaagac

SEQ ID NO: 237003 - DNA, 604 bp, Homo sapiens
attgtcacctttgagttgccaagaattttaacaggcacttagagaaattcctttcacatacccgttttagcacggccagttgactccaacccacatggatggtagcaggaggctcaggtgattgcagtgtgattttaattcatttacttgatcattcattcatccatccctccctttactaacttatttgctgctttcttgaattcctttattatcttctcatttatgtattcatttgttaattctctcatttatttacttcctcatttattttttcaggtttttaattacttacacattattcattaattcagtcactctgtcaattattcagttggtaattcagaaattaagtaattcaaataaacttttgaatattgactgaacttgacatcaagtttacaaaataaataaatctgttcttgtcctcaaggaattcacagtttggagaagatggacattgtaaatggatattttgcacagtgggttgaaagtacacaaggaggctgggggtggtgggcagagaagatgcccttgaagagctgccctctgagctgaattttgtagtagaagcagctaacatttatccagcagctgctggtat

SEQ ID NO: 237004 - DNA, 453 bp, Homo sapiens
tatatacacacatatatatacacacacatatatatgtatacatatatatatatatatgcatgcagaggtagaaaaagacttgtctatcccaaataatttagaattctgtagggtaaataaaaaataataaaaactataacacgagaaaatctatatgtataacacaactatttctaaattttaggaagttatcaataatactagtgctctgatgaccaaattataacaaatactttagaataagtgttagtcaagattataattctataaggctagcgcggcttacatgatgtattagaagcttagaagagagaagtgggttctagttgaactcttcacaattgggggttaggtttttttagagggttttgttttttttgtttttttaaacatctgctcatcttaactcataaagagaacaaaggagtcctggaatcttccaattcttaaaaa

SEQ ID NO: 237005 - DNA, 1689 bp, Homo sapiens
  misc_feature (833)..(833): n is a, c, g, or t
  misc_feature (920)..(920): n is a, c, g, or t
atacgactatgactatttctgcagtaattattattgagacttactataataatgataaggctgtatataaattataccttactaaaaatttaaaatctaggaatttactgagagagcataaagtatggttgtaatagagaaaacaaatgattgaaatggcttaaatgcaagcctttaatattaattttgagtattttaacgcaaataaaaccaattatgacagtgtgctcaaattggtaaacaaccaatctgtgactttatgaaaatatatttatgacagtcatacttgccttactcttaagtgtagtatttgtccttaagttgggagcaccataaattaattttaaagcaaaacatatgaccctcatccaatgttttaaatgaattgcttcctactaggaaaacaaaacatctcaggacatcaaatacttctagtaatcaagatgttttgtttaaatttgctaatgtaagcttcaactctatttggttgcactttaaaaaagcatactagaaaatggggaatatttgaaacatgcatttttaaaagctaggtgttatcttactcagaagatgttaaaagcttctttatacattttatttgaaagtaatttccaaaaaagggatgcttggtgggtatatgaaaaggtgttcagtatcactaatcatcagggaaatacatatcaaaaccataatggaatattacctcacagctgttaggatggcttttatcaaaaagacaaaaaataacaagtattagtgagactgtggaagagaaggaaccctcacacaccactgataggaatgtatatcagtataggcattattaaaaacantatggagattcttcaaaaatgtaaaactaagaatactatataatcaaacaatcccacttctgggtatatatccaaaggaaatgaganccatgtataaaagagatatgtactctcccatatccattgcagatttactcacaacagtgaagatactgaaacaatataaatgttcattgatggaaaagaatacagctggaggcatcatgctacctgacttcaaactacactacaaggctacagtaaccaaaacagcatggtactggtaccaaaacagacatatcgaccaatggagcagaacagagacctcagaaataaaacaacatgtctacaaccatttgatctttgacaaacctgacaaaaacaagaaatggggaaaggatctcctattcagtaaatggtgctgggaaaactggctagccatatgcagaaaactgaaactggaccccttccttacaccttatatgaaaattaactcaagatggattaaagacttaaatgtaaaactgaaaaccataaaaatcctggaagaaaacctaggcaataccattcaggacatagggatgggcaaagacttcatgatgaaaacaccaaaagcaattgcaacaaaagccaaaattgacaagtgggatttaattaaattaaagagcttcttcacagcaaaagaaataatcatcagagtgaacaggcaacctacagagtggaagaaaatttttgcaatctacccatctgacaaaggtctaatatccagaatttaaaaggaacttaaacatatttacaagaaaaaaaaaacaaccttatcaaaacataggcaaaggatatgaatggacacttctctaaagaagacatttacatggcc

SEQ ID NO: 237006 - DNA, 4077 bp, Homo sapiens
  misc_feature (1363)..(1363): n is a, c, g, or t
  misc_feature (1622)..(1622): n is a, c, g, or t
  misc_feature (2617)..(2617): n is a, c, g, or t
  misc_feature (3454)..(3454): n is a, c, g, or t
  misc_feature (3745)..(3745): n is a, c, g, or t
atgatgttttgtgtgtgttttaattctcatctatgacattggaataatgacaggacctacctcatagaattgtgaagattaaatgagatattataggtaaactaattagaacaatgtctgacacataataagtgcccttaagtgttaaatgagaatgatgttattgttttgtgttacagaattagtgtatctgtggaaaattggccaaaacaaattctgatggatcttctttattgctgtttaaatatttcagacaaaatgaaatataacctagaatatgaacagtgctagatatgcatacttgaaacaaaaatcatcatggtcatttatatatttctattttactaagatttttttctcttataaaaataaattataccttctaatagtaaggaaattgcctctgccagtttttgttgtttaatttgttttaatttcaaacattaaaatagcacattaattgatcaaggaatctcaattactttcaaatgctgcaaatatactaatatttattcatggcagtcacagcaggggtagagggacaggagacaaccatcttctagaggaagaacttttaaaacaattatattaattccatttataggaaaaagaataattcatagaaaaattaatgttgcagttcctaaaagcatgttccagttactattcccaaaacaatgtgtcagattctattgtattcattggctattagtcattttggcagcttgggctatgctgccactaacagtttcatgagactagcatactatcttctagtttacacaaaattgtgtagataccttgtctctctatcagactgttgctccttgaaggaaagcgttaaccaagcctgttctgtattccccatatccagtatggtactttgtccatagaaagcactcagtagattccaaagggatcatacaattttagagccacaggagaaaggccttcattagatatgggtaaattcattgtgtaatgtatgaaaaaaatatatactaactctacagtaaaggaatgaaaaaagtctggaaagatgcttttccccatgaagcctgctttccctttgctcctttgcagtttcccaatcttgttcctcttcctgtcactcatggtgctaacacagatgcctcaggacaccgcttggctgggtgcatctacaggtgttccctgcgtatccgaaatggccttattcagcagattctcttgcttgtgtacgtccctgtctctccctctaaaccggagccctgtgaaggcagaaatcattcttgtcttgtgttgcattatttttgtctagtgtgtagtggtccggtgtatatctaaaaaaaaaacactcatatatagtaatgattgaagtaantgtctagctctgctgtgggctagctgtgtgatttgggggaagtccgttagcctctctgggcctctgtccatctctctataaagagatgaggctggacctgatcagtgtttgaaatgaggtgatccatttgctgattctgatccagaacggtgtttttatttttattttttcttgtttgtttttacagagaagcgtgtactcccattttgctgcaagaccccctttcaactttcacctttgtgttcagtgttatcctccnagctcctgaaggcactctggcataggctgaagctttgtgttacctttctgttctaaaatttggagtctgtggttttaagacatgcatgatttcgtgcttcacctccatttacttacaagcaggagctttcatttacattgtcttgtcgtcttgagtatcatttgttttgactctttctacctggcaaagcttttggatttcaaagctcacaaattcctgctgttggctgtgccctttactttaacaggggtgattatatcttctctctagatatttttattagcatcctacagggtgtgaatttttagcattatgttgaagataaaatgaatagtgggaaaacaacatctttcggaatatatatccacacatgaattttagaaatcctattactaatttgaaattatttattttcctttctatggattatacttatgagtctatgttggttatggagatggatgaatacattttgattctgaacttaccagcaaaattcataagtaagtatacatatgtactatagacatgttaataactttatttaattagttataccccaggatttttttttccagggcaaaaccaatataaaaatgggtataatcctcagtgaatctgttgtgtgaggtctgattacttctatgacgtggcattctataaatattgctgcttattagattgaagtatagttgacatggacccatatttagagtgggccataacatgcctttgttgagtaaaaatgttaatatagctagtagttatgaacagtgagatgaacttctgctatttttgcactcaaaaaaagtaagaaatgtaaattttgtgagtgtgttttctgtgctgagtagaatagcagccattacattgagagataggtgaccgtttggctgattattgctgcctattttagaacattctgtatggttagctacttgaagcatagattcacaataggagcaactttcaaatctagtagaaacccgtggganatacacatgggcctgttcaaataattgaactcccttccacttatgactatcttatttgccacttggtgcagccctgaagattgtacaagctgtgaagaagccacttggatatggtctggcagtctcaaagcaatcatttcagcttccgtcacagtagacctactttatggagcaccaaggggcactgtcattaagaatactaaggaagtaattgcttgtacatggccctgagtagttccttcccttctatatagtttgcatgcttttacacagttattctccacgttgttatttcagatattaggagatttgtggtcacaggctaaagatgaccttattatacaacaatctgacgtttgaagcagcagtatctagatatgtcagtttcttatatatagctttgaataagtgtttctgctttggaagaagctctacctatctgatacatctgtaaatgtggcaagttaaagattaccatggtcaatacagtctttctccatctttggtcttattaccctcaccctatgtcaagtgctttatctcttttggagaagggagcctgagtttactgaggactcaatgtgcttgctatcaatgcctactcacttaaaagacatttattattacttcatagacaaaatttattgattaataaaatatctgaaatgaataaggggcattagagaagacagttctgattcaaatttatttttccccttattttctgtaaatatattttaccttattaaatgtgtgtgagtacataacaatgagaaagagaatgaatgagaaaatgtaggcacacactctctcagaataaaatcttgctcttgtgtntgattttgttctgatgccagctatctgggtttgaaaaaaaagtttttagtgccttgttaattatgtgttcaccattattacataagtaattaccttatgtaataatattaatgatattaagctccattcaataagagaactgtaatcctcaattgcacagacatcctcgcctttagatatttattcaaaatttagagaaaaagaaagatacatagaagaattagatatttgatctttgtaaggatttccaaaaaactttttgaccaatttcagccaacattagtgaaacanaatcagtgatataacattgcatggtattaacattgtttcaggatcatgagaaagctctttctgtatcagaaatgcatacctttaaatggaatcccagcactttgggaggccgaggtgggcagatcacgaggtcaggagatggagaccacggtgaaaccccgtctctactaaaaatacagaaaattagctgggcgcagtggcgggcgcctgtagtcccagctactcgggaggctgaggcaggagaatggcctgaacccgggaggcggagcttgcagtgagcggagatcacgccacagcactccagcctgggcgacagagtgagactccgtctc

SEQ ID NO: 237007 - DNA, 595 bp, Homo sapiens
gagatggaatcttgctctgttgtctaggctggagtgcagtgatgtaatctcggctcactgcaacctctgcctcccaggttctagtgattctcctgcctcagcctcccaaatagctggggctacaggtgcccaccatcatgcccagctaatttttatatttttagtagagacgggtttcaccatttggtcaggccagtctcgaactcctgacctcaagtgatgtgcccgcctcagcctcctaaagtgctgagattacaggtgtgagccaccacacccagcctcatttggagttctgagctaaggaatctgggagtggccaacccagaaattcatttcttatttatgaagaacatctgaacctctggctcatcccatgaaacacaggctgtatgaaggatcaaggccctttgttttgggttaagtgaaggttgccaggtggagggtgccatataatttgcatggtttttacaaatggtagtgattctctgtccagcccaccaccactggaccaccctgtatgtaagttccctcaataaaccctatgtcttgtttgctcactccgggtcttttcttcagcccctcgagcatggtgcca

SEQ ID NO: 237008 - DNA, 1793 bp, Homo sapiens
  misc_feature (634)..(634): n is a, c, g, or t
  misc_feature (1342)..(1342): n is a, c, g, or t
  misc_feature (1353)..(1353): n is a, c, g, or t
  misc_feature (1788)..(1788): n is a, c, g, or t
ttttatttctagtttacaataaaagcatgtataatttagtataaaattgtaaatgcttcataggtaaaattttaagtgtaatattaggatagggcagcatctgagcaagaataataaaacttggtattacaaagctgggcgtctggacatgtcctgatgagctcatcatgtgccatctgcttcaataattctggccaccagcaaacatattttgccagtgagtactgtacaatcctacctatagttggttgactccttttttatgaatatttctacctggctatggacaacactatgacatgaaacatactagcaaactacaagttgtatattttaatagcacattttaaaactgaaggacaattaggagtcaattaagtctgcattgcctagattgtttccttcttcattcttttcaccttttgtagtaagaactgagaaaagtaaaccaagctattcccagtagctttccttaaatgtggtgacccatctgttgccatatgctaggcatctgcttttatcaccctcatttgtggtccttcaaagctagaagtgatgaattaacatcaaatttatgctaatctgtggtaggagagaacagctatttgcaaactatttaatctggccatagtcnttatcagatataaggaatacaggacaataggaatagaaatcagaaatatttttttgaattagtgcatgacttttaggtaactgtagcacctctatggttgtatttctgtatcagcaaaatgtgcgagtgacccttgcttgcaaatatttgttgattttacacccaagtgactacaatatccaatataatagggtagaatcattcatgaatgctcatgcaggtcagtctctgtttaacttcagttgtagaattgcttctttcttgaaagattattctttttttaatccagtcctaaactgtcatcagaaaatgttcatagaatatgaaaggccaattctacactgaccagaccataataaaaatattttcctattatttagtattgcggaaaaaagggaattagaatcagaacatcaagatatttgtcccatttctagcactaagtggtgatacaattttggccaagtcatcaagcttgtgtccacatatgtatcatagaacgcagtactctgactccaaaattaactatggtttcttttagcactagaaatctctgattcctctgtctgtctttagggtatattttcactgtggcttggaaatcataacttatgcatttatcgacacagttttcaatgcacatatgtaatttttcagagtaatacatataatatcagtgatatttacattgaaataacttttttaaantaaaaattagntaatgtgtattgggcaggttttgtatgctaaaaccatatataaataatcattttgaacaagagaacaaccagatcattactgaaaacaaattgtcagtttaattaacctacttaattacattatatttcaacatccttgaatgtggaagacattttaaaaaattaggccgggtgtggtggctcacgcctgtaatcccagcactttgggaggccgaggtggatggatcacgaggtcaggagatcgagaccactgtggctaacatggtgaaacctcatctctactaaaaatacaaaaattagccaggtggcaggcgtctgtagccccagctacttgggaggctgaggcaggagaatggcgtgaacctgggaggcggagcttgcagtgagctgagatcgtgccactgcactccagcctgggcgacagagcgagactcngtctc

SEQ ID NO: 237009 - DNA, 410 bp, Homo sapiens
atttctttcctcaccctcccctcccggtgttagctgttagaggtctaagatatgtgcttcttggagatattcctaatttagtttggatttctaaaatgtcccacccagccgggcgctgtggctcatgcctgtaatcccagccttttgggatactgagatgggggaatcacctgaggtcaggagttcaggaccagcctgaccaacatagtgaaaccccatctctattaaaaatacaaaaaaaattagccagtcatggttgggggggaggggggcgccataattccagccacttgggaggccgaggcaggagaattgctggaacccaggaggcagaggttgcagtgacccgagatcgcaccactgcactccagcctgggcgacagagcaaaactctgtctcaaaaaaaaaga

SEQ ID NO: 237010 - DNA, 1828 bp, Homo sapiens
  misc_feature (164)..(164): n is a, c, g, or t
  misc_feature (329)..(329): n is a, c, g, or t
  misc_feature (615)..(615): n is a, c, g, or t
  misc_feature (627)..(627): n is a, c, g, or t
  misc_feature (1758)..(1758): n is a, c, g, or t
aaaatttaaaaaaaatgctagagttagaaaatcatttttgtggcccggcacggtggctcacgcctgtaatcccagcactttgggaggctgaggcaggcaaattcacaaggtcaggagctcgagaccatcctggctagcacggtgaaactctgtctctactaaanatatcgtactatgtctcacattgcttacttcatacatttaagaagctgtataaatatttttaaaatagtgacatgcaatgatacattataaacataacatgttgactaaattattatttacctagagcagttgcctcattctacacagtgctttttaatgccaanaaatgtattaataaaatattaaagtccaaataatttaagcatagagtaaatcatataatccacttttatgtcaattattatagtaccattatagtggtgagacggctacatctatttacagatatcaaactagctgattatgctttgatgagctttattttcaattttatactttattaacttaactgcattcactcgggcctgctaatctagcaaactgataagaaaggtgtgtttaaaaaaacacttttccatttctcaatcttgtggcaaaaaaataaaaaanaaaaaaaaaaanaaaacaccttttagcatactcctattttacctaagaaggcttcaaaccatcttaatatttataatagttccactgtattacataaatagcagttatccaaagaattttatccttaactttatagaaggctatattcttgacagagatgcctaaaacaaaagtgacttactcttaaaaagaatgttatgatgaaagccatgtttttaagcaagggcctgatgcctaattttatgtagaaataatataaatgccattttaaacaacagttacataaaaatctttccaaaagaactaatagggtcgagcacagtggctcatgcctgtaatcctgatacttttgggagaacaaggcaggcgatcgcttggagaccagaaattcgagactagcctggtcaacatagtgaaataccatttcccgtaaaattttacttaatttagcagataaaattccaaagaaaatgtaggaagatcctatctttctccttcataattcaagttcatattacattgaaacagattagaaggtgatattcatcaggtcatggatgagtgtgatgttgatcctaggaaaaaagttacaacttacttatctaaatgggcagtatggcatgggtacttagaaggaagtggtaacttttaggagaaaatatgaattcaccaaaaaactatgtcagactaaggtcattcttttctttgaaagggaccacgaaatttttgtaaattttgttcactatgctacaaagcatttgatgataaacaaaatcagggtttctgccctttccatgtaagagaccaaggctaatacagtctagggtctaccttcacacctctgtgacaggaaagaaagacccttccccacaccagctccagcagaaacatcccaaaagaggactctggcccagtatgcatcaggttatggatactgtcagaatgccaggtctactaccagaaggaaatgtgtgaaaagatgctggtaagttaaaaatgagagccaatacaataaccaaagggtgtcaattaatagaaagattatagtggtgtaaacatactgttctatactcagtcctgtccaatcagttttttaagtttgttaggaaaacatacagaaggaatagtaattaattgtgcagntcaaaaagtttcagagggaagaagtaatgtgcccaaccaaaaataagtataaagacctgcacccaggttt

SEQ ID NO: 237011 - DNA, 269 bp, Homo sapiens
gctgtggagaaataggcattcgtatacatttctggtaggagtgcaattttgtgaaactcctaaagggggaaattgggcaacatcaacaaaactaaatatgagtatgacttaaccattccaataggaatctgcacaaagacacaattccaacatacaagacaacatatgtataaggttattgtgaaattattgataacagcgaagtacttgggaaaaggcacatatacattaatataggacagattgaatagattataatgcatccacac

SEQ ID NO: 237012 - DNA, 173 bp, Homo sapiens
acattgcctttacaattcacttacagtctgtgaggccaactttgttgtcaggccagattataatcaagctattctttgttgaaccaatatgccctctcagggaatgatcgtaatcaatcaatggttttaccatttaaaaattccctatcagggagtttgaattatttttcttc

SEQ ID NO: 237013 - DNA, 482 bp, Homo sapiens
gccagacataagttctgtgctctaccaggttgaagagtgcctcctccccaaagattcccgtccagtcagaaccttagaatgtgactttactgagaaatagtctttacagatctaggtagttgaggtgaggacatattggataatggtgggccctaaatccaatgactagtgtccttataagagggagatacagacacacagagggaaaaagtccacgtgatgacaaaggctgagattgcagtgacagagtgataaaccaaggactgtcggcaaccaccagaagatgagagggaggcacgagacagattctccaatacagcctccaatgaaaaccaatcctaacaccctcttcaattcagacttctagcctccagaactgtgagagcatacatttctgttgttttaagccaccaattttgtggaatttattatggcagcccaaggaaacgaatacaagggctaactttaaaaactggatcttc

SEQ ID NO: 237014 - DNA, 482 bp, Homo sapiens
cagcctcacaacctgcatcatgcaaagccaggcctctttgcttagtttttctttagtataacctgtgtcactttgcactaccaaagttatactggccattctctgagttctggctgatgccttgctagttacactgagagtggtgaggtcattgtgggaagcttgctttcacattgcatagacaatgttaacctggtgcagtcgtcacgcctgttatcccagcactttggaaggctgaggcgggcggatcatgaggtcaggagtttgagactagcctggccaacatggtgaaaccccatccctactaaaaataacaaaaaaaaattagccagcatggtggtgtgcacctataatcccagctactcaggatgctgaggcgggatagttgcttgaacctgggaggtggaggttgcagtcagccgagatcgcgccgttccagtccagcctgggcgacagagtgagactccatctcaaaaaaaaaa

SEQ ID NO: 237015 - DNA, 575 bp, Homo sapiens
cgagtgaacctgcctaagaatgaaatcttacagggaaacagaggcagtctcaatgatactgcagaaggggaagatatcccatgaattgagaaatatttcctgggtttctactcgattgaaattccaagaggtaagggatagatactgccaggaagacttgggaattcaaaagaggagctctctgagactagagtcacatcctgacacggctcttctccaatgtgctggagtcctcagcatctgctggtcttgattcactgatgggggcaaccagtgtccccttaagtgtccgggcagaaacatactgtaccttggttttagaaagtaggttggcaggcatctttcctcattcccatcaaggagttggtaccttccacagtgtaagttattttctctgttctagagctactacaaagtgctagggaaggaaaatctcctaaagcagtctgtcatcatgaaggccaaattatgtagcagaagagcttggaaaaagattaagacggtggtggggaggacctttgtcctggtggcttgaagccatagggaaagaggttcactaaatgccaacaaatgct

SEQ ID NO: 237016 - DNA, 457 bp, Homo sapiens
cagtccttaaaaatgagaggaacattttcttgcattccttccttcgggaattgtattcaaaatgtaatggaaagtaattgttgacctcctgctttgggtgaaggagactgtaagctggtacttgagaacgaatttgccagcatgtgctgttgttgactgtgtgaatgatggtgccagggaatccgtggcttggtacacactgtttcatccagtggccacgtggaagctttgtagcattgagcagatagtaaaatatcttagaattaatgatctctttggaagagagcccagatttgtatgaaaacttgtttttcctctcaattgttttgtccactgttttcttcattttccttttctctgcataccccccgccccccaacgtgtagctctccatctaagttttggataaactgaagtggcactgtgactttaaaaataaaaaagaaatctacttgga

SEQ ID NO: 237017 - DNA, 2260 bp, Homo sapiens
  misc_feature (1095)..(1095): n is a, c, g, or t
  misc_feature (1156)..(1156): n is a, c, g, or t
  misc_feature (1398)..(1398): n is a, c, g, or t
  misc_feature (1462)..(1462): n is a, c, g, or t
  misc_feature (1496)..(1496): n is a, c, g, or t
  misc_feature (1551)..(1551): n is a, c, g, or t
tccaatattgactgggatgattgttgcacatatctgaatgtatcaaaaatgattagcttcaactaaatgggttaattatatactatgtaaattatatataaataaatttgtataaaaatataaatgaaactattgcctgcaagtagttccagaaagaagttgacacatttcaagaataacaaatgttattaaacatgtgaaattgatgaatgagaaaatatactatttccatactcttccttaaagatgtatcagtccctaatgtatattcctattatggtgatattatttatgctcagtcaatcattaacatatgcttatgaaaatcttattttacttaaagaggaatactttaaataaattttattcaattgccttagaatttaggcctactcctagacaggaagaaagatttccaagaattcacaatcttctaaaaccattacctatatttattatttatgctcttacataaccctcagtagcacattatttttcttgtacaattgatcagatattatttgaaattaaagtgtctgtccctttcagtcagcgtgtttctaaaatatgacaactaatgaaatcgcatagtaaatgctacaaactaaaggctataataagttgtaacactttttcagaatcacaataaaatttttctggatatgctgttgtgtaaggaattcctcagtgatatgtgcatttgaacttcagctaatatttctattctctctgagtttgggaagttatttgaattcccctactcctaggttttttatttatacacttaatattcattgtttttgcccttcctatgttatattttaacgatttattcactcattgttgtgtttctattccaaacgtttcctaggttggtgaaagagttgataactgtcaaaaaaataagcctgcaattggaatatggaaagagcaacggtcaagtaagacaacattttggcaagtgcacatagaactaatgagtaactgttcctggggctctaggactattagcgcagattctagactgagatgggatctgtgtgaagagttaacatttctagtaggcaatgaatcccagcaaggtcattaaaggancttgtctgtttctttgtttttatttaataaaaatgttcttctttggatacttcctgcccantaatgaagcaataaggtgggcttgtgaacatatgtgtcttgtatgcacgctcagcaatgtgccttcattatctaaaaaggaccaaaatctattaacttatactattattcagcatatggttttataagagacaggagagactaccatcagcatttccctgtttgaacataaaatattaattcagttttctttacagaaaatttaagagtcagtttcaaacataaatttattgaaagggttantcttctttgtgaaatataatctgtgttgccaaaaggaaaattcagacattacatccaaaatgtntagttctcagttctggctgtctctaatatatatncatttatcaaaatcagtgataatcagtctgctttaaagggtattttttgaaattnctgatatatcatgaagacaaatatgatggttatcacaacttaaaactaaaacctgtctatctcaggagaagataaaaaatgtatgcaaaatgtaaaaagactggcactcctggatgaattatattattgtaccttagagaaattgtgatactgatgtggttatgcatttcagtaagagaaaatggcaaattgaaattaccaaatattcaagacagttctcggaaatctaaattatattatagaatattaatgtcacacagagcactatttctagaattagtctgtgaaaatgtcttcatttaaattcttaaagccagatataaatatttcaaagtaaggttaaaattcagttgaagagtactagtacgatcccaaaataaaaaacggtaaactgaccagatctaatttagaaggaggcagagctagctgggcatggtggctcacgcctgtaatcccagcactttgggaggccaaggcaggtggatcacctgaggtcaggagttcgagaccagcctggccaacatagtgaaaccccatctctactaaaaataaaaaaacttagccaggcatggtggtgcatgcctgtagtcccagctattcaggaggctgaggcaggagaatcgctggaacctgggaggtggaaggttgcagttagccgagattgtgccactgcactccagcctgggtgacagagtaagactctgtctca

SEQ ID NO: 237018 - DNA, 1727 bp, Homo sapiens
  misc_feature (1027)..(1027): n is a, c, g, or t
tagtagagatggggtttcaccatgttggacaggctggtctccagctcttgacctcgtgatccgcctgtctcggcctcccaaagagttgggattacaggcatgagacatcacgcccagactctttttttttcttaagacataatctcactctgtcgcccaggctggagtgcagtggtgtgatctcacctcaccgcagcctccgcctccctggttccagctattctcgtgcctcagccttgccagtggctgggtctacagcgggggtgccaccacgcctgtttaatttttgtatttttagtggagacggggattcaccatgttggccaggctggtctcgaactcctgctcctgacctcaaacagtcctcacgccttggccttccaaagtgctgagagccaggcgcctggctctatgtctttttttggggggtatggagtcttgttctgttgcctaggctggagtgcagcggtgtgatctgggcttactgaagcatccacctcctggtttcaagcagttctcctgcctcagcctctcaagtagctgggactacaggcatgccccaccacgcccacctaattttgtgtgtttatttttagaagagaaggtttcactgtgttggccaggctgatctccaactcctgatctcaagtgatccgcctgccttggcctcccaaagtgctgggattacaggcataagccactgcgcctgactcctatgtcttttatttctaggtgtgtcccgtatcagtagaacctgactttgacaataacttggaatttgaagaggaggagaattatgtgaagtgaggctgttgtctgactgaaattcctaattgtagggatggtttcatttaagtaattttggagccttacaccaagctccatgctgagggcaggacccctagatgaaccaaatgttgtttcacttactttgttttcatggtttgtttgctttcagtttctatagctttcggtccagcctttttcagatattgaaatgattttcgttttggagaaagaaaggcanggtctctcttttcttgatcctttttctaatctgctgattttactattttgggaataatctcttttgtccttctgtcctctcttaagtctcttaagatgtgaaggtttagccacccatcccatccaaacaagattgggcacagcagcctaaagagatgtgtcatgagaggttttccttttctccacatatatgttagtgaatgactttgtgctcctgtatgttaattgggtcttgtcatgttagcatttagaagttcagacccttcagggattcctaaaccttgggaaaaaataacttgatcatttacattttcgtgaagcagtcttgctctatcattcatactgtgtctccacaagacatttccgtcccttttcataattttagtcaaagccacctagtaacctttaattatataggagagcttgattaagcagtgggtcagatgctctgaaccaccttgattcttagaaggtcatgaaaaaatgttgcctatagttaataattttcttaaaactttattaactatgtaattattttatgagcctctgatgttttagtacgacattccaccagtggaaacatgctcccctttattatgtggcaagaatgataattcgggccaggtgttgtggcatgtgcctgtacttgggaggctggaggatcacttgagcccaggaatttgaggccagcttgggcaatg

SEQ ID NO: 237019 - DNA, 346 bp, Homo sapiens
tcagaaaaaagctagcctccttttcttagcaaaacacattcccagcgtcccactccgttgcctcgataaaatgcagagcctggcccagatttattaactccacagacttttatcgagtggctactatatgccaggtgcacagtactaggagctggggaataggttagagcaaagtagacctggcccgtgatattaaaatgtaatctcgagattacaaaatgtaaaacatatgacctccacccattaaactgtctttgcctaagacaaataattcccaggatcacaatctttatgggaaaatatgtcaagtacttgcaatgtcagacaaatatcttccaattctcaa

SEQ ID NO: 237020 - DNA, 662 bp, Homo sapiens
aaacttacccactcctgtgatagtgacattaatcattcatgagggcaaagccctcatgacctaatcacctctttcaacattgtcacattcaggattaagtttccaacacatgaactttggaggccacatttaaaccatagcaacctcataatatattttaaagcttccatagaatatacttcccaaagaatgaagtcatactgatttgaggcctgaacaaggtcattaggagcaacaaaatgtaagataaaaggtatttcccttgtgcctggcactctccatctcctgttgttttcatgttcccgttgtcttgagcccaaagatgtagcggttctgctttctgtttttggtgtggtgcccatcatacctgtggtgttctctgaacaaaggcctgttcctgctgggcacaaaaattgggctgggcttggggctatagatttcttttggagataaataagcagggtatcttgcatccccttccatttcgcctgtctcaaggaagaggccaagggtcccctctttttgcaagtaaaacagaatgtactttcttaaaacgatttaaatatcacagttgggttcaatttatctacagaaatagacttattaaaaggaaaacttacaaaggagaaatttctaccaaataatgggctccctttttgtta

SEQ ID NO: 237021 - DNA, 495 bp, Homo sapiens
aagtcatcactactagactagttttaaaagaaatgctcaagtgagtcttacatctggaaactataaaactcactggtagagctgaacacaaaggataaaggaaaaggaatcaaaccttatcactacagaaagaaacccaacttcaaaaataaataataggagagtgagtaaagagcaaaaggtgagaccacaatcaataaaatgacaagcacaagtcctcatctatcaataataaccttgaatgtacatttctcattgaaaagatatacattggctgaatggatgaaaaaacaagacccaactatattctgacaagaaactcacctcatctgtaaagacacacgtagactgaaagggaagaaatggaaaaaggtactacatgcaaacagaaacaaaaagcgagcagagtagctataattatatcagacaaaatttatgtcaagaagatttaaaaagagacaaaaaatgagttatataataataaagagatcgatt

SEQ ID NO: 237022 - DNA, 595 bp, Homo sapiens
gaaactctatcttaaaaaataaaaataaaataaaataaatttttttaaaggccggagggactaagatgggagtgggaaggagggaggttccagctcaatcctcaccagcagatattcctgcatcctccatacctgagccttcagaccaatgctccccaggcccaaaggggacctccctttcaagtataaggctcccctaattcctcaccttaggatctttaaggcagatgactgccttaaagaacatatattccttgcagcaagaaaacccaactcccaacaccccacagagtgtggtctggcctggacaagtctgccctaagaaaaaagcgacaaagacccttagtaattgaaacagactttaagtaccataaagatgagctttcaatcattaaaaaaaaaaacgtttactgagccaggcaccaggcctaggaacagagaggtgcatccaggctgccatgttaggtgggcctgggccccactgctggggtcagaaggtattagaaagggtctggtctgctgggcgcggtggctctcacctgtaatcccagcacttagggaggccgaggcaggcagatcacctgaggtctgcagc

SEQ ID NO: 237023 - DNA, 447 bp, Homo sapiens
cccacaactctccattagaaaagaaggtagcttaagatagagaaagaggaacagttgaagatggaagttcggctgtaatttattatactctgtttgtttttgcacaagtatttatcttcttgtttggacttacaaagtcataaaatgccaacgccacatctgtaaatggaattctttagctttgtagtttgatttacacctttctccattatctggtggtggtgttgattcttcttgaatccatatttctgcattgtagaataccatggtcccctttgtggaaagtttcctttgggaaaagattgattttgtgcctcttactgtttttttcaataggtactgaaataaacttactttattattttatttttttgagacaggatcttgcgctgcctgtgatcacaccactgcgttccagcctgtgtgacagggcaagacctcatgcct

SEQ ID NO: 237024 - DNA, 1260 bp, Homo sapiens
cccacaactctccattagaaaagaaggtagcttaagatagagaaagaggaacagttgaagatggaagttcggctgtaatttattatactctgtttgtttttgcacaagtatttatcttcttgtttggacttacaaagtcataaaatgccaacgccacatctgtaaatggaattctttagctttgtagtttgatttacacctttctccattatctggtggtggtgttgattcttcttgaatccatatttctgcattgtagaataccatggtcccctttgtggaaagtttcctttgggaaaagattgattttgtgcctcttactgtttttttcaataggtactgaaataaacttactttattattttatttttttgagacaggatcttgcgctgcctgggctagagtggagtggtgtgatcacagctcattgtagcctcaacctcctgggctcaagtgatcctcccacctcagccttccgagtagctgggaatataggaacgtgccaccacacccagctaactttttggtatagtttgtagagatggggtttcaccttgttgcccaggctggtcttaaagtcctgggctcaagtgatcgtcccgccttggcctcccgaagtgctgggattacaggtgtgagccactgggtccagcctgaagtagacttactttaaatgaggacagagatgactggtgtgtgcagtgacaggcaggagaatgtaacttcccatgctggggtgctggcagcaaactcacacgataacactaacttcctatttggatttggaaactggttcctgtttctgaatccattacagtcctcagaggtttttgtccatggttttgcaaaatgaagtcagaaaatggagctggatgtagagagaacaggaaaacccatgtggctgggtgaaataactgagagtgggttatttagggagtgacgtggacatgccaaagaaaaacagcagagaactgagtctatccacgggagaagagcaaatcctgcacgattcgggggagtgaacattgatctaggcggatatgaagaaaccagggagtgggtgggtgagaatgggaactccttgtcaggaaaaaaatcattggcaatgaagtagaatattctggtcctaaagtaaatcggcaagcccttagaaatatctttttttataatgagttggggggaaaatcttaaatatgtttggcatgcttaaagatatggtccgagagtgtggacacttctctatgtgacaggctcctacac

SEQ ID NO: 237025 - DNA, 364 bp, Homo sapiens
gaggtggcagtgagccgagatcacaccactgtactccagcctgggcgacagagcgagactgtctcaaaaacaaaaacaaaagttaaaaaaaagatttctgtatgggaatattctttccgtgcgtttgtatgcccttgctaaaatgcaggttgcataacagccttaataagaaaattcctaagcctatggaaacttgtgggaggggtgtagtcatgcataatctcacatcgaaatctgccaaggcagtgaatactatagaatccacaacttcagttttcattctgccccacagctcagagctggaaacatatgtgcttatgaatctttgtcaagttaatcactttttccttttgcaccaaaaatt

SEQ ID NO: 237026 - DNA, 506 bp, Homo sapiens
tcttcactattaagctaaaaaggtaatttttctcttgaatgatgtgaagaattgaatttctttcaactgttccaaaaatctattcctgcctgccaccctgtggggcaggcaagatgatattatacatctcttataaaacaaagatacagactcagaatggctaataggatattgctgaggcctgccaggtatcttttggtgaatagatactctttatcttaaggtatcttttggtgaatagatactctttatcttaagatttgttgtggttattcttggtctgctgcccatctataaaaaatttagaatccatcggtaaagttgcacaacaaattctgttaggattttgttggaattacactgaacctacagatcggtttgggaataactgacatctttacaatactgagtcttcccatccaaggaaacagtatattatattccatctaattatgtcatttggaattgtcttccaataaatttttatggcttttctgcaaaaagat

SEQ ID NO: 237027 - DNA, 671 bp, Homo sapiens
atggttagcactttttgttccttatgtaagagatgtttccctaccttgagataatgaagatattctcctacattttatttctatttctaaaggtttcaaattttttactttcacatttaagtttaaactcatccatctagaaacgattttactagatggtgtgaggtaggaatccaatttcaactttttccatgtgctaattgctttagcacaattaactgaacagaccttcctttccctagagatcatcaatggcatttctgttacttttaaagtcattttatatgcatgtttctattttagagctctacagtctattctaatggtttctttgtttataccaataccacactgttttaattactacaaggtaaaattaaatcttgatattgtataacaaatcctttccaccttgttcttcagatttgttgtggttattcttggtctgctgcccatctataaaaaatttagaatccatcggtaaagttgcacaacaaattctgttaggattttgttggaattacactgaacctacagatcggtttgggaataactgacatctttacaatactgagtcttcccatccaaggaaacagtatattatattccatctaattatgtcatttggaattgtcttccaataaatttttatggcttttctgcaaaaagat

SEQ ID NO: 237028 - DNA, 1099 bp, Homo sapiens
catagcacatcagtgaagacaaaaagagttgttactcagttctttaccctagaataaatcaaatcaacaaatatttattgaatgtctactatgtgcaaatagccctggactgttcagcttttaaaagccatccaacttttcacattaacaaatcaaagcattattatttcaagcattgcagaagctgcttccatgtccttaaggtgacaaagcatatgaggactttgcaagtacttggagtaaaggaagagaagagaattcacagagtgaaaagaggagaaagagtgctctaaaatatcaccaatggactgcaacatgtattgaagttagagacaaggtcatcagccaagactggggagaaagggagatgaaaaagcctggagaaagtttaactcatctaagaggctgttaagtgaatcaacaaaagatgccattttctattaagtcatctattttattaaagagttaaatgcaactgttgctgtatatcatgaatttatgaaagatttaggagtgggagttctttttttctccaaaaaaaatgagacaggttaccatctttttatataggagtggtacaaacctcttatttgaaatacccatcctagggtaaatattcattgatacaaataattggtaacctttgttttggcttttggactgtgtctctcaaaggaaaaaaaaaatcttgctgttttcaaaagttaaatagaacatcaaccagggaccatggccatccagaagactgagttccataaaaatggactccccactcccactggaatcctctgtttttgtgtatctaaataaatagacgccttgctcattcctggtattaggtgtgattgagagataactcacttagcggcagcagcagcagcagtttctgtgcatgctatagcccatgctcttgtgagcatcaaaaggagatgaagcctgattaaccattttgaaatctatcggatgagaagtccttacaaaacaacttttatacgctttaattaaaaacgtgttccggcagctcagagctgaatgggcttcagggggagcagggctgagcccgttgctatgacgacaccaaatcttttcacgcctggcc

SEQ ID NO: 237029 - DNA, 635 bp, Homo sapiens
cttgttttcatctgtgcttagacaaaattacaaagtgttcttggttttgtctcacttcactctggttacagagtggccttgtctgatgttggtgttcaataaaatcgtttggtgggtatgtttgcttcagagagcaggcaggactccttctcatccacgaccttatggaggatacactggtataggagtagaaatgttcagttgggataagggtagatgaagaaatagatgacaggtaaaatcatctctctctctctttttcttttctttttttttctttttcagtgaagttagagacaaggtcatcagccaagactggggagaaagggagatgaaaaagcctggagaaagtttaactcatctaagaggctgttaagtgaatcaacaaaagatgccattttctattaagtcatctattttattaaagagttaaatgcaactgttgctgtatatcatgaatttatgaaagatttaggagtgggagttctttttttctccaaaaaaaatgagacaggttaccatctttttatataggagtggtacaaacctcttatttgaaatacccatcctagggtaaatattcattgatacaaataattggtaacctttgttttggcttttggactgtgtctctc

SEQ ID NO: 237030 - DNA, 348 bp, Homo sapiens
tcatatgtgcctttccacatctttttccatgttcatgccaaaatggaaacacattcacacacatgtggggctggtgtttgtttctaccgaaataactaccctattttaaaagtcctaggtggaggggaacaacgcacacgggggcctatcagacagtggagggtgtgaggagggagaggatcaggaaacataactcataggtaccaggcttaatacctgggtgattaaataatctgtgcaacaaaccccatgccacaagtttacctgtgtaacaaacctgcacatgtacccctgaacttagaagttaaaaaataaaaataaaacatccaagtcctatatgtcaaaaaa

SEQ ID NO: 237031 - DNA, 437 bp, Homo sapiens
cttctgcaagaagggagtttcagtgtggcagtgtgagtggcttgtgagggaaggctggagtgctgcacagttacgccctgtgctctgcagtagtgctcttgaatttctgtatggctgatgtaggtcagaccttcagagagtgttatgcctactaatcttaattagtatatcctaatactgattgttagaaggcattttagaatttctagtgcatcacatgtttatgtctaaaaaattaaatctcttttctactggtgttgtccataactaatgcataattaagccatagcagcgagaagttgagcagaaatgaaagcaccatacctgagccaacagactcttccaatgtgagacccagtttacctctggtcacttgatatggttaaaatgtgagcactagaagcctttacggagcatctagtctggtcactttaaag

SEQ ID NO: 237032 - DNA, 1056 bp, Homo sapiens
gtccactagtgcctcatttctttctaaacctcattccacatggcaggggaaggtcttaggaattgtggagctgtggcgttctaagggttctcactgcctacctatcaccagcaagggagtccttgttgccatccatccctagggggtaattttgttccctgaggctgctttctagggacttctggtcgcttgttttatcctggaccagacctgaaagcagagcctgaaataaggccttctatgcacatcatttatgtaggaggtggccctaggaagcaggcccaatgcgccatgggaaaaaccagtaccagggtgttttgctgagttgagcactgtggtgggcagctggacatgagcccactggaatcttctgaagagcccaagagcctcttctcagtattgtccacttgaggattgatagtgagaggcatttatccactggtgtccaacgctcactggttgaggatcaccccagaaagcgacacctcccccacttctagactagcatgtgggtattccaagcaggcttacctcagtgtctcaccccaggcactgcaaacaccccaggacagaaagtgaacatgtgtattgtgcaattgaagcaagacactatcagtgcaaagtgagtagaccctcagatgctgctgggtcagagggaaggcccagggatatgacacaggacacagaggtggcagatacaccacctcccaacatttcctctatcacagcaactagaacaatggcaacaataggggtgggtgtggtggctcacgcctataatcccaataccctgggaggccaaggcagaaggattgcttgagcccaggagttcaagactagcctgggcaacttggcgaaaccctgtctctacaaacatatttgtatgtgattgaacaagtagaacaatggaacggaaagtccagatgtagttctaaatatgtacaggaacttagtataggataaatatggcatcttaaatcaatggggaaaagatggattattcaacatattgtaaaaacttgagaatcacattaaaaaagttggactcctacctca

SEQ ID NO: 237033 - DNA, 473 bp, Homo sapiens
taacaaataattgtacagtgtcacagagactcccagtggtccagggtcaaagggtggagtgagagagagatggagaaggcagcatggtctgcagaaggggcagggacacactaggactctgccatgtacagctctcacgtgtctgtgggttaagtctcttcactttctttagcttcctcatctggaaaatgtggatgctatcactgccttcagaggcattattaggattaaacaaaacaacacataacgaagtgtacctggtccatagcgggtgctgcacagttatcacatccctttgcctaattagtaacaaatctgccagtgggctacagccaagaagcacaccatgaattaagcctagagagctcggaattttacttaagcatgactctgtgcagcccctgggttaaaccaggctgttatgtgctaataggaagtggcatcagaaagtaaacaatcagcccaagggccag

SEQ ID NO: 237034 - DNA, 466 bp, Homo sapiens
gtggaagtgggtaaataaaatctgcgtatgagatttttccatcttatgaaaaatatgcttaaagtaaaaccattccttgtaagtaaccatggcctaccaatgtgtcaactaagtttattacggggaacatttgtagatttattccatgctgaatcttctaactttttattcttatgtgactatatactgaagaaatcctaaagataagcagttttgcacacctttgttactcttattattgtatgtataaaaatattccattttcacgtatttaattctatagttattgattcagaaaaaggataatatgtaacattgtgggctcactgtttttcatgaacttaatgtgctcatgaatcattgaatgtcttctcactgactgcttcttgtgtccaagttattgtgtattattgatccacaatgactttgtaataaaatcagtttttttctattctttatattaatg

SEQ ID NO: 237035 - DNA, 394 bp, Homo sapiens
taactttcttaaaggtaagaacaagcctttagtcttattatttaaaccattattgttattctttactagctgtcttttggaaaagttagtttagattttggaccagattagggtaatttggcttagaagatctcaactgtttggcattatgaatctgtacatgggtagttacattttaaaatagactaggatcttaagtttcgtgcctacagggtagacagttgtctcttattaattagaaactaattagaaattagaattaattagaaattaattaggctagagactgaattggtattaaatgtcactaatcaaacagctcagtgctatgccatggtgatgcctggagttgaacagagtgtgatttccttagtatagcaaccttgtcatcctc

SEQ ID NO: 237036 - DNA, 412 bp, Homo sapiens
cctcatggcaaaggatatcagagaggtaaaagataattgttttgacatatttattatcacaactagcgactctttctgcattcacattggctggtatgcagaaaagggtgctttacaggattcttggaaatgtgtagtggatgctggctctaggggaggcagaatagagtgtgggttctgccatgggtcacatccgggttttaattctgcctctgccacatgaccttgagcacactggaaaaccctattagatgtgcaagaaggcttccccatctgtaaaggtgggtgacttagcaactttagcaatgcttaagtcacccggttgttgtgagtaatacataagttaatgtatgctaactttctagaaagtttcctggcacaaagttgtatttaataaatgatttttaaaaca

SEQ ID NO: 237037 - DNA, 347 bp, Homo sapiens
ctctcgctctgtcacccaggctggaatgcaatggcgtgatctcagctcactgcaacctctgcctcccaggttgaagtaattctagtgcgtcagcctcccaagtagctgggattacaggtgcccaccaccatacctagctaagttttgtatttttagtagagacacttttcgccctgttggccaggttggtctcgaactccggacctcaggtgatctgcctgcctcggcctcccagagttctaggattacaggtgtgagccaccatgcccattcagaaactgctctggcagggaggcccccagcctctgtgagatactctcctggagggcgcatttcagcctaagggc

SEQ ID NO: 237038 - DNA, 482 bp, Homo sapiens
agactaagacaggaacacccgccgtgggcaggccaggctggaaggatagaggactgtggtcgaaccaagaggaggttcaactgtgacttatgccagtgtggtcacgaaggcagatgggttgaactgaaaagggggcaccggttcctggcatggaggcacccaaggtcttaggaggtggatggactgtcacatgggcaaagaaatgtcccagggcaggactgcaaaggccacagaagaataatttgggagagagacaacccatgagaagtcactcagaccagggtcagaaacagaacaggaacaacaatggaaagaggatgacaccattgatgggcacctaggtcaattcaatgtctttgctatagtgaatagtgctgcaatgaacatgcaactccatgtgcctttctttctctgcagccttgcaagtatctgttgttttttgactttataataataagcattctggcttgtgtgagatggta

SEQ ID NO: 237039 - DNA, 336 bp, Homo sapiens
agtgaatacgcattagtcaggagctgggattgcggtgggcatggatggggagaggatagcagggaggcaacggactgaagatcctggcaagagaatggctgacatgagggaactgggctgagctggccagggaaaatgtgaagccaggagggagacaacaaaggaactacaagtcttaaaagaaaaagtggtgctgtaagaataagggacagaaaagtctggaaagacagtggacaaaatcagatggtgagattaaagtttaccattgcagaggaggttcaactgtgacttatgccagtgtggtcacgaaggcagatgggttgaactgaaaagggg

SEQ ID NO: 237040 - DNA, 506 bp, Homo sapiens
tgtttatgactagaattaataagcacttctgccattaaaaggtctatagatcttccaccaaattgtggattcctttccagcaagaggtgagtatttcatgtcttgtgtaatcttcagagtgcctggcaaactgtaaccaagcaatatgataactgttgggtggctgcatgggtattgtttttggtcctagagttctccctgaaacataatacatgtttggtaggatggaaacaaaatttctaatcaatgttagatttgtttctttttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattaaaaactgta

SEQ ID NO: 237041 - DNA, 2181 bp, Homo sapiens
  misc_feature (2114)..(2114): n is a, c, g, or t
attgcagggacagtgtttgagggcagttacagaggatcagaagaaaccgggcaggagcttgactctgacatccaaaagtaacccccgcttgtaacgatggactatggcattggggataattagccatcttcttagaccggcttgtgtctaagcagctgcttgtagtggggcagcgtaggcaggtttttagccaagcgcttcagtagattctcccagtctggataggggagcttgaggggcctctaagcagaagtctggagaccatctcccagcttaggacgtcaagatcaaagcccaaatgcagcgttgccactgctcttcctccacggtttgcccagagctggtgcttccacaagcccaggttgggaccagctttctcctctgagtgagactctgtggcagtccaaggaaaacctgtccatctggaggctgattatagaagcttggccagaattctcctcccctccctttcacttcccaaagacacaggcagcaagtgcggctgcttcccaaggagcaatgaggaggcagtcccaaaggggtgaaggcccaaacctcatctgcccagggggctgcattcacgaggcctttcttacccagctcggagcaggcctcagactgtaacatgatgtttcaggtttacggtgtgagactttgtcagtgtgaaccttgagcagtttggactcaaattgtagcctcatccactgaggcatgtttgtaattagggtctggcttactcagggctttctctggaagttaacaagaactacagagtcagaaaattctgccaggagaaaagtgatgtttaaaaaatcatctaggatggccgggtgtggtggctcatgcttgtaatcccagcactttgggaggctgaggtgggaggatcacattagcccaagagtttgaggctgcagtgagccatgatcacaccactgcactccagcttgggtgacagagtgagaccctgtctcttaaataattaaaatttaaaaattaaaaaaaaaattccctatgagagaaagtacatggactttggggaaggatctgaagtttagccaggttgggacaatttggaccgaatcatttaacttaaccctgctattttcctcaactgtgcttagaaaaggggtacaggacctgatttctgtccttaagaggtttatagtccagctacaccttagcctgggggcagagtttctcaaccttagcactattgacaacttaggcaggataattcttacagtggggggtgtcctgtgtgttgtagcattggcagcaccgttggtctctacccagtagatgccagttgcccctccccagttttaacaggcaaaactgtttccagacacttgccaactctgtgcaggcaggaggggcaagttttcccctgatggaaaaccactgccccagggtttctgcggcccagaactcattgttttcactgatgtcataggagtctggagttttatatcacatgccctggtcttcattgttttatggcatgaacatttcagtgtgatgatggttatccctgaaacagtaaggctgaagttactgaggcagaacaaaccaacccaagagagaccttgttccccatcttcctttagaattcaagtatagattcttttttatatgattgggtaagaccaagagacgtagcgtgagagagaactgtgcacccttaggagtgtacaaatcctttatcaggggtgcagatgcctctgaagtagcaacttcttcaggatcccccctttattctttttctctctcccttttgtatgagtttttctctcttgtatgttatgtttcttgttgcctttagttaaaacgtccactctttatggaaaagtgaaagtcatgtcaggcacttttttccattcttaaaaagtgcctcttccattggctgggtgtggctcatgcctgtaatcccagcattttgggaggccaaggcaggtggatcacctgaggttgggagttcgagaccagcctggccaacatggtgaaaccccctctctacttaaaaaaaaaaaaatcagccaggcatggtggtgcatgccagtagtcccatctactgtggaggctgaggcaggagaatcacttgaacccagaaggcngaggttgcagtgagccaagattgcaccagtgcactccagcctgggcgacagagtgatactccatctg

SEQ ID NO: 237042 - DNA, 452 bp, Homo sapiens
gctgctctgtgtccttagtcgtggatgtcatcctgctggtgggatatctccagcatttttttcctataaaggtagcttgtactgtgatggacagccatataccagagaatattcttaccctctcttcctctgaaaaatcttgaagtgggccaggtgcggtggtgcacacctgtaatcccagcaccttgggaagctgaggcgggcagatcacctgaggccagaaattcaagaccagcctggccaacagggagaaaccccatctctactaaaaatacaaaaaaaaaaaaattagccgggcatggtggcagatgcctgtaatcccagctactcggaaggctaaggcaggaaaattgcttgaacctgggaggcagaggctgcagtgagccgagatcgcgccactgcactccagcctgagcaacaaggaagaaactccgtctcaaaaacaaacaaac

SEQ ID NO: 237043 - DNA, 408 bp, Homo sapiens
aagggagattccatctcaaaaaagaaaaaaaaaagttacctatcaccccactaccaagggggataagccctgttgacaatattaatgcatgtccttccattcttctttcccttaatataagcttctaggccgggcgcagtggctcaagcctataatcccagcactttgggaggctgaggcgggcagatcacgagatcaggagatcgagaccatcctggctaacacggtgaaaccccgtgtctactaaaaatacaaaaaattagccaggtgtggtggcgggcacctgtagtcccagctgctcaggagtctgaggcaggagaatggcgtgaaccccggaggcagagcttgcggtgggccgagattgcgccactgcactccagcctgggcgacagagggagactccgtctc

SEQ ID NO: 237044 - DNA, 375 bp, Homo sapiens
gagatggagtcttggtctgttgcccagaccggagtgcagtggtgttagctcactgcaagctccacctcccgggttcaagcgattctcctgcctcagcctcccaagtagctgggactacaggcacatgccaccacacccagctaacttttgtatttttagtagagatggggtttcaccatgttggccaggctgatctcaaacccctgaccttgggatccgccctcctcggcctcccaaagtgctgggattacaggtgggagccaccatgcccagcctcactgacatccttcttatgcttgcgcttgaactcagcaataagatggttgactatttggttgtcaaagtcttctccacccaagtgagttctctgggtgt

SEQ ID NO: 237045 - DNA, 4396 bp, Homo sapiens
  misc_feature (69)..(69): n is a, c, g, or t
  misc_feature (1323)..(1323): n is a, c, g, or t
  misc_feature (1617)..(1617): n is a, c, g, or t
  misc_feature (3396)..(3396): n is a, c, g, or t
gctccctgcatagtatttcctttcttcaagtttttatttattgtttattttggcttatgctttcttaanattagacacctcccttaaaattctagtaagccttagccaatggttcttttttttttttttttttttttttgagactgagtctcactctgtcgcccaggctggagtgcaatggcgtaatctcggctcactgtaacctccacctcccagtttcaagccattctcctgcctcagcctccggaatatctgggactacaggcacgtgccaccatgcctggctaatttttatatttttagtggagacggggtttcactatattggccaggctgttctcaaactcctgacctcaagtgatttgcccaccttggcctcccaaagtgttgggattacaggcatgagccaccgtgcccagccaatggttcgtatttacagccgattggaaagggcagggcttaactgagaggaagggggtctcccaaatatcatcacttgtccaactaccagtatttttagacccagctggaagaaatgaccaaaaggcttccccatttggcttggaaactttgagcaaatgctcacttttccaacatactgcctcatctctactcatacttgtacccatatccccaagtcagcactttttgggttcagtctctttggagagcaaagttttcttcaggatgctctagggtaaagcagggacagacatggggtgacatggggtgaggaagggatctgaggtatcactctcctgtttctggccctactccataccctgtcttcagatgccaaccatttctcagcctctctgtggttttatagcaggaatctgcccatttctcattgactcccctctttgggagcctctgggtttttctttctctatcaagccaagtcagttaccttctcaagttccaaaattgtactgacatttcttattcgctttcatctcctcccctgcccttgtgggcctgcatcttttttactcctttacttctagtgtggtttggggaggcagcacaaagcaccagagatgttagtccatcatgtttaaacagaagtccctccttgctactgtcattcaaaagtggcagtcgctggtattctccgtttatcataaggtggcttctgccattatgaccaacctcagtctgacatgaaatagtatgtaatgctgacttgccagtgctgtgagaccagcaggggaacctcctggcaagctgagagttgggtgactttgccctcaatagccatcctcattacatttctcagtcatactttactgcattttatgggggaaattatgtggtagtctntaatccacggattcatgaagggctatgatgtatcccttgagaatgtcaagggcctactgtacctctgtcactatggaaactagttccctggtagcaattaggcttagcaacatccacaatggtgcaatgcacatggattctggctctggtaatggacagggagcagtccctggagacagggccacacttaccctaatgacagtctccggggtcttcatccagcctgagcaccctgcatggagcccggcctgaagtgctccagctcagaggaggaggagggagagggtaagcctntttggcccactgaaatctggaattattcaagtgctcctggaatggctttccaaacccagcctcccaggacatctgtcttacggccacctaagagaatgaggtttaaggtggtcaacagttcataatctaccttcaggtgtgtgtgtgtgtgtttaaaacagcctggctcatggtaagtgccttataagtgtttgctattattattactaaaactgtatttagcttggatccatatgaaaacaaatttgcattcctggactctttgaaactcactaaactcaacaaaaaatagtagataagacagagacccagggactaagaactcctggctcattgacccctctttacataatagagaataagccatcatccagatattttgtttattggtttgccccattcactggattggtgaactccctgccaggcccactccttgacactttaccaagaaccaatgagttgatgcctgtaaaggcatctgtgagctgtctctttccagaggaccctcaaggctgcttcttcctggtccagggggtgacagcaggccaagctccatacccttggcttgttcacaggactcctgctcctctccaggtctcccgtccaccctcgtttctccttccagctccaccctcgtttctccttccagctgtccttcctcctgtttatagatgtgtctccatctccccttgccttttctgttgtcatccccatcatctcactttctttcttttcctcctctggactgggagttccttaagggcaggtcttgtttatcttgtcagtctgaacacctagaatggggcctagtaaatagcagatgtccaaaatatttttttcctttttggactgataaatcctctttctttattgccttgcttctgaggtatctgccttgtgtcctctactttctcccttctccccgccttacacagacacacacacacacacacacacacacactctctctctctctctctctctcacttcgtcttagagcctcttgggctgctcttctgcctggctgtgcgtgtgaaggaggtggtgtttcccatccttgggaaagcccttctgacctcagtggtggcagggagaggcctaaataagttgcacaactcagaatgtcaggattgatacctcctgatgagaagcaggcttgttctgtgcaatttccatctcatttgtcttttcatttgtagcttaaattggccaatttcatctggaatgtgcctggactctctggcaagccatatactacaaatgagtgtcccagtagctgtctacagagggactggcaggggagtgggcccaggtcctccacagcagcattggtgacggctcctgggcctctggaagcactaatgcttggaggattggggccgaatgtgatctccccaaggcctgaggaggggaggatggaggaaactgcaatgagagggagttagggctaggtcctgaaaaatctggttgattgattgattgattaatttttttctctctctctatcagaagagggtaaggtacatgggatggaagaggagttgtttgtacttttaagagtgggcagaagtgatacaatgtggagcaaaagaatacaaatactccattcacatgaaattcaaaaacaggctaaactaggtctacgctgctagaatgctgagtgtaagagagccttttagggggctagaaatgtcctacatgttgttttatatcttgatttgggagtggtaatatggggatgttgtataccccatattcaaactcaagttgcccacntgatttgtttgcttcactatatgagttctacctcaataaaaatggggggaaaagtcacaccaatggttttcgaactttcctgtacataagaatcctgtgggagcttatctacaatgcagatttctggccagcctggaatctagttgatctgaagtgctgtcgggaatctgcatctgagtgccccacacccccaagggtgatcttgagacaggtgttccacagaccagaaaagaccacacaggggcttgaacatctgcccagttagatggcctaagcgccatcctgctgggagccatgaggggcagctgggtggctgagggctcccggatgcccttggcagggagggttagaggttgactatgctgcagcatagagaaagtacggtgaggacagcaaaagcggtagcaggaaacgaggggctgctctctgggctaagaaggaccaggacagagagtggatcttctcctcagggatgagaatctctctgagcaaagaatgctttgctgcacccctgcacccctgcacccctgcaccctgggcaccctgccccaggatggctgggcaaacctcatggagtggctttggcacaggaagggtagccactgcagaaagctggaccccagcagatgtggagtttcatggaatagcctgatccctctgcagggtctggagactgacgtgatcagttctgtatctgtatcttcagcaggcaccttctgtccaacaggaagaaggaacccaagactgaagacccacagctaaaggtgaaaccttggggagggtgtagacaacgtggcacttccatagacaaatgccaggatagtctgagcatttgaaaatgtgggcaaatgatgacttgagctgtccttgacttgagggcctgggagagctaggatatagtgagggggagctacatacagggagtgggaaaaggggcaggggcatctaccatatgccagaccctttacaaacaccatcccatttaatcctccagtaattc

SEQ ID NO: 237046 - DNA, 2553 bp, Homo sapiens
  misc_feature (25)..(25): n is a, c, g, or t
  misc_feature (80)..(80): n is a, c, g, or t
  misc_feature (127)..(127): n is a, c, g, or t
  misc_feature (140)..(140): n is a, c, g, or t
  misc_feature (178)..(178): n is a, c, g, or t
  misc_feature (209)..(209): n is a, c, g, or t
  misc_feature (211)..(211): n is a, c, g, or t
  misc_feature (217)..(217): n is a, c, g, or t
  misc_feature (248)..(248): n is a, c, g, or t
  misc_feature (278)..(278): n is a, c, g, or t
  misc_feature (438)..(438): n is a, c, g, or t
  misc_feature (481)..(481): n is a, c, g, or t
  misc_feature (612)..(612): n is a, c, g, or t
  misc_feature (797)..(797): n is a, c, g, or t
  misc_feature (844)..(844): n is a, c, g, or t
  misc_feature (861)..(861): n is a, c, g, or t
  misc_feature (882)..(882): n is a, c, g, or t
  misc_feature (926)..(926): n is a, c, g, or t
  misc_feature (938)..(938): n is a, c, g, or t
  misc_feature (980)..(980): n is a, c, g, or t
  misc_feature (982)..(982): n is a, c, g, or t
  misc_feature (1004)..(1004): n is a, c, g, or t
  misc_feature (1026)..(1026): n is a, c, g, or t
  misc_feature (1099)..(1100): n is a, c, g, or t
  misc_feature (1103)..(1103): n is a, c, g, or t
  misc_feature (1153)..(1153): n is a, c, g, or t
  misc_feature (1182)..(1182): n is a, c, g, or t
  misc_feature (1243)..(1243): n is a, c, g, or t
  misc_feature (1284)..(1284): n is a, c, g, or t
  misc_feature (1286)..(1286): n is a, c, g, or t
  misc_feature (1365)..(1365): n is a, c, g, or t
  misc_feature (1377)..(1377): n is a, c, g, or t
  misc_feature (1395)..(1395): n is a, c, g, or t
  misc_feature (1426)..(1426): n is a, c, g, or t
  misc_feature (1595)..(1595): n is a, c, g, or t
  misc_feature (1640)..(1640): n is a, c, g, or t
  misc_feature (1847)..(1847): n is a, c, g, or t
  misc_feature (1928)..(1928): n is a, c, g, or t
  misc_feature (1987)..(1987): n is a, c, g, or t
  misc_feature (1998)..(1998): n is a, c, g, or t
  misc_feature (2014)..(2014): n is a, c, g, or t
  misc_feature (2076)..(2076): n is a, c, g, or t
  misc_feature (2109)..(2109): n is a, c, g, or t
  misc_feature (2142)..(2142): n is a, c, g, or t
  misc_feature (2150)..(2150): n is a, c, g, or t
  misc_feature (2174)..(2174): n is a, c, g, or t
  misc_feature (2205)..(2205): n is a, c, g, or t
  misc_feature (2211)..(2211): n is a, c, g, or t
  misc_feature (2277)..(2277): n is a, c, g, or t
  misc_feature (2287)..(2287): n is a, c, g, or t
  misc_feature (2320)..(2320): n is a, c, g, or t
  misc_feature (2324)..(2324): n is a, c, g, or t
  misc_feature (2412)..(2412): n is a, c, g, or t
  misc_feature (2429)..(2429): n is a, c, g, or t
  misc_feature (2514)..(2514): n is a, c, g, or t
  misc_feature (2530)..(2530): n is a, c, g, or t
  misc_feature (2547)..(2547): n is a, c, g, or t
accatttaaaatgtacaactcagtntctattagtatgttcacagcattttcatcaccctgaaaagtgaccccacatctcntaggcatgactgcagccttcctccatgtccctccacctacccctgtngtaggcaaccacngtctacttttgtctccatatgtttgcctgttctgcatntttcatatacatagagttatacaatatgtantnctttgngactggctttttcacttagcataatgttttnagaattcatgcatgttttagcacacattcntagtttatttcttcttatagttaaatgatattctattccatggctatactggttttccattcattcatcagttgatggacctttaggttagtttccactttttagctattatgaaaaatgctgctgtgaacattcacttacaggttattatgtggacacnggtttttatttccctgccattggactttatcctcagagttaantgggcagatttcagcacttgtcttgctcatgctatcctttctgccttctcagtttctgttcatctagcctcattcattcagacctggcagacaatttttttgttttcatgaagctttctctgactgttctntcattgaccttatgtgttagcaatcgttgtctagtctgtgctgaaaaacttagtccttaattttacatggcttttttttttatggaagataattttctctcattataaatttgcttaatgggggaataatatataatatgtatgccacctatccttgcatacattgaaaatattttagcttagangtttgtagcatacaattcaatcctttataccataccaattatttctnctttgagaccttgacanagtaaggttatattctaaatntatttttagcaattaaatatcaaatctaacccaattagtctaanacaggagatgcnttcaatcacgtgtttatgtttttctctctatgaaaaagaatntnaattggccttttttcactatgnagccattactgtgtttctggantgctcccagtctgtcagctgaacagttctgggtgcagcttgtctgatgaaggatagcacagcccctcaatctnngtnctcagcagagtgcttgtgaaggcagcaccacagcaacagttgctcagagngaacggattcaggagccttgacttagcantagagtccagggttttcagctcagtgtctttagcctgtctctgctggtcatgtcagttacntactattccatccaggaggtgctatttacattgtagtacananatagtcattgcctaatgagtcatacagagagaaaagtaagttataaattatgtcccccatttgctgcaactctcagtgntaagaatgattnagtgcagctataggagantacttccattggcatgccacctgcgtaaaanacacaattttgttaagatatacaataaaattattatgctaatagcaaatattttatgtagctcactatgttccatgtagtcttctaagtgcttcatgttagtccccagttaaacacctggttttggaaggctgaggcaggaggattgcttgagcccaggagtttgagancagccagagcaatatagtgagaccctgtctctaaaaaaaaaaaanaaatttttttaaacacttagctgaggcatggtggtgcatgcctgtagtcccagctacattgggaggctgtggtaggagggtcgtttgagcttggaatattgaggctgcagtgagcagtgatcaagccactgcactccagcctaggtagcagagggagactctgtctcataaataaaacatgttgtatagattcccatagaagtgagntagatatcagacatagaattattagccactttgatgtctaccttgggagtaaaacatataataaggggcagctttaaaccntctcaatcaatgcctctaacttctcgagaaggttcttatttcatgaatttctaagcaanggactacctgnattaagacatttggtngacaccattttgagatgaagaatcttgaatgggaagaagggagatctctacttactgaagcntcccaatgacatagttaagtgtcccccaaaagnaactttagaacaagatgttcatcatgccatatntctatggnaaaggaaattctttaaaagaaaanaaaggcaaacaattgataatctgattctcangggaangttttcattatcaaagaaaaagagggctgggttccatggctcacatctgtaatcccaacactttgngaggctgagnggggtggattacctgaggtcaggagttcaaaancagnctggccaacatggtgaaaccctgtctctactgaaaatacaaaaattagccaggcgtggtggtgtgcacctgtagtcccagctacttgngaggcagaggcaggagnatcacttgaacccaggaggtagaagttgcagtaagctgagatggcaccactgcactccagcctggatgacacagtgtgactccanctcaaaaaaagaaaanaaagggacaaagtatantggtcc

SEQ ID NO: 237047 - DNA, 313 bp, Homo sapiens
caagggagggcactcatctaagcctgccctccagattccttgtcctgggttgttggacctagagcaaaatgatacaaagtagatggcactagtccattcctgagggttcacttgttcctgatctggttttcatcctgtctcaaaatctggttgtccagccttccaattaattaatcctgtgagttccttaataccttttgaataagtacattaagtaaaccagatgtatttctactgtgcatgaccagaaacactgcctgatacagtaagcagaggtagctgtctctaatagcaacaaataacttcagccaca

SEQ ID NO: 237048 - DNA, 459 bp, Homo sapiens
accccacagtacccttctgaggttaatccgcgttgatagaagcaggtgtggttcatctggaatctgttggtgtgaactgcgcggcggcgtcccccaccaggcaccacagcgggcgcctcttggtagcagccaccggcctcttctgggactcgccggagggtttccacgtcgcccgctccgacggggctgttcatctccccttgatctgtgggactccccgtccgtctcaggtatgacccctttgttggtgatctgggttgcagatatcccctctgtgtctgtggcttgtctcgctgcgttgtttatggtgcgcttttgtcatgcagacgtttctaattttgctctgtctggacttggcaatctttctgttcgtgatttgtgcttttggtgtttatgtacaaactctttcccggtccagaaagcataaaaaagtttgctttgtgcgctgaggtctctaat

SEQ ID NO: 237049 - DNA, 600 bp, Homo sapiens
aaatgccaatcaaagcagtgggatttttttttttaatactactctttactatccaatttagacaatgttagaattaaggttaggcttaggtaaaaaattaagaatgatagaagcaagcagggtagagttcgggtctttgtatactgtcagagtgagacacgtcacaggtattttgtcatctgttaaaattgtacatattctttgacccagaaattgtacttctagaattgtgttctaaagaagtacttgcatctgaacacatattcactccagaagtgtttgaaatggggacaaatgaaaactaaacatttatcaaaagaatgaataaaatatgtaagtccacattacagaatactatgtggcaatttcaaagaaggaagtgcatttttttatatggatgtagtgatctctaaaacatctctccctaatcagccacaaatgtaaaaaaagaaaaataataaaacatatcactaaggaaagagaaacatagtatagcataagtacactatgtagccattaagtcaagtgatgattttttttctatacgaatatagcattagataaatgctgtgtccagaaggttgacatgaaaaccagaaa

SEQ ID NO: 237050 - DNA, 172 bp, Homo sapiens
ttcacctcttctctttcctccttcccactgcctgcaagatgcacatgtgctgctgagccagtttttttgttttagcggttaatgacaggacaagaaacagaagcagctccggtccctagggcaaagtagtctacccaccccaatctacctgcctacctctgaattatttcaa

SEQ ID NO: 237051 - DNA, 542 bp, Homo sapiens
caaactcttcttccattcatctgcagactttcctatctctccctgcagaaacaagcaattcaggatcttatgtgtgatgcctaattaattttaacacagcgaatttaatgaaatcgttgaagagcagggcataacactaggaaggctttaaaatttcataatgtttccctctcatatttgcatctgattactgccaccatgcattctgtgtgtactttatcatctagtcgttattgatgcactttttggaatgtgttctcggttgttctattagcataggttcctctgccttgtcacctaacgtacagttttcttggaagccaagaccatgcatgccttttcttcctcagtgatcctttcgctgcagtaactgctattaaagaacttttaactgcttttcgttaatgaatgcataaaaaaatctctggaatcctacaagacgatggttcttttgttacatgaagaaaagaaaaaacagtagcatttgcaagggccagcaagttaaaatatatgtcattaaaatatgtttctatttcccatca

SEQ ID NO: 237052 - DNA, 454 bp, Homo sapiens
gggattacagcacctggcatatatatttttttttaggttttagttagacttagaacactgtgtcatttcttaccaaagaaattactgtcttgatttcctctcaggatttgagaagcccaaaataataatggtcttactaggccttggtttaaaaaatctaagccagcagactcaaaaaaaaaaaaaaaggcatagaaacttcacaaaacatcttgcatttgtttaacactctgcttcttcagatggcagaatatgtgtcttccattttgttcttgcagtaaactgacaaggcacagaatttaggtatcattacaattgtacccgtgaagaaacagaaactccaaggaactaagtgttagcagttagcagtagaaccaggcctagaatccagccatcttgcttctctggcccccaaaaagaagaggaagcaaatggatggaaaaacaacaacagc

SEQ ID NO: 237053 - DNA, 405 bp, Homo sapiens
tctgaagagtaatttagctgtcacaaatcttatgccatttactgtgtagtgaaagctttcagccctgcctgggtctcttttctgacagtttgttgtaaaatagacatgaaaaccagaggcagctggagttaatgacagcagcaagaagaaacattggtaaggaagctcgcagaagcacaccagcttggtgcaatttagtaaaaagggaaaatgagtagttgatacctgttgtttaactttttattttgaaataatttcagacttacagaaaagttacaaaaaggccagtcatggtggctcatgcctgtaatggcataacttgggctggctgaggtgggaggatcgcttaaagctaggaatttaggaccaaccaccctgggcaacatatcaagaccatgtttatat

SEQ ID NO: 237054 - DNA, 406 bp, Homo sapiens
gaatcaggcctctgagctactgagctggaatctgccttttggccggacccggttgattggaaccgcgttcatttgaggaatgctccctgcgaccagagctccaccaggacactccttccctccgccggccacgtttgcagggagcccctgagaggcagcggcagcccggatgctgaatcccattcgccccggtcatttccggagcgtcttccagcccgttccccgccatgacagcgacgtgtgctttgagctcagtccacagcaaagaccaccttggttctgtcccgccgcaaccacatccgaagaaaggggtcaggtattctaggcgtacggggactgataaattccaaaaatatgttgcctagaaaaagattgttaaaaatataaaggcaagttttattcaaaa

SEQ ID NO: 237055 - DNA, 481 bp, Homo sapiens
gtcaccctgcagaatcatgagagttaataaaatcaatattgttttaagccactatttggtcattttttatgatggagtagataatgaaaacataatgcttctagtgtagcagagaagaacggcattaagtacagtggtaaaatgtgatgagtgtccaaggtactatgagagtatagaatatgtctccaagttgagatgttagtgtaggagttaaccatttataaaagagatgtgggttccaaagtcatgggcttgtgtgagggcaagaaagaaagagtgcagagcttttctaaggagctgacgtaactttagtgccgcctgatcctgaagtgtgaggaagaggaataagatgagagagggaagtattatttagaatgtcataaatatcataaatgcagtggggggcctttgaagcactgtaagcctagaaataaagtaactgattttgtgatgtttcatcttgactgaggtatatgtgtga

SEQ ID NO: 237056 - DNA, 261 bp, Homo sapiens
aaaaggaaaagaaaataaagcattgtaatataaacaaaggcagtctgtactaagacaagcacaggccatggcagctgtgcagatgaaggctgactgcaagctaacacaagaagactatgatttggaagttgcaatggagatattagaagaaacacctagatacttcactagaagtgctgcaaaaatgacagcataaattgtgcaatttcacaaccctccaactcccccccaccgcaaaaaaaaactacaagcatttaacgg

SEQ ID NO: 237057 - DNA, 679 bp, Homo sapiens
gaatgctgcaagctgaggcttggtgacccaatgaccttgtagagctttgcagatgctatctgggaagaaaaaaagctgggaagggagttttattgtgtaggtagagacctccataagggagaagtaggagagacttctaccccccagtccagtgaggaagcaaggaagctctaaatgtgcactaatagaggagtgatgagagtgacaagtgatcagcctttggaatgtctgacatcaaaagcctgtccctcatttggcaccctcatctgcctgcagcccagctgaggacctaggatctaacacaaaagcttagaagtagcccagaaagttgtcttaacactcttgcagggaaacacaggccctgattcttagaagagccttgttcattctgctcaaagctgccttccaacggctgctggggttcccagcacagaagagaaggaacggaccatgcagctggagatcggcctctgccagcagcaggaagtggctgtggccagggaggagacacaaatatataaaagacgggagcagaaagttaacttgcaaagaccctaggtgggcagtcacggggtggagggcagcgctgtgtcacgtagcctattactgtacggtgtgtaatggtcacaaaaatgcccttggccaagaatcaaggttgaatgacgctgagagtcctctg

SEQ ID NO: 237058 - DNA, 512 bp, Homo sapiens
atttacatgctatgggggttagaaaagtagtcacttatgccttactctggcttagtgaaacaatagagcagagaaagccatcagatatgcatttatctcacgtgagcagagggatgactttgagttctgtctgtcctttgtccacaaggaatttccttgtgggcaaatagtgagggagttatatagcttttttttctcttagtagctaccttgtttaggaataaaatgggaggcagctttgcctgaggcagttcccagcttgacttccctttggcttagtgatttggggtcccaagatttatttttctttcacaatgtcctcttcagaactctgagcggggaccagattagatgaagccaggagtccagactaacgattcattcattaggctgggcgcggtggctcacgcctgtaatcccagctctcagaagcaagaggcaggaggatagcttgagcctaggagttcgagacttgcctgggcaatatagcgagaccccgttctccagaaaaa

SEQ ID NO: 237059 - DNA, 416 bp, Homo sapiens
ttgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaac

SEQ ID NO: 237060 - DNA, 234 bp, Homo sapiens
tttgtgaattggcagtagctgcatttgctgacatggtgagttacaggaaatgccatcatgttcctatcatgtgaaacaaagtgagaaataggttcagggtgggaggctgaaagggaggaatgcagacagccccgctccccacacttgctccaaggctgggaggaggaacgggaaggtgtctcccctcctggattcagtcaccttcttctcttcattcccctgcagtatcccctc

SEQ ID NO: 237061 - DNA, 223 bp, Homo sapiens
cagtctgtagtgcctataatattaaagattaatgcatatcttttaaaatagtcctcataagaaaacagaaatgttaattacacttattttaaaaattggaagatgaaattaatgtaaaatatcaaagcagaaattatataaaattaatgaatataagttcaaaacttctatgaagataccaatgaagcaaataagccactgattaaggagaggatgagtagca

SEQ ID NO: 237062 - DNA, 493 bp, Homo sapiens
ctaaggaaagagtaaagaaccagttgcctgtgactctcacacatgccatcatcccaaagcatcccaactcagttgtctcctgaccaggagaaaaaggaactcatcatgtcttctttatttattgatttaaactttttgtatagcaacctgtgtgagcagagcactattccagatgctctgaagagaccaaaaaggggttaaccaagccaggtgcagttactgtcgcctgtaatcccagcgctttgggaggccaaggagggaggattgcttgaggccaagagctggcaaccagcctggtcaatatagtgagactctgtctctacaaaaaaaaattttttttaatcggtcaggcatggtgttgcatacttgtagtcccagctacttgggaggctgaggcaggagggtcacttgagcccaggaatttgagactccagtgagctgtgatcaccctgtactccagcctgggtgacagagtaaggccatgtctctattt

SEQ ID NO: 237063 - DNA, 487 bp, Homo sapiens
agggacgactcaggagagggagtgcccatctcagagcctttcaggaacctggcatttaataaatgcctcctccagagggaaggattcaggcagatcacttctagaaggggtcaccgcctctccaggttctgcatggtccacagcatatgtacagtccccagaagctagactccttccaggcctggtgtggagggaacctaagtgtgtgatggaggagagtcttccacgggctatgaactctttgtaaaaaacaaaacaaaacaaaacaaaaaaacagcatgcatgcgatgctgggggcttaggacaatatcttaaaacagaactgaaacattggtggataaacctcaggacaggcaggaaaagagccgtagctcatccaccatcagcattagcaatgtaatcagacacaacggaaaatcaatgaagtaaaaccaaccagcaggattatgttgttgagcctccaataaatgtcttaagtgtccaatag

SEQ ID NO: 237064 - DNA, 503 bp, Homo sapiens
ttgcctcccaaagtgctgggattataggcatgagccactgtgcccagtctgaacttctatcttctttaagccactaaatctttactttagatacttgaaagtttttgataaatcatgttatgtacacaacattgaatattacacaactcttaaaaagaatgagtcaaatctattgaggtatacatgtagaatacccagatatagtgaaatgaaatgctttacaaaatactgattttatgtgaaacaagtttctaaaaggttgttattgcttgttaccatctgtgcaaagaataaaaatatcaagatgatatgtctgtaagtagataaaatctctctttctggaatggcacaagacactggtaacaggagttgcctctgagcaagagaactgaagagctagggaagggaatgggagagagactgctagctctaggacttttttgtacctttttgtccttttgcatgtattatttaaagtaaataataaagtttaaaaaattaaa

SEQ ID NO: 237065 - DNA, 372 bp, Homo sapiens
attcctagaaaaatgtttcttctccaaattgcatggaattttcttccttgcatgtcactattcttcaaagcatttagcattttggagtgttccttctttttccttgcaaagccaacaatcacagctgaccaggacttcaattcttcaattgattcacgcaggataaaatgacctgcctgtgacttgacgttttattttaaacagcttgtggttgtgatagaacaagaggcccagaccaactcccatcccactgccatgtgatttcctatgaaacagcgatttccctgaacaccagagcaaactatgcgatgataatgctccaagcagatgtttggagaagatgtgggttttcacagcttatgctgtgatcaa

SEQ ID NO: 237066 - DNA, 175 bp, Homo sapiens
ggactttctgcagactggtctcttctaacaggctggatgtccttggggggcccatcctgtcccgagccaacatagcaggccatggacaaaggcgcgataagggactggccagcgtttactatctagtccctcttaggagatggatgaggtggctttgagtgatgggcttccctgc

SEQ ID NO: 237067 - DNA, 538 bp, Homo sapiens
taatttcctcacctgtaaaataaggaaaataacacccaccccaaaggcttgatgtgataattataatgaggtaaagtatttatgatcctagcagatggtgaatgcccagtaaatattagtttctgccccctcctggccccaccatagacgcttgcggcctgagccccactgtctgctaactaataaaacatgagcttggtctttaccatcttgatctccctgttgcttttgtgtgtaggtttttgttttatttaatctttcggacaatgagagaagggaagagaaaagagaaagggagaggaggagggacacggaatgatacaaactcaatttagaactttcctaagtgaaaatgttgcctgaaagagtaccttcaggtgtcctgcctcagttctttctccaagagaaatattaacctatgtgacaataatatgtgtctacagtacactttgggaggcggaggcgggtggatcacctgatgttaggagttcgagaccagcctggctaacatggtgaaatcccgtctctactaaaaata

SEQ ID NO: 237068 - DNA, 413 bp, Homo sapiens
ctgagatgcagtgcctgagaatctgggatccacaatgtgaacttctcaacaacccctgcacctgccacttccctgaatcttccactaagcaccagaagacacatgcattttaaatcaaaggaatggctcccatgcagaaaccagagtgttaaaatggatccctcccaccctgaactctgactggtttggttcacctcaaagaccatcctcctgctatatggtttcgataagtctaaaaagatgagccattcaagccacagtgtcttctatctccaagctggtgagacacactgcagtcctctacagaacagaagagagacagtgcacaagattgctcttgggtaagttttctttttcttatgtaatgaatgggttactcttcagcccttagaataaaaatactataataactt

SEQ ID NO: 237069 - DNA, 302 bp, Homo sapiens
gcgctctcttctcctggcccgcagccgggagccaaggcccgggggtgggcggggaaaggggagaaacgaacaagataggatgaccgcgcagccgacgtagccgcgagggggccggagccacctcaggccctggcctgaaaccctctgaggcgggtggccggcagaagggccccctccaaggtgcgtgcggcgccctacggttcttgtgggtggtttacagtatctagtgcagaagaaatgattaataaatattggctctgtaattctctcctctttgagcattgaataaagatgcatatgct

SEQ ID NO: 237070 - DNA, 551 bp, Homo sapiens
caagcaatggacgctggcctgggtcccatctgcacttgccagtgcccgtcccgtcagcagcagcgccctgctgcggtgatgcgtggagttgcaacagccctggttctggaagggaagcacctccctcgttctcccttgacaccagctcccgtggaggcagaggggaagggaaggccaaagcggcgtcctccccacttggccgccctgccctgcacccatgtgcaggcacctccttcagcattgtcagagtcttgtggactcaaaccaaaaaacgtgacctgcaacggggccaggttcacaaaatgagcccctgagagacagtggagagcggccaccattccaactgacacagtgggagcggcgccactgggtgccagagcccggccgtccacgtgggctcaggtccccactctgtctcttaccagccatgtcatcttgggcaagttgctaaacagctccttgcctcaatttacccacccatgaactgagcgtcagaatgctgcctccttcctagaactgtgcagatctagtttactaataagatgcttaca

SEQ ID NO: 237071 - DNA, 370 bp, Homo sapiens
ctgaaaagctggcatatacctggctgccaaaccataaagggacatacctagagtgaaggaccaactgcccttaaattcactgccttgtgccagctcctaagttactgtagggatctgtgtgggtctggcccctcttcatgggccctgggacccttcagaaatctattcttgtgcttggcatcccatcttatcttctccttgctctgctgttaggtgatgggtgaacctatcaacaccctatctcatgtcaccaagtactcagattcaaaattgaaatccagttcctactagatcactagccctcctcttttacttcaatttctcatagcctacaaagaaaagaagaaacaacacatacgaacaaaagatc

SEQ ID NO: 237072 - DNA, 390 bp, Homo sapiens
agacttacttgcattttatgatcgtaaggaactaaatgtgaatgggatgggactgactggcaatttataaacacatcccctccaataaccagcagatttctgagacctgtaggaaaaccaacattattgtgtaattgtgtgaggaattctaactacataataatttagtttcgaagtttaagatttgagaacaaattcctgtcttttcgattagcttaaatttatttgattaatttataattaatgcttcatatgcttccaaacagatatgggatgagttgattaaacaagggattctacagatgtttttactcatgcaatttttaaatacacatttatggttcaattgcaataaaagaatttacagattgatgaaatttttttaaaaaa

SEQ ID NO: 237073 - DNA, 642 bp, Homo sapiens
ctcaactttgccagtattagttgcaaaaccccatgcagaatatggatttttaaagaaaatgggttaaggtggttttttttctttttttaaatcccagtttggcttaaaggagtgaagacatttcatgaactattaagaatgaaggtaaatgcaacagtagacagtaaaatgaactcgaagttattatggtaacagtgcctttcagtataatgaaattctttgccttatacctttttaatattcatgaaattgtttaggaacaggagtacaaaaagttgccttaagagtttcttggattttatcagtaactattttgatgtatagtatcttaccaaggcattttttttaagtgcaggttttgtttagggataaatattcagagttctaccaccctacttgtgttttcttgaattctttagagaatatggtatctacttaatcttccttcagtgtcagtgctgtgaatgaggaatgctaactccaggagtgagttaatcctcttgcaggtttgaaatcagcaaattgtttactcagctacataacataggccttttctccgtcatgagacagttacctaggtgccgagcagtgggagaggataaagaactaaacgcgtgtagagaaggggtcccatatcctttt

SEQ ID NO: 237074 - DNA, 396 bp, Homo sapiens
gaaaactgttgagttctcaggtacctgtgtgtccgtctttgccgaatcctgtggctcttccggctcactgccattcttcaggatacagctgtgaaaggagaacagatccagcagccccctcatgctcatcttggaggtgtctgtccaggttaatgggacccaggtccacctgcggagggacagcccaggcatggctcagataagcaccagctttgggacgtgtcgtttctaggaaccccaacccttcacccaaacccataggcccaagggaaaaacttattctgtctccattatttctacattttacctctattttctgattatatgcccatttttgactatatccatcagatgcattcagctaatataacagaaacactctcagaccagcttaag

SEQ ID NO: 237075 - DNA, 2077 bp, Homo sapiens
ataatatgtgcaaaatccttaacatcgcattgaaagattctttggatctgatcttaccatatatttctagcctaattaatcttctacatttaccctgccagttctctgttcctactcattgattccctaacaatgtaagcagagttcctttgttaagtcattcacagaaagttttccctattcttctctatctgaaaaaaaatgtcctctatccttggagatctaacccaaagtccatgaagcattttactgatactttcattttctgttgcagcacttgctatttcttttatgccatggagtgggcacattttgtatttgtgtcttgtattattgtgacttgatccttggattggatcttattttacttttgatgtatgtggtagtcagaggcctaccaacagatagaacccacacagtaatttggagaaagttttacataaagaataagtagatataatacagtatttatgtaatggaagattagctagtaataactaaagaggagtctaaagaatatagtaataataattataaggagaaaccattgcctctgaagctgagaggtacccaaaaagaacctcttcatcccctgcaaggctgatatccaaactttatttgtgaggacatgcccgtggctcactggctggtggacaaattgctgaggtgctggaacagcaggacttgttggaaatgttttcctctgggattccaaataagtcacccatagggaggatcctaaccagcagcactcctcttcaaagccatctaaggggtgccatcttcgtagaggtgcctcattggcaacacttcactgctatgctatctgagagggtaatggaaaatgctatccacaaggagactgcacattgaaagttaatgcaaagcaacttaagggggtgtggaagatgccatccacaggaagtgctgggcttcggaactcactgaaaagccatcagacacagtgtctgggtgcttctagccaccatgttctataggagccaggtattaaagaagctgcatgctgagaggagcacactaggaccagaaagagaaacctttctccctctagtgtccccccaatgtcatgtactgacagagctcaaaatgtgcaagttcacaagggagaaatatttatcaaacccatctccattattgtagagcaggcagtggggggtggatttggatgtgataatcaatgtattcataattggcacaatatacttgtttattgactctttgaacaaatcagaatttcttacaagatagaaatacattcttaactttccttttgtgcccaggatttttaaaaaatctcaaataaatattactatatttctccatcatattcttattaatatgatataaactttgacattttatgtgcacaagatatatcctaagcattaaagataactgtgttacataagtgcacattattgtgcttagtaagtgtatgagcatgtgtgggcatatatgggtgtatataaagtcaatatttgatttatgattgaccaatttgaaaattaataaaatgggcttgctgaaagctagaaggtagctactttaaacatcagaaagacaaatgacaagtcttggtatcagctagttaaaaacataagtttctacctttgaaaggattatgccacacattgattttcctattaatttaaataaaggtaggtgtaggaaatttactttagtttccatctttgaatgttataaaatattgtactaacacatgttgatttctgaaatgttataatcttattatacttaaaggataacattggggctgggtgtagtggctcatacctgtaatctcaatactttgggaggctgaggcagggggattgcttgagcaaaggagttcaataccagcctgggcaacatgatgatacttcatctctacaaaataaataaataaataaaaactaactgggcattgtggtgtgtacctgtagtcccagctacttgggaggctgaggtggaaagatcacctgagtccaggaggctgcagtgagccgtgaccgtatcactgtactccagccaaggtgacagtgcatgaccctgtctc

SEQ ID NO: 237076 - DNA, 348 bp, Homo sapiens
aatgtgtgctctggagccaggcactctagattagaacccagcttcctggagaatcctcctggctgcttgacccaggataagaacttgattgcctgtagttagtagactagaaaaagaagaacattttgaacccagagcagtaaccagttacggaagtaaatgtgggtaagattcccagagagaaggtaaccatggccagcagctatacccacagagccccttcataaaataaggtgtgagtcaagtgctgttgattcattgttttgagatagctctctaaaacttacagtcatgatttctcacaaaataattaacaattttgttgcaaatgaggacatagattgtgtt

SEQ ID NO: 237077 - DNA, 236 bp, Homo sapiens
agagtatttgcccatcaggatcgattggttcccggcttgttggccaactaatgaattctgcagaacagtctttgggtttgttttgtgtggcactcgtgatggccaaagcacttttctctctattgtttcattgtgtcctcaaggattccccatcccccctgccaccaggaaaggaaaaatgtcataaaatagtagggctgaggctcatgagaaattatctgaacaccctcatttta

SEQ ID NO: 237078 - DNA, 1702 bp, Homo sapiens
  misc_feature (1572)..(1572): n is a, c, g, or t
  misc_feature (1619)..(1619): n is a, c, g, or t
  misc_feature (1624)..(1624): n is a, c, g, or t
  misc_feature (1627)..(1627): n is a, c, g, or t
  misc_feature (1630)..(1631): n is a, c, g, or t
  misc_feature (1651)..(1652): n is a, c, g, or t
  misc_feature (1657)..(1657): n is a, c, g, or t
  misc_feature (1659)..(1659): n is a, c, g, or t
  misc_feature (1665)..(1665): n is a, c, g, or t
  misc_feature (1669)..(1669): n is a, c, g, or t
  misc_feature (1673)..(1673): n is a, c, g, or t
  misc_feature (1681)..(1682): n is a, c, g, or t
  misc_feature (1684)..(1684): n is a, c, g, or t
  misc_feature (1688)..(1688): n is a, c, g, or t
  misc_feature (1691)..(1691): n is a, c, g, or t
  misc_feature (1694)..(1694): n is a, c, g, or t
  misc_feature (1698)..(1698): n is a, c, g, or t
aagtagatataatagggtaaaggagaagtggtggtaaagacgaaaagagtagggaacaggtggttgaaggaatcagattatccccagtagaggggaaatttatggttgtttgctttagaataaggagttagttgctgaaataaaagagcattctaatataagtgctagaagctattttaactgtatgaaatggatactgagccaagatggctgaataggaacagctccagtctacagctcccagcatgagcgacgcagaagatgggtgatttctgcatttccaactgagggaccgggttcatctcactggggagtgctggacagtgggtgcaggacagtgggtgcagagcaccgtgcatgagccgaagcagggcgaggcatcacctcacccgggaagcacaagaggtcagggaattccctttcctagtaaaagaaagaggtgacagatagcacctggaaaatcaggtcactcccaccctaatactgcgcttttccaacgggcttcccaaatggcacaccaggagattacatcctgcacctgtcttaaagggtcctacacccacggagcctcactcattgctagcacagcagtctgagatcaaactacaaggtggcagtgaagctaggggaggggtgcccgccattgctgaggcttgagcaggtaaacaaaacggcccggaagctcgaactgggtggagcccaccacagctcaaggaggcctgccttcctctgtaggctccacctctgggggcagggcacagacaaacaaaaggcagcagtaatctctgcagatttaaatgtccctgtctgacagctttgaagagagtagtggttctcccagcatgcagcttgagatctgagaacaggcagactgccacctcaagtgggtccctgacccccaactagtataactgggaggcaccccccagtagaggcgggacacctcacacggccaggtactcctctgaggcaaaacttccagaggaacaatcaggcagcagcatttgcggttcaccaatatccgctgttctgcagccactgctgctgatatccaggcaagcagggtctggagtggacctccagcaaactccaacagacctgcagctgagggtcctgactgttagaaggaaaactaacaaacagaaaggacatccacaccaaaaacccatctgtacatcaccatcataaagaccaaaggtagataaaaccacaaagatggggaaaaaacagagcagaaaaaccggaaactctaaaaatcagagcgcctctcctcttccaaaggaacgcagctccccaccagcaatggaacaaagctggacggagaatggctttgacgagttgagagaagaaggcttcagaagatcaaactactccgagctaaaggaggaagtttgaaccaaaggcaaataagttaaaaaccttgaaaaaaattaggccgggcgcagtggctcacgcctgtaatcccagcactttgggaggccgaggcgggtggatcacgaggtcagatcgagaccacggtgaaaccccgtctctactaaaaaaaatacaaaaaattggctgggcgcagtggcnggtgcctctagtcccagctactcgggaggctgaggcaggagaatggngtganccnggnnggcggagcttgcagtgagcnnagatngngccacngcantccngcctgggnnanagancgngantccntctc

SEQ ID NO: 237079 - DNA, 453 bp, Homo sapiens
ccttgatgaacatagatgaaaatatttttaacaaaatttcgataaatcaaattaattgctatataaaaaggataatgtatcataaccaaataggggcttgaaccaggaatacaagattaatttaacattacaaactcactgtagtttacatataacacaccaaaaaggaaaaacatctcaatagtaacagaaaaattatctaacatccattcctgatgaacactatcagcaagtgcgggatagaagggaacttcctcaaccaaataatggtcatctatttaaaacctagagccaacatcaaacggagtagtaaatcactgaatgccttcctcctaagatcaagtatagggcaaggatgtctgctctcactaattctattcaggattataagtatagccaaggtaacaagacaagaaaaataaataaaaggtacccagatttgaaaaaaaaaaa

SEQ ID NO: 237080 - DNA, 2157 bp, Homo sapiens
aacacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccaccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcgcccacagcgggcacaagatcacaccagtgctcagtgcctaccaggccctcaaggacaagctgacaaagagcctgacatacatcctgggaaaccaggacacagtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctggaatacaaaacttagccaggcgtggtggtgcgtgcctacaattccagctactcgggaggctgaggtaggagaatcgcttgaacctgggaggcggaggttgcagtgagctgagatcgcgccactggactccagcctggacaacagagcaagactccgacgtctcggaaaaataaataaataaataaataaataaaggccaggcaaggtggctcacacctgtaatcccagcactttgggaggccaaggtgggtggatcccctgaggttgggagtttgagaccagcctgaccaacatggagaaaccccatctctactaaaaatacaacattagctgggtgtggtggcgcatgcctgtaatcccagctacttgggaggctgaggcaggagaattgcttgaacccaggaggcggaggttgcggtgagccgagatcgcgccattgcacttcagcctgagcaacaagagtgaaactctgtctcaa

SEQ ID NO: 237081 - DNA, 2195 bp, Homo sapiens
aacacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccaccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcgcccacagcgggcacaagatcacaccagtgctcagtgcctaccaggccctcaaggacaagctgacaaagagcctgacatacatcctgggaaaccaggacacagtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgaggctgtggccaccgcggactctgctccggagcaccccagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctggaatacaaaacttagccaggcgtggtggtgcgtgcctacaattccagctactcgggaggctgaggtaggagaatcgcttgaacctgggaggcggaggttgcagtgagctgagatcgcgccactggactccagcctggacaacagagcaagactccgacgtctcggaaaaataaataaataaataaataaataaaggccaggcaaggtggctcacacctgtaatcccagcactttgggaggccaaggtgggtggatcccctgaggttgggagtttgagaccagcctgaccaacatggagaaaccccatctctactaaaaatacaacattagctgggtgtggtggcgcatgcctgtaatcccagctacttgggaggctgaggcaggagaattgcttgaacccaggaggcggaggttgcggtgagccgagatcgcgccattgcacttcagcctgagcaacaagagtgaaactctgtctcaa

SEQ ID NO: 237082 - DNA, 514 bp, Homo sapiens
tcttgggataggtggtggcccgactccagcacttcaggccctgggaagccaccatcccatggcttctgagccgcagggaagtgagcctaaccccaggtgcgccatcacgcccagccacacaacaaaaaacttaaaaagatgtgtttggagtcaaagtccaccaaacctaccaacacggtgcggcaccatctgatcccctttatctctgatctgtggctaccccagctgaatcccctctggccctggctgtcctgctcaaggcctttggccactccctttcctggatccctttccccaaatagccacagctttactcccttttctcctttagcttttggctgaaatgtcacttcttagacttttcctcagcaccctatttaaagcaatccccaccaagacaggaggattgcttgacgctgggagtttggggccagcctgggcaacatagtgagacttccatctctacaagaacacttaacatttgccgggcatggtggcgtgcacctgtagtccc

SEQ ID NO: 237083 - DNA, 666 bp, Homo sapiens
cctgcctcggcctcccaaagtgctggggttacaagcatgagccaccacacctggcctattatgacctttttcatttttctctgagctacacattatttagatatttcccctagagattagaaacctcctttcatcctgtccactttttgttagcatactttcattggatttactggtacatgttttgtgatcatgataatgtgatcttgttttggtggtgtccccctactccgtctctatgccatgacagccttctgccccaaagcctggaagattactctttggtcaagggcatacaaatagaaagttaataaaggggaatggtgttgaaatagaacctcatacatttattacagttctacttatacagaaaatctagacaccttcatccttctcacagctctgttttttagtagagtagtctttagagtagtcttcactgttatctatatacctagaaagttaactgggagctttgactcttactgtgccttcactcatagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataattattgaaat

SEQ ID NO: 237084 - DNA, 598 bp, Homo sapiens
gatccctaaaattgaccttttagaaaaagggagaaatagaaatatagtggccactgatccatagcaatttgaaagtaccacttggcaaaaataattaaatctctctgctatagttcatgaatatattccttggtttgcctatcaggcaacccctgattcacctttctgagaggaattcctttacctaatgtcctcagggggccttggttttactttctgggaggtttttattgtacattaattttcagacacaatctgaatgggcattggaaagtatacccttcttggaggctgggcagccttagcagtttacttcctataattgtgagtctgggggcaggcttgggaattagagtatagatccgtaacagctacagtctattgcaggccaggtttgggtttttgttgttgttttgttctgtttcttggccaagtggattcctaaaactttagtaagtttctggtctgttgtcttcagtcatttacatggacagtattaaccaaggtaaaatacattgtttttaacaaagaacctcatcatttacttgctggcctctgtgtgctctccatcccctttgttcttacaggaatggtacct

SEQ ID NO: 237085 - DNA, 392 bp, Homo sapiens
aaggaccattgccacctcacactcctgtcttccatccctgactattctcccaaagaagaacatggaagttaacgactgggagacagtggacatcacaggcttacagactcttagccaaaattgcagccatttagaaatgtggatttggggagtcatagaccattcgaggcacagacttttagcataatgtaagtacttgagaagctctattaggaacacagactttaaaaccatataattttagaatcccaacctctcagacatattccagaaataacagacaaacagactcctggtctctatggtcacagagtccggtggtgctcagagcctggagagggacaggggtcctcatggcacaggcttgcctgccaggaagtagctctctgggc

SEQ ID NO: 237086 - DNA, 270 bp, Homo sapiens
tcctcttagtattaagatttcttaaaaagctatacacagttttaagatagattgttcttgaagataatggggcaaataattacctgctaaacaaattatgagtcctgtgattctttttttggttgaaataatttcaagaactccagcatatgttgcagttttggctagaaaggtgattgtgacatacatccattcatccattctccctctctccttccctccttccctcccttccttctttccactttcaatacatagggctggggtagc

SEQ ID NO: 237087 - DNA, 781 bp, Homo sapiens
tccattttaactttaattccgtctaattactgtattgtgagctcagtcagcaatcttgcatgaactctgcagtaacttctgaagactcttgctccaagtgtttgataatgaggagatgtgcaggactaaggcgactgtgtgatgtctgcacagttcgaaagcccgctttcctgttactttcaaatctcgggtcagcattttggaacttttctgctttaatttttccacacacacctctcactgcgaccacctaccatcaccacaacccaaaacaaagcaaacaaacagaaagcttgaacaagaatttacatctgggaaaacgcttctactcatcaagagtggaattcctttttattcctataattgactcacagcttcaaaaatctgtgaagtcatactttggtcacggaagttgcaagaaaccatatttgcaaacgttttattttaaagaaggtatttaaaaatatttcacatattagccacagatttctagaagtgaagttataaaaattagaaattatatttttccttttgatgatagcaagtgaaaagagattgctccaagcatgttttcaataaattcagtataactgcaacacaaaaattctgcatgcaggcttcatacacacacgttataattttatgcatttatcttgagagttgtataattaattttaaaaatgcaacagaaatgtgaagttaagtctactttgccaataatggaaatgtctcatagataattttgaatacaattaaaattttgtttttatcataaaaggaa

SEQ ID NO: 237088 - DNA, 405 bp, Homo sapiens
cttttgtttaatcctgtgtttccagtaaatatctacactatttaaaacaataaaagcaacttgattcaaaagggagtaaaaacaattattatctcatgcctaacaatctatatttacagactttctaagtattgaaatttgttattttggtattagaaaaatctattatgtaaccgtggtttgattccaagcacctaataaccttaacctatttcaggttaaatgggatattttttcaattattcaacaaataattattgagttattctataatccaggcactgtataggtggcgaggacacaatgataggcaaagtagtacaagtttctacttttggatagcttacattctaatagagactatcaataaacagagtttatatagctctgatggtgataaaccca

SEQ ID NO: 237089 - DNA, 1971 bp, Homo sapiens
tttgttttcttttctcctcaacccagcattttatttaaacaaaatttagaatttggccgcaatgggccaacgctggggccaaaaatccacaggtttctctctccatccctgctggtttctagtcccccctccccctcttccctcccaggcttaatcatattttggaacgggtgaggtcttttgttgggtgggcaccccctgattgcttgtctgtttattttttaatgtgcaactaatttgatttgaatttccttcagtttccaggccttcctagggaaagctaagggagagggaatatgctttttaaaaatcgttttctttctttctttctttctttctttctttttctttctttctttctctctctctccttccttccttccttccttccttccttccttctcctcctcctccttcttgttcttgttcttcttcttttttttttttaaataaatgtggcaggaggtggggcgttgggaatggggaggcacggtggttgtgggcaaagagtcaggaggagcagacagacccggaagaaaaggaatctgctctggaataacacttttttttttgaggcctcaggccttgggcaaaattgcttcgctctgtaatgatttctgctgccggagttgctcctccacccctaagttaaagctatgaacctgggtgcccgggcaacgccccacagtggatagcagccgggagcgctggttttgtgccttttgtgggggcccttggttccccctcattggaggctgactctgaaatttactggatcagtaaatttcctggctccctgggagcagctgttaacgaggataaagtctctgggcatgtttctggccctgcaaaaggacctcacccatgaaggtacaattctcactttgtttagataccagaggggcacccacaggctggctgagaatgaggcatagttgattaaaaaaaaaatcagtcattacaaaattgtttttaaactcacacgtgcttttaaagtgttgtggtttaaattactttaagataaaaaaaattcatctgtaaggatagcgttcatttaaaagatgctaaaactgcaggatctcatcatgaaataggaggttgtagcttctaattacagtatatacaatttcagaaagatattccggtaatcttttaatacagactttataaatagctcacatcagacgatgggttatattggagagccagtcttctgcggtttcttgaagaatgcttgggatctgtgaggaagctctaggcccttggaggctaggtagcagttcactcagtaggagtttgtgctccttttgctcagtatttaacctggtagcatttgatggataagttcattaggagctaactagaaggacttaccacacttgtcagtttggaaaatgaggcccgggaagggaagtgacttgttgagggtcaccattatagacgaaagtttaatacaggattgtgttaatagctcctttctgggatatctgatgtgtactaagcactaattcctgtgcttttatacattatctcattaaaattctagtattttcgatttaggttgtgttatgcacacttcacaaacaaggggattgagatttacagagagagagtaacttgcataagatcacgtagctaccaatggtgtcatccaatggaattttcttcagtgttggaaatggttctgtctgtgctgtccagcatagcagccacaagccacatgtaactgagtctttgaaatgtagctagtggactgaggaacaacagtttaagtttttttttttttttttgaaatggagtctcgctctgtcgcccaggctggagtgagtgcagtggcgcaatctcggctcactgcaacctccgccttgctggttgagatggattctcgctctgtagcccaggcggaggttgcagtgagttgagatcatgccactgcaatctagcctgggtgacagagcaaaactttgtctc

SEQ ID NO: 237090 - DNA, 1060 bp, Homo sapiens
gacgctgtgggggcagtggctgtggagagcagcgctgcctgcctcctggcttcatctgcaagtttccctcgctgcagaagtcaggcatgcctactgatggagctcctacttctgccccaagccctgggcttcctctttctgagttgctcatggggttcagtcagggctccgcgtgctgcctgtactcaggtggcatttcccgtcccccgggctgagttgtagcatgcaattgcatacttgcccaagcattacaggagctgtggctgcaggacagggagggccacatggacatgacagaccactcaggtggccggctgctcctgggagtagcaggagggccccagcaggaagtgcttttcaagtggtgagcttggtggctgtggccgagacatgcaccttcccgtcattgttcctcccagtgtcattcttcctctgagaagctgtgaacttgaggctttgcccctggggtttgaggctcccatgaggtcccctcagaggaaggtgccttcactgggcagagcctggtggacctgcaccagccccatgaggctgagcggagagtgcagggtggggcccgcctgagggtaagcacagcagcacccctcagggctgcgctttccagagctgagagggagggcagagctggggtcttggggtggaggtggggtggggatgcaggtgccgcctcttgtactgacttgcaccagaggcagtttggctcccagctgcctgggaacacgtgcggagtttgtcagaagcaggaagacttggtgtggcgggaaccaaatcacagacacacactctcccagcaaagccctgtttgattcacccgtgtgtcctcagcagacacgactgtgtgttgggggttggggggtgggcgaggtgactcagccgcggacggcattagaatgcttagcacattgaaggcagactgtctgtttctgggtgccatctgtggcatgtttgggtttggaaggacagcttgcttgctgatgaacacttccacagtcttttgagctaagtagtttttgtaaattactgtctagaccattctgcatta

SEQ ID NO: 237091 - DNA, 334 bp, Homo sapiens
gatatggtttggacccagtaggaggtaattgaatcatgggggcaggtctttcccatgctgttctcataatagtgaataagtctcacgagatccaatggttctataagggggagttttcccgtgcaagcactcttcgcctgccaatatccacgtaagatgtgatttgctcctccttgccttccatcatgattgtgaggcctccccagctatgcagaactgtaagtccaattaaacttctttctttagtaacttgcccagtctcaggtatgtctttatcagcagcgtgaaaacagactaatataatatctatcagttaagattaggtttggctgct

SEQ ID NO: 237092 - DNA, 297 bp, Homo sapiens
ccttccataatctcagtgcaggtcccagattcagtaaatcgaatgcagatatgacactcatgtctctaagctacaatccacgttccacctttccaacttgtcccaataaagttgatggctaatctttccccaggacaggatccaagcccaggaccacacatcgccacgggacgtgtgggccagagccaggctgagggaaaggaggacctaggagggagatgcggtggaaccagggcacgtagtttccttttgaaaaattgcctgattagagttaaatcaataaaatcataaatccaa

SEQ ID NO: 237093 - DNA, 254 bp, Homo sapiens
atcttcatttgctaagataattttacatactatagaattctaggcttacaattttcttcaaatctttgaagatgttataccactgtgttctgcttgcctacttcttgacaaaaagtctgcagttgttcatatttttttccctttgtacataatgtgttttccccttcctctggctgattcaatttttattttttattatactttaagttctgggacacaagtgcagaatgtgcagtttttgtcagataggtata

SEQ ID NO: 237094 - DNA, 681 bp, Homo sapiens
tagaagcaacctgtcaagatgcaatgggcttttgtaacaggctctgcaacctcttctcaaaaaagtagaattgttagtaggctaaaatgctgtgggattttaatacacaggtttaccactgaagtttttaatttgggatggctaacataaaaatgatcttctatcaacactttagaggatggtttctttgggatttatttataattttactgaaaaattactgtgtagggaagagagagtgactgtttctgaatatcattgaaattacgctatgcaaaggccttaaactggagaaagaagaggagcttaaagagaaaatagaaaacctcccatcgatgggatgattatttcaaaaactaaaaattttgtgtcagtcactttggtgcaaaattacaaagactctctgttggttccttacacatttcaattggatttgtttttggcattttattactcagtcccaaatccaaagggaatttcataaaattaatttgttcacttccccaccaccccaccaacaaaagcccccaaacgcaatgttgtatccaaggatagtcaggcttcctgctgataaaagctgatcttgttcttctagctaatgttctagggaactatttctagaagcttaggaatgtctttaaaacttagaagctcaagtcaatgtcatgtaaatgaaactaa

SEQ ID NO: 237095 - DNA, 486 bp, Homo sapiens
gcaagcatttcttgatggtacatctctgtgtgtccagtcctgggttaggctggagatccccaggggaagtccaggtcccaccctctcaaccaggtcccaccctctcaaccactcacagcccgttctgtggtcagaccacgagtcctagcccttcttggaaaaggctgcttggcccacccactctaagaagcccagccactctcagcacagatgaaaccactggttttacaaacctttccagtgactcacttgacacccttatacccttctggtcattcttccctcttccttttctccgtcactatagtattgggcctctaattattatcaactctgtgtccctaggatgcggtggtagaattaaaataaattatctaacatattttatttccattcacttctgttggttgttgttattgttgcagtgagccgagaccacgcccctgaactccagcctggcaacagagtgagactgtctcaaaaaaa

SEQ ID NO: 237096 - DNA, 661 bp, Homo sapiens
aaggccaggctgcttgtctcactctaggaccacttagaaaggccttctcagctgcagagttcctggtaaaatgggccaggggctcacatgcagccacatgggtgcagcctcttcctcactcctctgcctgtctcacctctttacaggtgaatctccccagagtgcctcccaagaagccgtcaaaaaacaattttcacctcaagatctgttcccagggaacccaatatctaccagttatggatgtgaatattttggggtaatgattctcaaatttgagtgggcatcaaagtcacccagggagcttgataaaataaaaattgctgggccccaccctgagagtttctgagtcaagtggtctggggtggccagagaatccgcatttctaacaagaacctctcggtgatgctaccactttcagaatcactgttttagaactcagtaagttgctgccctcctcttattcctcttctgaactaaagctaaatcatagagtttattgaaatgaaattgataaaccttatttctgtaaaatgttgtggtgtgaccaaatcgacttgcttagaaagaaaaaatgcaaggatcaaccataaaataaaatggagtcctagaaggagggattggatttgacttgggaaccatgtaaatatttaatataattata

SEQ ID NO: 237097 - DNA, 1793 bp, Homo sapiens
  misc_feature (69)..(69): n is a, c, g, or t
  misc_feature (378)..(378): n is a, c, g, or t
  misc_feature (1563)..(1563): n is a, c, g, or t
taaaaccatagtgagataccatctcacatcagtcagaatggccattattaaaaaactgaaaaacagcanatgtttgtgaggatgaagagaaaagggaacacttatacactgtttgtgggaatgtaaattagtacaacctctgtggaagacaggatgggtatttctcaaagaactgaaagtaggatctaccatttgacccagcaatcccactgttgagtatctacccaaaggaaaataaatcattttatcaaaaagacacctgcacttgtatgtttattgtgacactattcacaatagcaaagtcgtgaaatcagcctaagtgtccatcaatgaatgattggataaagaaaacgtggtatatatactccgtgaaatgcnactcactcataagaaagaataaaatcatgtctttgcagcagcatggatggatttggaggccattattctaagtgaaaaactgcaatggaaaatcaaatactgaaggggtgcgttgcccctccacacctgtgggtgtttctcattaggtggaatgagagacttggaaaagaaaaagacacagagacaaagtatggagaaagaaataagggggcccaggggaccagcgttcagcatacggaggatcccgctggcctcttgagttcccttagtatttattgatcattcttgggtgtttctcggagagggggatgtggcagggtcataggataatagtggagagaaggtcagcagataaacacgtgagggaaggtctctgcatcatagacaaggtaaagaattaagtgctgtgctttagatatgcatacacataaacatctcaatgccttaaagagcagtattgctgcccgcctgtcccacctccagccctaaggtggttttcccctatctcagtagatggaacatacaatcgggttttacactgagacattccattgcccagggacgggcaggagacagatgccttcctcttgtttcaactgcaaagaggtgttccttcctcttatactaatcctcctcagcacagaccatttatgggtgtcgggctgggggacggtcaggtctttcccttcccacaaggccatatttcagactatcatatggggagaaaccttggacaatacctggctttcctaggcagaggtccctgcggccttccgcagtgtttgagtccctgggtacttgagattagggagtggtgatgactcttaaagagcatgctgacttcaagcatctgtttaacaaagcacatcttgcatagcccttaatccatttaaccctgagttgacacagcacatgtttcagagagcacggggttggggtaaggtcatagattaacagcatctcaaggcagaagaatttttcttagtacagaacaaaatggagactcctatgtctacttctttctacacagacacagtaacaatccgatctctcttttccccacaaatactacatgttctcacttataagtgggagctaaacaacaggcccacaagaacatacagaaagaaatagtaggccgggcgtggtggctcacacctgtaaccccagcactttgggaggccnaggtgggtgcatcatgaggtcaagagattgagaccatcctggccaacatggtgaaatcccatctctactaaaaatacaaaaattagctgggcatggtggcatgcacctgtagtcccagctactcgggaggctgagacgagaatcacttgaactggggaggcagaggttgcagtgagccgagatcgagtcactgcactccagtctaagtaacaagagtgaaactttgtctc

SEQ ID NO: 237098 - DNA, 442 bp, Homo sapiens
tgcctgatggtttggcttaaaaaaagaatcatcagaatcaccatgatgactttacccctagggtgatagtttataagctcagtccaaagagaccagattaatgtttgaaaattaaagttccctaacaattcccaaactgttcagctagctcatagtcaatggacattccagtacctatgacaaatgctaaaatgatacagtccttcctctctctctccctccctctctccttctctctcaggatgagaacagggccaactctgctgctgctgaagcttatcaaaggcctttaacttttcagcagattgtgaacaatgggtaggacatcatttgcttcattcagagatcctcaagaaggcactgccgatcactctcctctaggcacagatcaagggtggcattgtttaatgtcttatttaaataaaatccagaaaaactggag

SEQ ID NO: 237099 - DNA, 451 bp, Homo sapiens
cagacctctgtgtccatggtccgcatgtctaggtcaggggaccagtatcaaagtgaagactgggcaagtaagccccacctgcccttgaacctcaggcttggcccctcccgaggcccagagctgattgaatgttaattagcaactaattggatgtccatgagactctctacataaagaacacaccaaggtcaggtttagacagtgtgtagtgccaagtgattcattcttttcttccagacgtgatatttcctgtatgtgaagcatataaagaagagtcattcattcactcatctagcagatatttactgagtgtcaactacgaatcaggcatgcaggcactgcgaatactactgctcttatttgcatatgggttggaaagagaaaataagcaagtaagctgttgaatgacattatttcagagagcaataaatgctgaaaacacaaaactgaa

SEQ ID NO: 237100 - DNA, 123 bp, Homo sapiens
aatctagacacacattttcaggcatatcagattggagagtaaataacgatggaatgcctgttatgtacacggcctggtgctagaagtacaacaacacaattttgataaacaaaagaacacaga

SEQ ID NO: 237101 - DNA, 663 bp, Homo sapiens
  misc_feature (18)..(18): n is a, c, g, or t
  misc_feature (49)..(49): n is a, c, g, or t
acatatttaatcactttnaatttcaagtccctctacacaactgccattnccatacagtttgacagaatgtctatttttggtacagctcagtactttcgtctgtcctcttgataacctcctacaaatctgcaacttgatccagataatgcagcagacttttgtcaagacaattagtggtatttggcagtgttataggaggcacataatagctgtcacctctcttaggtgatcttagcagctgttcatgctaagtgtccgtatccattcattgggaattgcaaaatggtgtcattctatcattcatttttcatttattacttggaatactttgtgatggttaatactgtcaacttgattggattgaaggatgcaaagtactgttcctgggtgtgtctgtgagggtgttgccaaaggagattaatattttagtcagtggactaggagaggcagatacaccctcaaacccggtgggtaccatctaatcagtgggcaccatctaatcacttgccagtatggctagaacaaagcaggcaggagaagatggaagagcagacttgctgagtcttctggccttcatctttttccgtgctggaagcttcctgccctcgaacataaactccaagttcttcaacttttggactgttagaccagtggtttctcgtg

SEQ ID NO: 237102 - DNA, 326 bp, Homo sapiens
acatctttcctcctgttgcatcctctgtaggctttcactagataactagtgataatgacagtttgccaaccccctttcttttcctttaagtgaacccaatttgttcacatacatacacatgcaaatcccaaaagaaggttttatttgaagtgttcctgacaaataaaggggtaaaggagattttttttaaaaaagaagaagaagaagaaatctattctggaacatagctagagcaatgttccctaacctgtgttggggtggatcacctggttaaagatcagcaggagagaagataggcatcagacagaaattataggaccaaggta

SEQ ID NO: 237103 - DNA, 422 bp, Homo sapiens
aaaggcaggtttctccatgcattgactgattttgctggaaagtttttccatttctctttctccactgaaagtctcctcctcagtgagaagggaagctgcccattgaacactggggcaaggaagctctctgggccttcttaactacacgggccactcttgctgagcacaaagatacagatttaactaccccttaacaaagaagagaattaaaaatgacccaccaaagaaaactagaataaaaacaaaggcaaagcggccaccgcgagctgtttgattattttctctgactttgctctttgattggaacctgcctcatcagaaataaaaataaataagaacacaaaacgttgattggttcttcatcagtgaatgtgtccatggctgatacagagagaaaagaaaataaatcctgattgcttaat

SEQ ID NO: 237104 - DNA, 637 bp, Homo sapiens
atctctgccaacaagaaaaaaagtgcttttaataacatctataatatgaatgatgtaacttctagaattatcaagcttgagaactagtgtgcagaaaagagttaacatagcaggtctgactaccatccttcaaaagacctgcttaaaagatgtcccttagttggcatttgggaacttagatttcagaagagttcctaccactctgataagagtggctcactgtacctaaataatttggtttatgctgaatatttgctttccttctgggagtttggaatttcagtgcatactaggcagaaagtgtctacgtggccatccccgataaaaacctaggttttgagtctctaatgatcttctccagtaacacgaaatttcacgtgttacaatttgttgctgcaaaaaataagtacaccctctgtgattccactgggagaagactcttagaagttcgtacctgttttcttgggacttcaccccatcatgcacctttccctttgctgattttgctttgtatgcattcaccgtaataaatactgctatgagtatgaccatacactgagtactgtggatcctctgagcaaatcaaagaatctggggtggtcctgaggatcctgacacaactagttatccactttca

SEQ ID NO: 237105 - DNA, 935 bp, Homo sapiens
tcctacaggtagactagaggcagggtaagagctccatgatagttcagatcacacttctgtgagctatggatttgtgaccatctagggcttggttcttagctgctctgtgctttggtttcccatctctatgcccatctccatctttaacagattgtgaatatcagggaactagggtattgtttcattcttcttcaatccagccccctccgctgtcacaatatagtgcctagcatagcatctagtccacggcaggcactcaattgactatttactggatgaatgaacattcataattctctaatctgcctccccttctttctttctttcttcctttctctcctctctctttctctctttctctctctctctctttctctctctttctttctttcaaggcaaggtctccctctgttgcctaggctggagtgcagtggcgccatcttggctcactgcaacctccatctcctgggttcaagtgattctcctgcctcagcctcctgagtagctgggattacaggtgcctaccaccatacctggctgatttttgtagttttagtagagacagagtttccccatgttggccaggctagtctcgcactcctgacctcaggtgatctgcgtgcctcggcctcccaaagtgctggtattacaggcataagccaccatgcccggccctgcctcctcaacttgaaaaaaaaactgggattaaaagagtgaaaatgatgccacttaactgttgggggagagagacacagcgtttctctacattatgcgtgtagaaaactagatcgtgaggctggaaagagtgacaaaggatattgaaaatagaaataaggttgggaacttaccaagaccctgtccatggaaaatgtgaatgctacctggaacctttccagcccagttcctgaatcttttgtaacaaaaggtctaacggg

SEQ ID NO: 237106 - DNA, 769 bp, Homo sapiens
tcctacaggtagactagaggcagggtaagagctccatgatagttcagatcacacttctgtgagctatggatttgtgaccatctagggcttggttcttagctgctctgtgctttggtttcccatctctatgcccatctccatctttaacagattgtgaatatcagggaactagggtattgtttcattcttcttcaatccagccccctccgctgtcacaatatagtgcctagcatagcatctagtccacggcaggcactcaattgactatttactggatgaatgaacattcataattctctaatctgcctccccttctttctttctttcttcctttctctcctctctctttctctctttctctctctctctctttctctctctttctttctttcaaggcaaggtctccctctgttgcctaggctagtctcgcactcctgacctcaggtgatctgcgtgcctcggcctcccaaagtgctggtattacaggcataagccaccatgcccggccctgcctcctcaacttgaaaaaaaaactgggattaaaagagtgaaaatgatgccacttaactgttgggggagagagacacagcgtttctctacattatgcgtgtagaaaactagatcgtgaggctggaaagagtgacaaaggatattgaaaatagaaataaggttgggaacttaccaagaccctgtccatggaaaatgtgaatgctacctggaacctttccagcccagttcctgaatcttttgtaacaaaaggtctaacggg

SEQ ID NO: 237107 - DNA, 2304 bp, Homo sapiens
  misc_feature (1626)..(1626): n is a, c, g, or t
  misc_feature (1718)..(1718): n is a, c, g, or t
aaaaagcctgtttggtggtctcttcacacggacgcgcatgaaatttggtgccatgactcggatcgggggacctcccttgggagatcaatcccctgtcttcctgttctttgctccgtgagaaagatccacctacaacctcaggtcctcagaccgaccagcccaaggaacatctcaccaattttaaatcagctccaggagaatgggtgacttgaactggcaaggagcaacctgctctctccacgggcctctggaaccccggcaagagaagatcccttgatcaccatggacactcaagttggcaagaagagctccttagagaagtcgtgggagggcaagcaagctgatgtggagccaggacgatttgatgtgggagcacctgcagtggagcacagccagggagagccatctccccaggcctgacttgctcccataggagactttagccctaggggaactgtccatcctgatctctgcagggtggtcttgtccatcagacagggctgattcgacctgagcaccccttggtctgctggcctttctggggtcccagcctggccagacctgcttgcagggcagtcttgggtgccctggaggccacgccatagcttctgtgctggcagatagtatctgactggtggagagctccagcaaggctgcccctaggccacacaccagcccatccaccccctccccacactgcagcttccctaggcccaggaaactcctcacgtgtctttgctggcacaagtctgcacaggtaggttttgccttccttgccctgccagtgcatgggagtgtagtctgcccccctgccccgtctggctgtcattgaagacagagccttggtgggcacagagcaagccagctcccccgcaacgcccacctcaacacctggcccttgtgctaacactgtgcagagaacagtggaccctgctcgcaccctgagtgatcactcctgcttgtggggcacagagaaggtgtccagacctgctcacgccagtgccctgcccccaagccaacaccacatccaacaggagcctgcacccagtcttcagcatagaggtgaaagatctctacgaggagaactatgaaacactgctcaaaataatcaaatatgatacaagcaaatggaagagcatgcaatgctcatggataggaagaatcaatatcataaaaatggccatactgcccaaagcaatttatagattcaatgctattcctattaaactaccattgatattcttcacaaaactagagaaaactattttaaagttcatatggaaccaaaaaagagcctgaatagccaaggaaatcctaagcaaaaagaacaaagctggaagcatcatgctacccaacttcaaactatactacaggactacagtaaccaaaacagcgtggtactggtacaaaaacagacacatagaccaatgaaacagaatagagaacccagaaatggttctctatttcacacacctacaactatctgatcttcgacaaacctgataaaaacaagcaatagggaaatgattctgtattcattaaatgatgctggaataactggctagccatatgctgaagattaaaactggaccccttccttatactgtacacaaaaatcaactcaanatggatgaaagacttaaatgtaaaacccaaaactataacaacaatagaagacaacctaggcaataccatcttggatataggaacaggcaaanatttcatgacaaagacaccaaaagcaattgaaacaaaagcaaaaattgaaaagtgggttctaaataaaactaaagagctcctgcacagcaaagaaaatacaaacagagtgaacagacaactacagaatgacagtatctgcaaactatacatccaacaaagatctaatattcagcatctataagaaacttaaacaaatttccaaaaacaaccccattaaaaagtgggcaaagcatatgaacagacacttttcaaaagaagacatacatgcagccaacaaacatgaaaaaggctcaacaccaccaatcattagagaaatgcaaatcaaaaccacaatgagataccatctcacactagtcagaatggctgatggctgttattaaaaagtcaaaaaataacagatgctggcaaggttgtggagaaaaggcaatgcttatgcactgttggtgggagtataaattagttcaatcattgtggttgacagtgtggtgattcctcaaagatctgaaaacagaaatataattctacctagcaatgctactactgggtatatacccaaagaaaaataaattgttcaattataaagac

SEQ ID NO: 237108 - DNA, 277 bp, Homo sapiens
ccaaagcggaggcccgatcggggttccggtgccccagggctcccgaggcgcacatctggctggcgggcccgcagcccacccaagggcggcaccagctgtgggctcgacgccgccgtccccagcgctgggcctgggaccaggagtcctgagggcgccagactccgaggggcgggcggccggggggcggcccgcggcgcagaacaagccaggccccacccgggccgcgtgagcgagctgcgcagcctgcgccttcccagccggccccccgccgcggccg

SEQ ID NO: 237109 - DNA, 474 bp, Homo sapiens
tttcctcaatatttacagcatttatggtttgtatcactcatttggcacctccagatgtagcctctcactatttatctgttgatctctgtcctgttcccctaacaagatgatgaaatcctttctgaaaggcagagacatatgttttcagcatctaccagtgtgttctacacggagtctgttatggttgatctttaatatgaacctggtttagttttgaagatctcatgagtggtttgaacttaacagcaccagacgctatagatattttatcatatctgagacaacattcccaatgttcaaaattactttccagttgggtatgcccaaaaaaatcactcaggcaagagttttcatttcaaatattataaactctatatagctgaacaatgtcaggacaagcagttactattccccttcatatagtttaggtaagctctcttcatagaggagcaagttgcaccttctcatgcaaat

SEQ ID NO: 237110 - DNA, 698 bp, Homo sapiens
tgactcaggtaaggatcctgaaatggggggattatcctggattgtactgttaggtacaatataatcacaagagtccccgcatgagggaagcaggaaggtcagaacctgagaagaggcagaggtcagagtgatgcagttgctccctggaggacacaagtgaaagaatgtgaacaacccctagaagtcagaaaaggcaaagaaatgaattcccccttagagattccagaaggaatgaaatcttagtgacattttgattttagcccactgaaatccattttggacttctgaccttcagagctgtagataatacatttgtggcattttaagcactaattttgtggtaatttgtcacataagcaacaggaaactcatacacttagttcctcacattgaaccctacccactctagctctctcgccatccctgttccctattagctagattccccaattcacacacctggaatctccagagagggagttctagagtgtgggactctcccaccaatctgtgtggatcatgagtaggtagatcagagatccatggaaggccatcaagaccatcagtggttggagtaggtcatgaacgtgatagggccttgagggtgagtagttactcctctcccaatttggtaaagaataaacttcttccaggaaaatcacagatattgtcatagactgcaagaagaaaaaaagcaa

SEQ ID NO: 237111 - DNA, 547 bp, Homo sapiens
tcgaggggaaagtctccggatgccaagagtcacaaagggccgaacagggtgaggaaacccgacgcagagtccggagaaggcagcatggaatccctccctcaggcctctctggacggtgttggtgggggatcaagatgaacacactgcagacgaggacacgagccccacaggagctctttgtcccgccggagaccagcggacccacgtcagagaagatgcttgtatcttttcacggctcttctctgagaaatgaagccacaccacaatacggtctggaagaggaagccgggaatgggagatggcaacagtccctgtcactggaatgctggcctctctggacaagccacccttttggaaccccatcccttatgaccctggcagtggaacggtgatatatcccgcctggccgccggcgtctgccctgtcctccctcctgctctgcctcacctgtttctcaagtgcctcaatgcctctcgctgacgcccaatgtcttcaacaaagatgacttcccagtccgtcagggagacatttcttcgaaaaaaatgtc

SEQ ID NO: 237112 - DNA, 696 bp, Homo sapiens
tggcagtgcttgggtgtcaaggctctgaggctccggcctgacggctccactgggtcgaggggaaagtctccggatgccaagagtcacaaagggccgaacagggtgaggaaacccgacgcagagtccggagaaggcagcatggaatccctccctcaggcctctctggacggtgttggtgggggtgagtctccccaaaagtcgtgacgcggtgatctcgaggacaggacggcctgcgtgcccctggggtgctctctcaccgaagggtcgttctcgtcgaaagcagaaccccacagcctcaggggttgcctgggtgtgtgtctttcaatgcctttgctataagactctgtgtgtgtgtctgtgtgtgtatgtgtgtgtgtgtctcccattctctcttctctctctgtctctcagtctctgtgtgtttctttccctctctctgtcagtttgtgtgtgtgtgcccgtgtgcgtgtgtgtccttggccgaatgtgccctgtgcaccacaaagctgtttctcgcatggcggcctgtctttggtgagcctgtttctgcctctctgcctgggtcatgagaccggttgtcaatccttttcgccgacgcgtttccgctttgggtgtgtgaaggcctggcccacgtgaggagattcttcggtcccggagcaattgaaatatccccatcctgagcggtctcttttctag

SEQ ID NO: 237113 - DNA, 807 bp, Homo sapiens
ccggtactgatccagctttgcggaggaggctccgcctcctgcctccagctgggccagaagctctggggcccttcccgagcactcgggagccacctgtgcacatcttctcagtccccacggccccggtgcaggcctgccaagagaaggatccccgcggaaacgtctcgactgactcagtccctttctgcacacctgctcttccctgggcgcgctctcgccttacttattcctgtgtggttcaggcgctgcggaaggagaaggcacctagactgcactgggaaggctcctggagttgacctggagcgccaggaaaggtcagtggaggaaagtgctccaggcagagggaatagcttgtgccaaggccctgagaccccggctggggagcctaataatggcaacagtcagcacttgccacgccaaggcatgttctgagtgtgtgtctcgtgtcatttctgtgatgctcgcacatcgttagggggtacataccactggaacctcctcttttaataaatgaggaaactgaggcacacggcggttaagggacttacgccaggtcacacagcagtggagctgcgctcgggcaggggggcagtggaaactggagagcccagggggcaaacggcggaggctggaggggctggcaagggaggcaccgcaaagggcctcacaggggctagacgagggccctgggcaccagagattatggtgccccgccatgtggattgaagattaaacctcgaagcaagtgtataatgcccccaaaaatcacatttggaagtcatcacttcaataaaattttctacaaca

SEQ ID NO: 237114 - DNA, 1538 bp, Homo sapiens
ctcccggggagaggccgcgccgcgcctccgcgtctgcccgcgccgggcttcgggggcctggggagcctgaggcggccaggaagtggggcgaggaagggcggccacacggcccgagctgggagtcccacagtcccgcagcggcgacgccgccacccgccgagtgccgaggcccggggcccactcccagcccagctccaggagaggccgcgccggaggaccgcgaggacggcgccgcagcgccaggtcgggctgagctaagggaggaaatggagcgaaaagtggcggcgggcagagggccccgggcgggcggagaatcgctgacgagggcatttcggaaggaactgaacctaggagcacagggctccctcccgggaaggcagggcgtgaccctggagccgccggtccctcttgccgcggccccaggcgtggctggcgcgctccaggatctggagcttctacaagtttgctttgtttcctgcttttgcatctaaaaacccgctctctcctcgcccgcctgccggagaccaggactctggcccgtctgcctccctccggcgtcgtctccgggagcgcgggcgcggtggggcctgcaggccgggctgggaccaggcgcgccttggggcgcgagtggctcggccgtcgccgcagaacccgctccctgcgaaacagccgcacccgctccctgggagagtcatgagaactggggtcgcgcctgacccccgcgcccgaagaaaaccagcccgcggaccccgccacacgggccgtgacccgagccccgcgcgccgtcccgaacgcgcgcggtgaaaacgccccgctgcgccggccttgctcggtccccctcctccacccccacttctccggaaaaaaaaaattctgaattgggaacgaagacccgaaaaactcgccatgaccattcccctccccggcccctagcttcggcccggaaggcccctcagggcagcggccgtgggtaccacgacccggccagttcccctcgccgcggaccgaccgggcagggccaacccaggactgttccggggaggggagcagggtaggggagcgaatgttggggttcgttcgtgggtcacccagaactgggcgcacgctggcggcgcccggacttcgccgactgtccgcccggtgccacccgcgcggctcgcgccagacgcagcctggcggtccctgtcctgtcttcgagtatttgtttttaatgctgggtgtcgatcgagacaacaagcgctcagagcaaagcaaggatgcattacgggggtaattttaaaccgatcgataagatttttcagagaaaaaaaaatcgctcatagtccatattttttaagaaaaaaaaaaagcctcaacattttaacggattttgttaaaagggaagatatatacttcttgaacattcacaatcctgaatttcttttgctaaaaaaaatgtaaaaccccaaagccagaataaaaaataaaataataataaaaatacaaaaacaaaaaaaaaaatgaaagcaatttcagttacttactggaggctgtttcct

SEQ ID NO: 237115 - DNA, 306 bp, Homo sapiens
ttttatataatgggcttggttgaacaatctagttctaccttactctctgaaggacctctcttagtaggaaatgggcttatgttaagatgttttaatccaaggggtaagccacacagttggaatagaatttttaatatatccaaaggaaatgaaatcagtatgtcaaaaagatatctgcactccaatgttcattgcagcaccatttacaatagccaagatacagaatcaacctaaatgtctatcagtgaacgaatggataaagagaatgtgggatatatacacagtggaatactattcactcttaaa

SEQ ID NO: 237116 - DNA, 389 bp, Homo sapiens
catcaattaatttttttccaaataatcccccactgattgctgtatgctgaatactgttgtacaaggtgcaggaactacaaagagactcagatgttatccttcctttcaagaaacttcctatcaaattaggaggttaccatttgaaatccaagttctctttacttgccctgagcagttgttacttgccttttggggtcccatatctctttgagaatccagttaaaatgcacatatacataatcatttttttaaagagtgtcattaaaaaaatctttgtacaaagcagatattcctccctgtagttcatttccttgaccaatttaagtagtcatattgaggaaagagagagaccctctcatattgttttatactcagtacctgttttaagg

SEQ ID NO: 237117 - DNA, 434 bp, Homo sapiens
gatataaaatgctttcgtatgtagtagtaaatgtttaatgaagttggtttaccaaccaaggcttgagtatatacatgactaagttaagagtcataatgtagtaataacaaaagcattgcacatgtgatgaagatataattaaaaatgtactcagagccgggcgtggtggctcacacctgtaatcccagcactttgggaggccgaggcgtgtggatcacgaggtcaggagatcgagaccatcctggctaacacggtgaaaccccatttctactaaaagtacaaaaaattagccaagcttggtggcgggcgcctgtagtcccagctactcaggaggctgaggcaggagaatagcgtgaacccgggaggcggagcttgcagtgagctgagatcgcgccactgcactccagcctaggtgacaaagcgagactctgtct

SEQ ID NO: 237118 - DNA, 236 bp, Homo sapiens
gtggctcatatctgtaatcccagaactttaggaggatcacttgagcccaggagttggagaccagcctggacaacataatgagaccctcgactccatgcatggtgatgtgtggcagtagtccagactactaggaagctgaggcaggagcttcccttgagcccaggagggaatgctacagagagcaatgaacatgtggctgcgctccagtctgggcaacagagtgagaccctgtctcc

SEQ ID NO: 237119 - DNA, 379 bp, Homo sapiens
cagattcaggaccacggccagcacccacactgccttccgtaaacactgagctaaataaacctagagccttggtgatgagatcagcactgcctttagcactctggctgtcaactgaaaacagcagcagcagcagcagcagcagcaacaccaccaccaacaacaacgacaactgttgcatatataactgaagatccacagagtccctctttccagtgttagttgctacaaggagtgagagaatgaagatctgacctcaaggaatacaagagttttgttcaaagttccaagactaagctattagaagggagggagggcctggtgccatgtcatctctgaccaagagaattggtagaatagaaataatctatttctcacgtgg

SEQ ID NO: 237120 - DNA, 457 bp, Homo sapiens
cgagagagcattctttataaagtgcagataatctaaacatctcaatttactcactttattttattctctttccttctctttttaaatccaggtaaggaattgtgaaattagtttgtaagtcactttctcctcccccggctttgtctgttcccttttgggacttaataattgggctggaggaggcaaggggaaagattaccacatgcccagaagtatgaatcttggaagaggtaaaactggttaaaagccacaacacagacacacacgtaccaaaagcagggaggagaaaaagaaggatgagaaatgatgaaaaagaaaaatttcagggttgagggtgaggggagggaactcagagtacaggtcaataggtgcagcaaaccaccatgacacacgcatacctatgaaacaaacctgcatgttctgcacatgtatcctgttttgttttgtttttttagaa

SEQ ID NO: 237121 - DNA, 299 bp, Homo sapiens
gaaagaagtcagtcactacagaccacatattatatgatgccactcatttgaaatgtccagaacagaccaatctagagagaaagtagattcgtgttcaaccaggattaaggggaagaggtgagggaaggaaatgggaagtgagtgctaataagtgggggatttctcattggggcaatgaaaatattctaagcacagattgtggtgatggttgcacagctctactatattaaaaccattgacttgtatactttaaacaagtgagttttgtggtatatgaattctatttcagttaagatgtt

SEQ ID NO: 237122 - DNA, 431 bp, Homo sapiens
taggtactcaaagaaatatttgtggaagtaaattcaaaggattctccatgaccttgtttcatacggacatcatgaagtgggaccctctccaaaagctccctggaagaacaaaagaagttttgaagcatgtcaaagctactcatggttacaatctttaggatgaggcagacagacaaaaataatgctaaaaataacaatagtactaacattctgaagtaaaatttcctaggtggagtgctgttgctcttcaggaacagcagtagttgaggattgtcaagtaccctgaagcacaagggacaataaatgtgacaagaacagctcctgggtttgggggattattcaacaacgattagattggttagagacagtgcacttttgtatgtatatccttgcttaagagtagagaaaataaaatgtaagatttttgaata

SEQ ID NO: 237123 - DNA, 1066 bp, Homo sapiens
gcacatctgtctcccttcctcccaagtcccgggccagtacagccggcaccacccaccaaggaagcctcaggcaacctgatgaatggaggcattcaacaacacaaaccgagcacctactgtgtgccaggccacagacagggccctgccctgaggcacacgtgtgatgagggcggagagtgcacaaaaagagatataaacgctgggcagaggagtgccaggcagggcaggtcacggtctgtgtggagagcctcctgagggggtgaggaatcggccggaaagaaggactttaagagtgtccaggaatgacgtgcaaaggccctgtggtggtgaggagagggaggggccagcgtggcaagtaaggtggtcggcccccggggacacgtctgcagtgcctggccacccacggccggatgaggattagggggcgctggcctagcaggcctctcactctcagactccaagggccaagaaaaactacggacaggaagcccgggtctggaggcgtcctttgttcggggccgccatcaaggagcactcacccctatcccaggctcccggggcggctgttccggaagccccgcccctttccagccgcgcgcggccgcgcccgcctgttaatcacaggcagcgcgcgccagtacaagaccagcctcgccccgggggccccgcccacaggtcagccccgcccctttccgctcaccccgccccgcccctccgcagtgtgacggccaatcaggggcgtctgcccgggctgggggctggggcatgtgcgaacacaaaaggcaggaaatacgagtagtctggggcgctgtcaccatggctacctgcgcccgcgcgccgccccgcgcccagtcccggcactggcccgtgggtatgccgggcgggaggctcctgcggggcgctgggcagccctctccccacagggctgcaagaccctgggcctccacttcctagtctgtgaaatggggtcacgttttgcccagggctgaattcactcatacttcaacaaacatttattgagtgcctactatgttcgggtgcttgagatccaccactataagagatt

SEQ ID NO: 237124 - DNA, 873 bp, Homo sapiens
tggagtcagagtcttgctctgtgcccaggctggagtgcagtggcacaatctaggctcactgcaacctctgcctcccaggtttaagcgattctcctacctcagcctcctgggtagctgggactataggcacgcgccaccacatctggctaatttttgtatttttagtagagacggggtttcaccatgttggccaggctggtctctaattcttgacctcaggtgatccgcccgctttggcctccaaagtgctgggattacaggcgcgagccaccgtgcctgcctcttatctataatttttatgaagctaatatgacaaagttgtctccttccctccacaagggcaaatacgctcatgccctcctaatcctgtattgaaccatatccttggcatattttttcaaacttttacatacatttatgaataaatgtatgttatggttttgtgtattttaaaaatattgtctaagtggcaccatattatatgtataattctatagcatgtttatgtttttgaggtctatccatggtgacatctattgagttcattcacgttagtagttctgtaatgctccatcatgagactgtagcagaacatccatctcttcctccatcgatgggcgactaggttgttccctgttttgcttttataaacaatgctttactgacagccttaaaaatgtgtgagaagatctctagggtttatacctggacatgtaattgttttgggaatagtagttgttatgtgttgaaatgtgcccccaaaaaagatacgtttaagttctaacctggggaacccattaatgtgatctatttgaaaatagggtctttacagatgtaatcaggcgaagatgaggcaattaagatgcaccctac

SEQ ID NO: 237125 - DNA, 286 bp, Homo sapiens
tggtgtggacttgaagagggtgctcttggatccaagaacttgagaccaactctaactatcttaatctatttattgagagtgtatcagagcttgcagaaccaacccaatgtgtgggtttgggtgtggagagcaaacacagtagtcctgaaggctggaaagctggtctttcacctggaatgggtgggcttggacatcacctctgcattgctggactgtggtatggtctcacaccacaagaagatttaagcaaccttattaacttaataaagatttaaagacgttgagc

SEQ ID NO: 237126 - DNA, 1645 bp, Homo sapiens
  misc_feature (1011)..(1011): n is a, c, g, or t
atgaaatgcttaggtttccaggccagtctacagaggaacatttatctcttatggtagttaaactgtagtactgtggactctggccacaatgtaaatcaatcttcatgggaatatgcctttgctataggacctcctctccccttcagagctgcagtagcatttgtgactctgatctgcagaccctgtagtgactctaaaccaggagcaactaccactactgtggcatggagtggggaaaaaggtaattggaaaagggtggagatggggaaggacctaccaaatgcctttgttgacacagtagagaagtcatcagacataacattgaatggaggcaataagagagttcctatggccctatcaagcttattagtaggtgttttaacaagaaatatgtaaaaattattacttgtcggccgggcgtggtggctcatgcctgtaatcccagcactctgggaggccgaggcgggtggctcactaggtcaggagttcaagacaagcctggccaagatggtgaaaccccacctctactaaaaatacaaaaattagctaggcgtggtggtgggcgcctgtaatcccagctactcaggaggctgaggcaggagactcacttgaacccgggaggtggaggttgcagtgagccgagatcgtgccactgcactgcagcctgggcgacagagcaagactccgtctccaaaaaaaaaaaaaaaaaaaaaattgtttgcctgcataccctagcacagagtactgtaccttgaaatattcactttgtaacctcaagaaaagacgttgagggagctgtggaattagcaaagagaatgcagtgccacccataaacggagtgatgttttgaggagcagaggaactttgagggaggaaagtgcaacaggaaaaataactgcaggtgtggaaaaacaaatataaatatcttctcaattccaatcacctcctaccttcctataccaggcctcagaaggcagcaggctatgataataaatttgattttatatggcnttgaacccaggattttattttataacatatacacttactgttattcctggtcttcaagagttcttgtcatcctcaaaaagacaaaaaaggtaccaaaacaaaaaattaactacagtattttatagatgtgagagaagtgggcagaaataatacggctttaggctaaaaaaggaaatgaggttatttcttgggggagccaatattggcgatttctgagggagcgatccttacgtgaatataaaaaattgtgacagccaccattcctcctgctaactgatctaaatccatccccttgggaaacgcccctgaggtatctatcaggtgtagttcagccagagggagtaaacccaccgggccctcgtcctttcctagcaccaccatttaaagggatgtttgaggggtagggcagcggagcattccagacacggagttaaacccgccccaccccgctggcccacgtccagcccgatcaagaattggaggagagaggagcagggcgtggtggcgcgggcctggagtcccagctacccgggaggctggggcgggaggatcgcttgaggctgcagtgagccgtgattgcgccactgcactccagtctgggcgacaaagcgagaccctgcctcaaaaaaaagtg

SEQ ID NO: 237127 - DNA, 641 bp, Homo sapiens
gtgagccgagatcgtaccactgtactccagcctgggtgacagagtgaaactccatctcaaaacaaaacaaaacaaaaaaagggcaaaagaaagagaaggcactgagattctgctctcggtgggaagtctgatacctctagcatacatactttaagttggaccccagaagacagtaccctcaaggtcaaggtgggccaaaagtaagccggccctcaggtggtcttgtatggattatataactaccaggtggtccagagaacctcaagtgttgaatgtggacaaaggtagtccagaattgtttgtgtccccaggtacctgataaaaacaaaagaaaactatctctggaagaaagtatcatcatcctaactcttaagtttttcctacacttaatttttcaaatatgagaccagtccaaagtataagataatcatgcacacaaagtcatcactataaattggaactagcacactagaaagactcacaagacttcagccaaattattagatacagactgtcaaaaactaggttttcttttaaaaaaaaaaacacaaaactcgaggcggggcccggtacccatttcgcctatagtgagccgattaccattccttgcccgcggtttacaacgtcgtgactggggctgg

SEQ ID NO: 237128 - DNA, 553 bp, Homo sapiens
ctgttcctattcggccatcttggctcctccgaaagcataacttttatatgcactgagaaaccaaaaaattgtgtgacttgctttattgtgatattccctttatttcagtggtctggaatggaacccctcacaatatctctgagatatgcctgtatttctgagtgtgtctatgtgggtatttccagaagagattagcatttgaatcactagactgagtaaaaaggatcactgctgatgtaagcaggcatcctccaatttgttgagaacctgaacagagcaaaaagtccgagtaaggacaaattctctctttcttcttgagtgaggacatttatcttttcctgggaaatcaaagctcttggttctcaggcctttggacttgaaccgaattatgccactggttttcctggttcttcagcttgcagatggcatattgtgggatttcacctccataatcaggtaagccaatttccataagtctgctcttatatttataaatctatatattggttccgtttgtctggagaactctactaataaagtatcaaaattttgt

SEQ ID NO: 237129 - DNA, 348 bp, Homo sapiens
ctcaccatctgccgtctgcaagcttgaggcccaggaaggctggtggtgaagttccagtctgaatctgaaagcctgagaaccaggagaaccaatggtgtgagtccaggtctgaagacctgagaaccagcagcatttacgtccaaggtcagaagtgttctattcagaccttcaacaggtgatgtacacgggggagggtggtctttttttcagcccaagtcaaatgctaatctcatccagaaacaccttcacagacatgcccggaaatggtatttagcaaaaaatctgggcatcccttgaccctatcaagttaacacataacattaatcaccccagggagtaagaaagaat

SEQ ID NO: 237130 - DNA, 412 bp, Homo sapiens
gcactttgatgctggctgcgcccatttgtgggcctctggcctccccaggccaccttctgagagcacagggagctgtgtgggccagaaaaggagcaggggctttggggccgccaggcgggcgttgcctcccctgaactgggtaacttttctcttcccctccctagcctccagtttccaattctgtaaaatgaggatactggctttttctccttgagttatccttgagattaaacataaatatttaaagtacctagcacatgacaaattaacaaatggtatgtcttaaaataatcactgggcatgatggcatgtacctgtaattgcagctactcgggacgccgaggtgggaggctcgcttgcgcccaggagatcaagaccagctagggcaatatagtgagaccctttctccaga

SEQ ID NO: 237131 - DNA, 611 bp, Homo sapiens
gagtcttgagcctttcttcatcacctcagtcagaagactctgtgattggagattccaagagatcatcctcgatcaccattttatgcgggcagagcaaagaataaaaatgcttaatacctggacagatggcccaagagtcattggagtgtgaagctggcaatgtttccttcgtagtgagcacatgcttatccactttagaataaacaaacccagtggtataggtttgtttatcaacaggagattagaggtggaacatgaacagttcaaatgcagtccaatctccacacattgggtctggagtaacatcagcaagataattacatataaaagttgagcttcaattaattgggagttctaggcctataaactaaggtttaggaaatttgcctttgctagagcttttgaagagcaagaggaaggaatcaaggcacagcacctgaccaacttcgggagaacaaagcctccatctggaccaaagggaaagagagctggtcgcctgtggagcagcaaagaacaaggctttgcttccctttgaagagctggcgttcttgttaatcacctggcaaagtcttaatttaaagagggactcttagagaaggggagaatcccaa

SEQ ID NO: 237132 - DNA, 152 bp, Homo sapiens
caatcaaatgagatttatcacaagaattggtttaaaatggaaaattaactaatgtagtccaccatgttaatagagtaaatagtaaaaccacatgattattcaatagatacagaaaaagcacttgactaaatccaatgcctactcatgattaa

SEQ ID NO: 237133 - DNA, 1498 bp, Homo sapiens
tttatctgggaattttgaatgattccaactccttagtatagacatttacaggcttttgggcattatgaaatcgtactatttttaatttgatttcaccacttctcctctgtcttataaaaagctgacattgagcacatgtgtccttataatttttaaggtgaatcaaaagtaaacctgttttgagtatttggatatagttttgcagtagctcttgaggttactagggttgcaaaatcaagtttgagaattatagtgctagatttatgggtgaaatggattacactaattagtctgacatttagtcaccttgttttaaaaaagcaaggcaatattctggcagtgatattgaactccagatttctttccatatactcacttatgaaatttacttcaacatggcataccagaactgactactaatttctttccccagaataatttaaattctttacgtctcattgtatttagtacttgtcagagctcctggaaggacagataaaagataaatgcagacaattattcattgctcagcttaggttcatttcagccggtcattctcttgaccttaccctggacgtccttattccccagaaccactcttcctaattcagaggaacgtgcgtggctcctaatttctggagctaacacccactaccaccagttttgaactccatgctcttttttattttccagatggagtcttgctctgtcacccatgctggaggacagtggcgccatctctgctcactgaaacctcctcctcctgggttcaagcaattctcttacctcagccccccaagtagttgggattataagcgtgtgctaccacacctggctcaattttatattttgtatttttagtagagatgttggccaggctggtctccaactcctgacctcaagtgatccacccacctcggccctcccaaagtgctgggattacacgtgtgagccaccgtgcctggccagaaggctgtgctctcttagctcttcaaggatgctctattgttattcttcttctccctatatctctactggagattttgtcttgtgggtaaaatatgcttaagtttaccatatcttaagcaaaagaaaacacacaaacaacaacaaaaaaatcactcctctctatactaatactttgcctcttggtctcttattatccgtctccaccaggccctgtctctggggtcaagggtaagagctcacatagaggcacaccatatatctacatatttgaaagttgtaatatcaagtttgaattaaagtggttaagtaaatactcttaggtgaaatttgtgcaaattatgagtataaagagggtgagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggcttcaggcagg

SEQ ID NO: 237134 - DNA, 477 bp, Homo sapiens
tgaggtcaggagtttgagaccagcctggccaatatggcgaaaccccatctctactaaaaatacaaaaattacccaggtgtggtggcacgtgcctgtaatcccagctacttgggaggttgaggcaggagaatcacctgaaccccagggggtggaggttgcagtgagccgagatcacaccactgcattccagcgtgggtgacagagtgaaactctgtctcaaaaagataaataaaatcgtttatttgtaatactggattagaaaatgtccatgagctcttccgtgggctctgattgttggttaaaatatatgtgctcaaatacagaatcgttgttatactgtgactttttgctatgtttgtgtatgtatgaaaaaaacgagagagaaagaaaaatgaagctggagctctaaggaacttttttctttatgtaaaatttctataatgttataatattcattttataaataaaataatgtct

SEQ ID NO: 237135 - DNA, 408 bp, Homo sapiens
tgaaaaaacatggagtcatttcaatctcatttgatggcgctccatcattcagctgctcaggccctactcctttcatagtccactggcagattcttttagctcctgcttcaaaatatatccagaatccaaccatatctcaccatctctattgtttctatccttgtccgaatctttctagcctggactactgcaaaactggatgcttgaaggtaatagtgaaatgtcttcaaaattctaaagaaaaatgagtttgaacatagaactgcaggcccaataaaaataaagtgtgaggaaaaaataaaggccttgtcaaacacacaaggactcctagtttctctcccatgcaccctttctgggggaaaaaaaggcacctgtaaatatacttcagcaaacagaaaagacaaattc

SEQ ID NO: 237136 - DNA, 446 bp, Homo sapiens
ttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttg

SEQ ID NO: 237137 - DNA, 215 bp, Homo sapiens
agtagcagggactacaggcatatgccattgtgcctgtaggtctcacatttaatgtgagatttgctctcttaacagatttttgagtatacaatacaatacaatataggcacagtgttgtacagcagatctctagaattcatttgtcttatataactgaaggtttatacctattgagtagcacctcacaatttcccctttctcccagcccccagaaa

SEQ ID NO: 237138 - DNA, 430 bp, Homo sapiens
atgtcttctgccacctgccaagtttttctcaggctttggtgacatcagcgccctgggtacatgtgctgggcaggggatcacagctgcgtggtctgggaccctggtgcagggaaccacacagtacctccaaagcatctcacccttcactggcatttcagaacagccagagaccccaagtttcaatcctaaggaatgagccattcaccccagcacacacagtgctggaggaacatgccaccctccacttccagaagcccataaattgtacctgtcccccatgtggggaggataaggtgtctggggagatgaagggcctgtcccactgtccatctagatggctgggccaggccaggcaattttgctgatgtcacctctctggagatattaaatattgataatacaataaattttccatggaccttctaagact

SEQ ID NO: 237139 - DNA, 1707 bp, Homo sapiens
  misc_feature (822)..(822): n is a, c, g, or t
tggtagagatggggatcttgctgtgttgcccagggtggtggtctccagctcctggcctcaagcaatcctactgcctcagcctcccacactgctgggattacaggtgtaagccaccacacctggccactgatccctttcagtctaaatttggtttctcttaccttccccaaaatgtcaggaaaaattacctccacccatctccatctcagtaaacaatattcaatattcttcccacatcaaagctggccttaagggacaggttcgctgactctcaagattaagccttcaacccctagttcccaccttcaacaaggcatggattcttagcttctttgggaaaggtcaaatgggaaggaagctagcagcttggaggtaagctctgcctcaaggcaatcagattatgtcacaataccaaccaattctatgctgataacaggcagggaagatgaaacactttcaggccatcgagtagggggattaggagaccaagcactggtccccagagggatggcaacagaatacatatcgatttcatcacagctttctagtatgtcgtagacacaaagaaaaaaacaatagggctaattctacgcttgatttatcaggtatggtgttgttttttttgtttgtttgttttgtttttttgacacggagtcttactctgtcaccaggctggagtgcagtggcgcgatcttggcttactgcaacctctgcctcccgggttcaagcaattctctccctgcctcagcctcagcctcccaagtagctggtattacaggtgcctgccaccacacccagcttatttttatattatttagtagngatagggttttaccatattggccagccttgaactcctgacctcaggtgatttgcccgccttggcctcccaaactgctgggattacaggcgtgagccaccgcacccagcccacacccagctaattttttgtattttactaaaacagggtttcaccatgttgtccaggatggtcttaatctcctcaccttgtgatccacctacctcggcctcccaaagtgctgggattacaggcgtgagccactgcgcctggccagatatgttaacatagctccacacctacaggtcctcccctctgggccaagtttgaagaaacagattctcaccttggcttaaaggaccctagtggtttctacaaagatagtatttctgggtggacttggctcattttctgttcaaaagacccaagtctccccaagggcagacatgaaacagctaagcaaccaaacatctgggggctggttttctggattttggttgatctttttggacagaaaagcaccaacagcaaaagaaaaggcaagggggaataggtgaaggtgagccactgtcactacaacaactgagttcatccatgatgactaaggaatatcaggacattctagtttttgagaattcttcctttcagagtaaatgcttcttatatccttctggagaacagaactaaatccagaagctgtagtatcattaactttgcctagaaatctagaaatctcaacctcatatctgttcataactccttccctttctccaaagagaatacggaaggcaaagtccattttctgaatatggcatttttccttttctatttttttgagacagagttttgctcttgttgcccagactggagtgcagtggcacaatcttgactcaccgcaacctccgcct

SEQ ID NO: 237140 - DNA, 399 bp, Homo sapiens
ccatgcttgttacagagctgtcaccgtcatcagctttgccaatcattcatgcaacctatgagtaaaaaaaatgagtgggctggagggcctcagtaaggggaagacagtgttcataccctcctcatgtacggagcctgggagctgtccgaaccaagtacccagggaagcatcggccctccccacatcaaacacagagacacacagagtctgaattcttctgatatggccagtgctgacctgccagcctccaaaggtgtttcatttgcttatcaagaaatctggataaaatggcttgtgaataatgtcccagcatgctcctgacgaaccccaaaatgagattcaaaagcattaaacaggattggattgtcaataaatgatatgtaagaacattaacataaa

SEQ ID NO: 237141 - DNA, 4606 bp, Homo sapiens
  misc_feature (181)..(181): n is a, c, g, or t
  misc_feature (1425)..(1425): n is a, c, g, or t
  misc_feature (1816)..(1816): n is a, c, g, or t
  misc_feature (2669)..(2669): n is a, c, g, or t
  misc_feature (3505)..(3505): n is a, c, g, or t
  misc_feature (3579)..(3579): n is a, c, g, or t
  misc_feature (3696)..(3696): n is a, c, g, or t
  misc_feature (3855)..(3855): n is a, c, g, or t
  misc_feature (4488)..(4488): n is a, c, g, or t
aatgaataaggggataagcaaatgaagtgtatagggaaggacacacacattggaaaactctagatactgagtgttttcacagcctttgtccagcctgtgttacaaaagggtcatgttgaggtagattaactgggcctccagtatcatcttagctcaggctgctgtaacagggtaacatacngtggttcagacaacaggcatttctctctggtggttctggaggctgggaagtccaagatcaagatgctggcagattcaactcctggggaaggctctcttcctgctttacagatgattgccttctcactgtgttcctcacatggcagagagaaagagagagaaagagtatgtggtctctgttccttttcttataagacactaatcccatcatgggggcccatcctcatgacctcatctaaaccgaattacttcccaaagggcccacctccaaataccatcacattgggagttaggacttcaacaaatgaattggggtgaggcaaggcacaaacattcagtccataatgtagtgcattaaaattacacattttgggtccctgctttggcacaaaagtttgatcgctgtaatagaattctaaagtgacccccaagattccctcacccagtgtgcacaacctgtgtaatccccatcccttgagtgggtgggcctggcctaatcaagtgaactctttaaaagagggtgtagaggttagagatcaaagaagtcagagagattggaagcatgagagggatttttcttgaaggaaccaatagctacattataagagggctacaggatgagaaaataggagaggcctccaggagctcagagcagtccccagtaacagccagcaggaggtgggcaactcagtcctacaaccacaagcaactaaatttttgatgccaatcttatgagaccctacgcagagaacgcagccacaccacacctgcacttctgcctcactttcttgctggctgttactggggactgctctgagctcctaggtgatcacaaatttgtgtttcattaagccgctaggtttatagtaatttgttacatagcgtagaaagcttatctcctttctacaatagatcagtccacctctcctgggtcccgtcttattaaaaatagctctcatgtggttgttgattacatttttccctcgcattaatatataacctgttccttttaatctataaccttcttcttttttcccctactgtttcctttgggaatttacatagcaatttagaatctactacacacattgctatttgaacactcacagaaaactattatcttccccccgccctctacaaagcatctccagggctcatattattgtgaggcctctattttcatccttgcaaccaatgttcagagcttacagagcttatcatgtttattatataacaataagacanaagccaaaacaacttgctgctgggcttttaaacatagcaacagcagaaatcttttctgggcttgaggaagagccacttcaaatgtctactaatttcagcaattttctggtctatggaatgaaaagtctaaaactcacagccctctgctccaccatcggacttcatgacgcaagggggcgggtggggaagaaagtggcgcgctccctggttgttgggattcacaggctgcctctcaaaggagtattgcctgggtggcgaatgctcttggaggagaaaagagaaaggcatgaaacggggacccttcaaagttgccaccatggtaatgtcactcagtggcacagggcttgttcctcccttttgttctcttttcttttttttttttgagacggantctcggagtctcgttctgtcacccaggctggagtgcagtggcgctatctcagctcactgcaagctctgcctcctgggttcacaccattctcctccctcagcctcccgagtggctgggactacaggtgcctgccaccacgcctggctaattttttgtatttttattagagacggggtttcaccatgttaggatagtctcgatctccggacctcatgatccacctgcctcggcctcccaaagtgctggcattacaggtgggagctaccgcgcccggccccttttgttctcttttctaatgggaggaccatcagcagttgtattcaaatgaagagctcatttagttataagcactgaaaacctaatccggtttaagcacagcaggtttcttggctgacatagtggattgagccaaggctgtgctgttcccttgacctccctgtttggtttcattctcaggcacccactccccacacaatgcccttcacttccccacccctaacccaaatctctggcctcaccccatggaaaaagggtgcctctttcctccattccagccatgaacgctgggctgaccatttgagctttggtcacatgtcctccccttaaatcagtgcagtggccagggagatggaacccactgtttggccagcacagggcatgtgtgtctatttctagagcaggaagacgaggtcacgaggactgagtgtggggaaaggctgggtccccagaggaaaaccagggtgccattaccattggatggtggagtggacactgggtgaaccacggatggcctccagcagcaggacctgtcccagtaccagatagagctgggaaggcttgaagcccggagagnccatggggagcagaggcttctccccagctctgtgcttccactgagccaccccagcatcctgcacgttcatctatgtgtgtgtgtacctctcacccaggctgcctgcctggaagtagagtcaacgtggaggtgcatagcacagtgtttctctgcctcgggccttctaatttcctctcttggcccacaaggggtgggaatttctgtgccctgtccctgtgttcctctgagagtggactgtcttctctcccttcacaaaaatctgagggctgtatgaagacttcacgtggggggcctggcctgctgtgggtgggggtctgtgtgcagcaggaagtgggaagctggagtaaccctgggtcccaagcctttggaaagccacattgtccctagagctgtcactcgtggggttattccgtctctactcgtgtcctgttggatctgccacacagcaggacctctctgtatccacttcctatgggttctccccagagcatctttcaggggtgccatgacccctgctttctggattgaggcggtaggaagggctctctcttgtttctaattgaacattggcctatgccagactgaccaaatactccctgatcattcaaagtgtctcctccatgcccttgggcaggttccatttctgcttagccggagagacttccctattcaccaacaatgagttaaacactctttgatggggaaggtaaaagattttccctatgtaggatacatacttggaaatttagctcttagcagttgggtgtgctatatgcaaaagtaaagtgccaattagttttgctgaattttattaatattgggggtccattataaanccacccattaggtctataacagcacaacttaagatatatcctagtggggttatctatttgattcatgatgcttnaatcgttaattttatacttaacacagggaatgtgattgaatgattcatttatgtagcaaagttgtacttattaaatatttactcagtgtaaggtactgagccaaggaatacaaaganagctaacactcatttcttctcctccaaaagtttataatctactagatgaagcaagtgcgtagcacaaaaatagctaaatctgtttctttgggaagacagcttattggaagttcacctaacttcaagcttgaggagcttttactgaaactaactaaggtntggctcaggtgtctggtattaaaaagggccactcagaagctccaaatcccaggaaaggttctagatactggggaggggctatagagtttcagggattcttttgcttcaaaattaagtaagaattttttgactgctctgaaagaagctatgtgaaacccagtgggaaaaaaatgactaaattattcttgatcttttggcatttaacagagcaaaatgtaagtggaaaggaagcaggaatatcagattattaatggcacattaactatttgaagaacgtgttggtccatagagtgtgcagagaatccagtaaagggaatgtatcatgtgacgtcagaacagatggatgtcacattgagtcagcaatgatgaggggacaggtgttggacattgacagggtctgctatagtcaccagggagaagctgtctcaaagacttgagccccaagtctaaacatctctggaaagggccctgatttggcctatctttcgtcacaagtcacccttgggccaatcaccttgggcccaaaatagctgatgattctgtagtagccatgggagctactggggtgggaacatgtggggaaagtaactgtgaggggtgtgttctaactggggagttagtcctagaaaaagngtgtccagtatgcctgactttagctggagacatttctgtagctcagctttaattttccagtatttggcattgagttactattgttgcttctacaactctgacatgaagtcccagttct

SEQ ID NO: 237142 - DNA, 394 bp, Homo sapiens
aagcttgaaaagggttgtaatctctataaaatcccttggatcagaagttctctatctacttgatggaactcaaagacagctagtgtggaaatacccgagtctgaatggacacttggccctcctctgaagatgggctgcaagctgcctgccagatctgtgggttgaggatacccagagctacagtgaacttacatagttcccttatacaaattggaaaaagatagtcttctgcatgcaccttttttttttttttttttgagacggagtctcactctgctgcatggaccaactttttaaagttatccttcaagttgactcatgaggaaaacaaaagttatccctttgtgagaagaagcaggtttcctttcctatggattgatgtgaccctctacca

SEQ ID NO: 237143 - DNA, 1994 bp, Homo sapiens
atcctatgtactcaagaatgcaaactgtaaatcaatacctatgacttaaaggtgacatttcaacaattgtacatcctggagcctctcaggatctcaggatcattttgttcctgtcaaatatctaactttttaaataatttatgagcatttaactccacttcttacaattccaggatgaactttcttcattttagatgtgtatgttgtcattcaaagagccagttatttattcatcaaatattattgaacaagtactatgtgccaggcactaactatattgtgcagtgtggatataatagtggaaaaggcagtcacaacctagacctgaagcttacatggggaggaagagagaataaacatcaacttaggggttgtaccgatagttgttctttttttttgtttgtctgagacggggtttcactctgtcacccagattgtagtgcagtggtgtgatctctgctcactgcaacctctgcttcttgggctcgagtgattctccagcctcagcctcccaagtagctgggactacaggtgtgtgccaccaacgctcagctaatttttgtagagacagggttttaccatgttgcccaggctggtctcgaactcctgagctcaaagcaatcggtccgcctcagcctcgcaaagtgccgggattacaggtgtgagcctgtgccagacctaattgttaaattgtaattgtaatgattgttaaaaataaaaagaattggacagcgtaggcttcttatgtgaacatttaccaagaaggcatgatcttgtcttagatgaatggagtcagaatagagatcaaggagtgcttcctggaggaagaagcttttgagttgggctttaagtgtgaacaaatgtatttggagggtgctaatatttaagatgccatgagaaaaccccacattgaggaaagcagagatacagtctgatgaaactagcaaggtctgtaataagcagggctgtgttaagaattttggcttgatcaataaataaaatcagtggggaagctattaaggaatttgcactatgcagggatatgaccgtctggttacagtgtgtagaatagacaggaaagtatgggtacaagcagtggggagaccagattgaagacaataataataaacaagtgttcctattaatttccaaggagagacgtgctctgaagtccatagactatcaagatagagctaatttgggacttagatagtcctactgtgaagaattagcaaatacatggcactgctttgtggacaaaaatcagaaatctaacaggtttagcagaaaaagtgaaagaagagtgagaagaagaggatataagaataaacagacccaagaagatggcctcagaagacaaacacctgggataagctatgtgccagtttttctttttaatttttatttagatttagcaattaataagagctcattctgcctcaaaagtgcaccaagggctttatatttatcacagaactggaggtttagggaggtagagtaacttactcagggttacaaaatctgtaggtggcagagacaaaacttgaaccaagggctttctagtgtgaaatgttgactcctcacactacatgatggtcctctttaatggttacctcctgcccttggagttctccattactccaagcccattatgtttggaacgattctgagttcttctatacttcaccatggatacatgaaccttagccctaatggagccttagaaattgaccgggcgcggtggctcacgcctgtaatcccagcactttgggaggccgaggcgggcggatcacttgaggtcaggagatcgagatcatcctggctaatgcagtgaaaccccttctctgctaaaaatacaaaaaattagccaggtgtggtggtgggcgcctgtagtcccagctactcaggaggctgaggcaggagaatggcataaacccggaaggccgagcttgcagtgagccgagatccagccaacagtgcgagactccatctca

SEQ ID NO: 237144 - DNA, 453 bp, Homo sapiens
ccttgcaggcatgttgttaggaataaataacatgctgaattatagagattcacagaacaggtgacatttaagctggatcttgaaagaggagaaggggtttgccaggtggagatggcgcacaaaggaaggttacagacggttaatgtcaggaccatcctaccctaaccaaatgttctcagcatcaaataaggttgggaaatacttggaaagtagaagtaccatataagaatacggtactgataaaacttgatcagccattcaagtgaagtcagagcgaccacaccacccagcttatttttaaaattttttgtagagaattacaactccccatgccaccaaagaagatttgtaaatggatggtaaataagcacatgaagagttgctcaacatcattagccattagggaaatgcaaatcaaaaccataatgaaatacaactacatgcctattagcc

SEQ ID NO: 237145 - DNA, 805 bp, Homo sapiens
ataaatctgtattttgtttttcgtaatggctatcctcatttacgttcacaccaacagtgtgcaaggattccgttttcttcacatctttaccaacaagaatgaaactctgtctcaaaaaaaaaaaaaaatttgctgcccagaacaatgttatagggcttttgctctatattttggcagtagtagtttcagagttgtcaggccttacatttaagtactaatttatttcgagtttatttttacatatggtgtgagatgagggtctcaatttttatctctgcatgtggatatataagttttcttaattgaagattctgttctttccctttaatagtcacctgtactttaaaatcaactgtaaatacatggatatatttctgctgtttttttcttctgctccattgacctatgtctctgtttttattcaagtaccatactgttggttaccatagctatgtagtgtatttcaaagttagtcacttcttttgtcttgattgctttggctattcagggtcttttgtgataccatatgaattttagatatacttttaaaagtcattttgtgtaatacaaatattaatgtcagttcatgaatagtccatttatgtattaatttctatttagaatgtaaggcgtttcaactttttggttaaatttatttcaaactatagttattgtagatgtaattgtttttgaatttcattttgggatagttattaatgtagagaaatgctgtgactttttgatggtgcttttgtattttgaaagtttaataaattttgtttatttatttatttattttgaaatg

SEQ ID NO: 237146 - DNA, 833 bp, Homo sapiens
acggcttggacccagagtcggaggttgtagttgagccagggttgtgccattgcacttcagccttggcaacagaatgaaactctgtctcaaaaaaaaaaaaaaatttgctgcccagaacaatgttatagggcttttgctctatattttggcagtagtagtttcagagttgtcaggccttacatttaagtactaatttatttcgagtttatttttacatatggtgtgagatgagggtctcaatttttatctctgcatgtggatatataagttttcttaattgaagattctgttctttccctttaatagtcacctgtactttaaaatcaactgtaaatacatggatatatttctgctgtttttttcttctgctccattgacctatgtctctgtttttattcaagtaccatactgttggttaccatagctatgtagtgtatttcaaagttagtcacttcttttgtcttgattgctttggctattcagggtcttttgtgataccatatgaattttagatatacttttaaaacttttctatgaagtatatcacgtatttcgatagaggttgcattatacctgtaggtcattttgtgtaatacaaatattaatgtcagttcatgaatagtccatttatgtattaatttctatttagaatgtaaggcgtttcaactttttggttaaatttatttcaaactatagttattgtagatgtaattgtttttgaatttcattttgggatagttattaatgtagagaaatgctgtgactttttgatggtgcttttgtattttgaaagtttaataaattttgtttatttatttatttattttgaaatg

SEQ ID NO: 237147 - DNA, 424 bp, Homo sapiens
attcaatgttaacttgaaatagttcctgctggtaaacttgcatcatcatcttttctattcaccaacttgctgaggtcaactttcttccttggatcttggttgtctaactttattcttttcatttatatttattcctagcttttttgtatgtgctcctgatgagtataaaggaaaccaaaggctctcagcaaagttgcaaaacaagaaaagactgatttgtaaagacatgatgcagacatattttctagaatataagtgcagaatctctgcagcttcactacctgtactaaatatgtctacagatgccagagacttaaaaatatttttaaatgatttatgttatttattgagtcagtttcccttagaaacagactgaagtgagaatttgtgtgcatggaagatatctattaagggtgatcttagg

SEQ ID NO: 237148 - DNA, 433 bp, Homo sapiens
ttaccttttctcccagggctaccattaaatagaaaagcactacagaaaagttggccccttatatggaagagttctgtgtgatttggtgagacagtgaattttgctatacttttaatgaagtacagatttgtgtttaggagcataggctctgaagctggacttctttgattcaaattctggctttgtccctttctatatagatgacttaggcaaggagcttaaactttctgtgcctcaattttctcatttataaaatgatgagaataagagtacctgcctcaaaaagttgttgtaaagattaaagcgctgttgtatgaaaagctctttgaccaatgcttgacatataataagtgctagatgtgtgtgttattattaattattcttagaagtttattgtcacaaggctttaagttcttaagtaatatgaatgaaa

SEQ ID NO: 237149 - DNA, 342 bp, Homo sapiens
  misc_feature (331)..(331): n is a, c, g, or t
aaattgcaggagtacagatttcaatagagctcgaggaggcatttctaacagaagccagtgtttgactgcgcagggatgtctcgtgaggtgatgtggtgctgcagacttaagctatctgccttgaagatattctatgggatatttatttatttatttttgagagaggctctcactccattgcccaggctggagtgcagtggtgcaattttggctcaccataagctttgcctcctgtgttcaaatgatcctctcatctcagtctctcaagtagctgggactacaggcacgtaccaccatgcccagcctgggcaacatagggaaacctcatttntgcaaaaaaaa

SEQ ID NO: 237150 - DNA, 531 bp, Homo sapiens
ttcactctgctcctttctcctgatcttctggaagtttctttctgaatctagagaaactctcctcaccagagaggaatgatgtaagcaggctcaattaaatgcccgctatgtataatgaagcatattgttaggtgcagcatgggacatagaagttcaaagactatagctcttgaggatatctttatttagttggaaatacaagacagaaacattcaaagtaaagtaaatttattccttatatttaggtagcccttgttcatctacctcttctgaaattttgcaataattctgtgatgttggtaggaagggaatgtgatgttagataagaagtcagatggccggcacatccatctgacagccacaccactgatattaagggatttgttaatgtcatatggctcctaaagagctaggatatgcatccatatcttccagctccaagtacgagtttttttctttttaaaaaatattgtgtcacattataccctctaatgccaaattcatttaaaataaagaaaaagccatataaga

SEQ ID NO: 237151 - DNA, 459 bp, Homo sapiens
catttctacttaaaaaaagaaaaagataaattagccaggcatggtggcaggcgcctgtaatctcagctacttggaacgtgaggttgaacctgggaggcggaagttgcagagagctgagactgcaccactgcactccagcctgggtgacagcagagcaagactccatctccaaaaaaaaaaaaaaaaaaaaaaaaagacattttaaaatatagtttgttagtattctatttgcctttatatgtatctagtatatgaaactgcaggttttagagttaatcccaaagatcattaataagtctggacaatatagcaagaccccatctctgcaaaaagtttaaaaatttagctgggcatggtggcacctgtagtcttagatactcagtgggctaaggcaggaggtttgcctgagcccacgagtttgaggctgcagtaagctgtgttcacatgactgcactccag

SEQ ID NO: 237152 - DNA, 548 bp, Homo sapiens
tctgaattaatttataagtgatcataaatacagtcatgcactgtataatgatgttttggcatctatgatgttggtcccataagataataatggaactgaaaagttcctgtcagcaagtgacattgtagccattgtaatgttgtagcacaattcattactctattactcatgtgtttctggtaatgctggtggaaacaaaccagctgcgcgacccatcatttaatatttgataatgataaactagtatgttaactagtatatgtatttttacacgtttaatcattattttagagtgtacgccttctacttctaaaaacaaagttaactgtaaaatagactcaggtaagtccttcaggaggtattccagaagaaggcattgttgtcatgggagataacagctccatgcatgttattgcccctgaagaccttccagtaaaacgagatgtggaggtagaagacagtgatatttgaccctgatcctatgtaggtctaggctaatgtgtgtgattgtgtcttagtttttaacaaaaaagtttaaaaagtaaaaa

SEQ ID NO: 237153 - DNA, 671 bp, Homo sapiens
gtataggtacatttccaaatgcatgctgctgtggtaagcaacctctgaaatggccccccagtaatccctgactcctggtattcaagttgttgcaaaatacccacctcttaagtgtgggctggatttattaaatagcttctaatggatggaacatggcagatgtgatgggatgttacttcctagatctggttacaaagattgtggcttctatcttggggtgccctcttttgctcacttgctgtaagggaaactagctaccacgttacaaactcctatggagaggtcaacacgaaaagaaagtgatgtttcttagacaacagggagcaaggacatgggggctgccaatggccattgagtgagtgcagaagtagattctctccccggtgagtcttcagatatctgcagttctggccaacactttgactgtagcctcatgagagatcctaaaccggaggcacctagctaagccatgccacaaattgtgaaataataaatgtttgtggttttaaactactaaatttggggataatttgttacacagaaatagagaactaatatagctgcttatctttgagacgtatccatccgtgctgagaaccttggatatccctgactcctctctgttacatctcaaatctagttaccgcaataaatcatgttgtttctacctt

SEQ ID NO: 237154 - DNA, 450 bp, Homo sapiens
aaactctaaggaactggaatccttcctcccaaagtgagaggtcggattcccccaagggcaagaagaaggagcagcagatgcccagagaggcactgatgctcctcctctcatataaagtcccctggtgagcagggctttggactaggggtggggatggtgtaaatgcctgggcaccaagcactaggacttcagtctctagggccacagagggggtccttctgcttagccaggctctggggcagtgcatatagccagtagggccagcctctttttcttggattggtaagccctgtagtggaagcttctgagagtggctgatgtgggcagctcaattttgcccagactgtgtaagcccttgagtcctggtacaagcccaggaacaaagaggagtcactgggggaaaaaagccagacattagaagtgggggcttaaagcaggttttatccaatt

SEQ ID NO: 237155 - DNA, 567 bp, Homo sapiens
caaggaaaaagtattgaagcagcaagagcaaaatgaagatcacttacaagggaagttcacaaataaacggctgacttaccagcagaaacactgcaagccataaggcagtgggatagcacatccaaagtgctcaaaggaaaaaaaccctgccaatcaagaatcctatatccagcaaagttactgctgaaaaatgaaagtaaaaaataaacactttcccaggtaaacaaaaatagagagaattcactgctagcagacctgcctcacaagaaatactaaagaaagttcttcaggctgaaagcaagtgaccccagatgataatctggatcgacacaaaaagtgttagtaaaggtaattatgtaattagaaaagacactataaatgaattttttaacggatttgaacagcaactgtataaaaataagatgtatataacgtattaagcttgcatcatatagaaatgtaatatatgtgcaatgtatttgccaataaaagcacaaaggaggtgtgtgggagcaaaagtgtaatggtctaaggaaatgacagtgaagcaaaagcaacaattgtaac

SEQ ID NO: 237156 - DNA, 448 bp, Homo sapiens
agtgttgggccatggaggacgtgttcaggcttggtcagacaaagggaaggaggactggattttagttactgggaacagaacaagcagagatttttgccccaatatttaataatctattctttacctgcaacattatgttacctccagggctattcaggtcagccttaacaaaaatctgccttccggtttcccactgattccctagtatcatctctcccattcttgcctctgcttcaatccattatgcacttctttcccagcttgtgtttctcctttgtatcttcactagtttgctagcactctcatttgaaccttgagtaggtaagagctttttacttacatttcagagcagtttataaataggctgcttagtttcagccagcaggtacaagctttcattaaattcttcctccttcccatagtgctgttatctggagctcccaggaaa

SEQ ID NO: 237157 - DNA, 680 bp, Homo sapiens
gctttggctcccttggcctgatgacgtccgtcctggtctgccctgatggaaagacgattgaggctgaggccgctcatggaccgtcacccgccactatcgggagcaccagaagggcgggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaat

SEQ ID NO: 237158 - DNA, 450 bp, Homo sapiens
atccatctgtgtatttctggaacttagcaaaatactttatagaatatgtttcataactgttgatttaaattgaatcatctggagatttctcataaaacaaccaaaggtttacaggtcgtatttgaggaacccattgattttgatgaatacatttttaggaaaatgttgtttcatgtcttaatatctctgacactttgtagtagtagttcactctctttaacagtcttttgtttatctcctaattgtgctagttcattatgctatttggaaaaatgaactatttattcacttagaatgaaagttaattgagttaattctcattgtacattttaagaggcaaatcatgaatatattgtacaaatttttgcaatatgcaactttttaacatcctgatcaacaccaatagtaacatttcattagatttttaaataaaaattaaatatgacttta

SEQ ID NO: 237159 - DNA, 604 bp, Homo sapiens
gaagtagataatctttcagcggatatatccactagcatttattatagtcaggccagtgttaaaagtgaaaatatccaccagaaaagaactctgattctttaaagtcacctatgttaaaatgtaccaccaaaaaagaattacatgtgtataaatatgaggctattctgttaaaaatgatagtttaatgttactagtaatttgcttaacctaacaagtttcttaacgaaagatccaaatctaaaaaggaagcacacatgtttagatttaactgattaccatacaaatgtccggccaaacttaagagaaacccccttcaaaaatgattaaaggaaaaaggattcaacagatgttcaataataaatagagaagttcctagagaaataaaatttaaaaattgtttaatagtttacccaaatttgtaagctgtttgcacttagtcaagctttaaagtaactgcaaaggaaccatctatactaatctatattgattctaaatacacctttatcgtggctcatacatttagaaaatttcagacaataataaaggtcaaagccttgttcatgaagagttaataacccaagtgttaaataaccttcagttacca

SEQ ID NO: 237160 - DNA, 185 bp, Homo sapiens
caaagcctcagctcaggaagaccaactccaggaaggcctcctgggctgccccccacttcagatggggacccacgtctgttcttgctgccctgaggacacagtgcgcttggttctctcacaacatgcccttgcagaatgacagttctctgtccctgggtgtgcagcccctccagcctgggaattcc

SEQ ID NO: 237161 - DNA, 406 bp, Homo sapiens
agcaagtgtgttttatttatatttttttaaagtcatcccagggctgtgtccaggcaactgagggcctgtcaaagaaccgaatgtctaattccctttagaaaaaacaaagggattaggtgtccctgggactttaacaaatgcattgttggtggttttgatttaggtttcatttagggaaggcaagtgcagaaacgaggatgccaaagatccaggctaccagtgttgcgaagatgcctggagacaggcatgcataaaatgttggcggggatgtaaattagtgcagccttttggagggaaatttggcaacatctttcataaaaaatgagcgtgacctttgatgcagtaatttcatgctttgtaaactacactacgttaatagttgcacgtgtatacaaaaacctatgtt

SEQ ID NO: 237162 - DNA, 343 bp, Homo sapiens
atttcgctaagtaatttatgaaagggaaaactatttttcatgagcatcagaggagagatattgtacccactcttcagagacagaaactgaaattcaaagagaatttttaaaagcaagcttaaatggatcctgcagccatagagaaataaattctgcctgagggagcttgcaagtgaatcttcccaggctcacctgagaatgcatgatgagagtgcagcccagcagccaccttgactgcagccttgtgagacatcaagcagaggacccaactaagttgtgcccacacttctgactcacagatactttgaaataataaaagtacattgttttaccttgctgctca

SEQ ID NO: 237163 - DNA, 363 bp, Homo sapiens
tgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaaatgttttgtttgtttgttttttgagacaacagtctccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctacc

SEQ ID NO: 237164 - DNA, 507 bp, Homo sapiens
tatatatatatatatatatatattatgcatatatatatgcagtaatatatttgagttactaaaggaaaggaaatgcaacaagaattttacatctaacaaatctgtccttgaagcataaagggcacaaactgctatctacatgtaaggattcaatgaatgagattcatgttcctcaggctgtactagaaaacaagtgttagacaaacaacagaactagagagacactgatagaaggactggggttagcattcaatatgtagctacttacaaaatgagaccaaatgaaggtttagaaattggagagaatattatgtcatcaccatatgctctgataaagaagaaatggtacaaaagtaaacatgaggagagcagggaagggagggcattagtaaaaaatgtacaaaactctttttggcaattgtatggaagatgatagtattactataattattcttaggttgttccatacataatgtgaaataaagaaaattagtaattatggaatat

SEQ ID NO: 237165 - DNA, 681 bp, Homo sapiens
ccaacataaagtaaggattcaataaatactattgagagtgagagggctgggtgcggtggctcacgcttgtaatcccagcactttgggaggctgaggcaagcacatcatcacttgaggtcaggagtttgagaccagcctggtgaaaccccatctctactaaaaacacaaaaactagctgagtgtggtggcacatgcctgtagtcccagctactcaggaggctgaggcaggagaattgcttgaacccaggaggtggaggttgcagtgagccaggatcatgctactgcactccagcttgggtgacagagcgagactccacctcagaacaaacaaacaaacaaatatatatatacacacacacacacacacacacacacacacacacacacacatataattattaagaatgggagatagtactgagatttttttttttacttttcagattcctccaatatataaaatttcatctcatagttttaaaacatgggaaatattcaaaatacccattctgtcactgtagctaaagaatgactactagaatcagctcatatttttctggttcttcttgaaagttattcaatacatcaataattcaatatatgttactataaaccaggggttgggacattttttctgtaaaggtccagatagtaaatactttacacttttcaggctgagac

SEQ ID NO: 237166 - DNA, 606 bp, Homo sapiens
atatatctgcataatagatgcagtgattttgccaacttggagcctgtcagttgatcatctacattggaaggtgatttctgtctgtcctgcttcaacagctataccaaagttcgtgataattcttaatcatcattcaacatcatttagcagctataccaaagttcatgatgattcttgattgagagcatactacaattgaggccttcatagttctgctggaattccaacagggctggcctgagaaaaatccaaatgagagtaattagcagtcagaattgaggaaaccttctaataggaaaagagagaatgggaaaatgatttctacctaaagagcatgccaaaaatggattatacccgtctctgaaggacagaaactttaatgcagccttggaggcatcactcatttctttctccttccttaatgattcatggccttaccgttttctgatggattttgacagcagctactgtgagagcagagataagaggatttaaaagagatcaaacttagccaaaatctgactatacctagcaacttttctacagtttgatctttttatgtgaagagaaaaagaagtaatgattgagggattgttgtacttaatt

SEQ ID NO: 237167 - DNA, 221 bp, Homo sapiens
tcttcatttattagagacattaattttataatattggacatagggattggcaatttttaataaagaaaatggttttacatatcaatggcaatagatgggttaaaatatcatttgtaattcactatccatatcctaagataaacccaggaatatacagtacttctgtagtgtccagccattacttagcaagggaagagggagggtgggagggagggaggggg

SEQ ID NO: 237168 - DNA, 437 bp, Homo sapiens
cacttttttttgtatcatttacaaagaaatatttcttagccaattgagacctactctgaaaaactgaaaatcccacaatggaaactaggagcaagatatttgtaaaaatgccttgcaatatgtggattcatctcacaaagttaaaactttgttttgattctacaagttggaaacgctcttttcataggatctgcaaagggacattttctagcccattgaggacaatagaaaaaaacacacaaatatcccacgataaaaactagaaacaagctatctgtgaaaatgctttgtgatttggggattcatctcaccgagttaaacctttcttttcattcaacacattgaaaacacttttttttagaatctatgaagagacatttcttgtaactaacctgcacaatgtgcacatgtaccctaaaacttaaagtataataata

SEQ ID NO: 237169 - DNA, 366 bp, Homo sapiens
gttagagaggagaggaaatctttgggattaaagcctgacagcagttaccatcatatcacctgagatgactttcccaacccttaaagtgagaaggataaaccatttttccaaagatataacatcacaggagggaaatttcctgggcttatttgcataaatgatgagtcaggttaggagaacactgactgactctgatgtgtccgccctattacatatgtgatggacatgttgaacaagggggtctcatgattagtaactagctcttccctgtagcgtgaatgaactcaagagcaggtactgtgatttttctgttccctctcaaataccaatgtcatttcatcatgagaatggctagttacatttaat

SEQ ID NO: 237170 - DNA, 1562 bp, Homo sapiens
attatgacacccgtctgtgtcactgctcttgacaatgacagaacctacaaaaggatccagggtcctcagcccccatctgcctcccagcctcacttcctgcacttccatgaaaataacctttgttccccctacaaggaacttcttgcagttatccaaatgttccctgtcctggtgcacactgaggcccctgcatggagccaatccttcacttaaatcactatgcccccatgccttcatctggagaactcacacttctgttcagaccctcagatgtgactgcttccgtgttactgctttctctgccatttcactgggcctggaaaataccttctgcaaactccagggagagttactcagctcccccttccctggtgctttgctgatgcctctgtcacagcactcagcacatgacactcggattactggctcacagtcccctgcttccaaaggctctgcctgcatgcctccaggggttatttccagagcacccagctcagtgcctgtccagtggtgaacgtccatacatgtgtgttgaatgaatgagtggacagatgtgtgcagggagaatgtgaattcactcccacaaagcttgtatgtgccaaaaaatattggttatttttcataattgagctaatcttgtttccctagccctatctcctacatggcaggagcatagagaaatttttatccagctgagtaaatgtagcccagtgctgtattttaaacagtcccttaaggtaaagtgatttgtctctcagattgcctctctcccagctcctctcttggacggagctggacacatggcggagagggactttgagatcccaggaagcagggaatgatgagggctggtcctaggagccacgcgagccctctggatgcttgctcatctctgctgcatggggctaggctgaactgctgtctgaactggtacctgctgaggtccatctggttagggcatccactgctggagtccatgcccttagggcatccactgctggagtccatgtcctctacttgcctccggccttgaaatctccacctctgctctctgacccttgagttctgttggcccactgactttagcacctctatacctcagctgaggacatggacacttccaggtccctcacactccgtggaggagctagaggagacagcagccctatgacaggctcattggcctatcggtgtcccatcacagcctctgtaacagccaggataagcttcaagccaagggctgaccttctcccagggtctgccgaggcactccaccagccccagtgttgctgggcttccccgtggccatctgggtgtttctaaagcaactccccaccaacctcttgggctgtggtgaccaagggctaaaaattaagtggggaccctggtatctgacttttgctccacttctgacaccttctttctctcccgtttcactaggactggaaaatacaggctttttttcccaatccttgtttctctcaaaccaagacctcatctacataaaacatctagggtcaggcccatccactctagctcttattacagagaaagagctccag

SEQ ID NO: 237171 - DNA, 540 bp, Homo sapiens
ggaatctaaacctgtatttccactaggagcagtggcttggtatttggtaattcattgcttgaggtgactttatagaatataactaccacaaataatgaatcaactatacatacatgggtgtgtgtgtgtgtgtgtgtacgtgtgtgtgtctgtgtctgtttatgtgtgtgtgtgttttggagtactttagtgcaaattgctgacatcttaacattttatctgaaaatgtttcattatgtctctctaacatattggttcttaaagtgtagtgtgaggagtcctggagacacctgagacagaccctttcaggtgactgggaaatcctttttccaactacatatctccatgaggttggatttgtcttcatatactttatccaaaacagcatgttacaacattaaatgcagaagcaaatatgggaatctagctgtcttgtactgaggcagacatttaagagattttcagaaacgtaaaacattcctaaattctttgtttctgaaaatgcaattattttaataaaattttatttacgataatcag

SEQ ID NO: 237172 - DNA, 1075 bp, Homo sapiens
cttggctcaccacctaagactgaacaagcactaaaggacagaccagcccgctaacagctcactccaaaaatgagcgggactcccagagaaactatttttattggagcatcctggttttgccacctgctcaccccactgcctgttcttctctccaaggaggcttctgccagccctgcttgtccttccctagaaaaggaaagccttttcctgtttgatcctgagacacctgtagattgagtttggaatattctccctattgcaatagtatttttgaataagttttatttttccctacctctggttgatttttaattaataccagtaagcttggatgaaagcctgcacaccttaggtgtgtgtgtgtgtgtgtatgtatgtactttagcattatcataaagtaataacagtaaaatcaaacaaacacagatggataagcaatatgttggactagtatgaaaatggcattgccagcagtgatatgatttttttttcaaaatggtacactttttgaagtataatcttattttaacctaaaatcttactatcagaaaatgcagtgtacattaaaatgttctgaactgcttttattcatatattaaatggttgtactcaaatatctacaaatttgtttttcacttatgtaattgtcttatagaatgttcaaaagtcttgcagaatgtgagacaattttctattgaatacgatcgctttatcattgcaagacatcaaacatccctgtttcctgccaaataaatgtacaatagcaataaatgtaaagatgtgttttgtaaaaaagatatatttttgagttacaaaacaaggattttaaaacttgaattgttacagtgaatatgtcttaatacaggccagagtcatttaggtaaaaaattacctcatatctattctttgcagtatcacttaaaggtgtttatttagcggcaaagatttttttttttgtgcctagaggcagatattttgccccatggctatttacggtatgaaactgtatttaaatgagtgtacatatataaaagctgccattctggctgtaaactattgcaggttatcaagatta

SEQ ID NO: 237173 - DNA, 1893 bp, Homo sapiens
  misc_feature (1520)..(1520): n is a, c, g, or t
ctttttcttttgagtccaatcttcagtcaagccttccgtgtgaatgatagtggccacttggggatctccatctgcattttattgtatggccacgcaaaaccttttatctaattcctagaagacatcgattgctgcatagcttggtgggtgaagaatggaaaagcacaatctcactttattttgctggtggctttgccctccctttcctacaagcagtcattcaggcctaatggttctgttcctcctaattattcatttgttcattcgttcattaattcattcagtctgccattcaatatatatttatcaagcatccactatgttccaggtgcgattccaggcttcagagatagaacagtgaatcaaactgataatgcccccctctccaggagccagcattctagcgagagagaatgacttgctgaattgtttcagttggaactttttttagactctgaaccttggaaaaagtccactttccatgggcttattaaatgtgctgaatcagacagttggtgctgtttactagagatcagggttcaaccagctttagctgcatgacccagaacatttgattttatgatttacaaaataaaaagttatggccctctgcagatgtcccatctaatttgctcattgtgttccttagaggcaatgtggtattgtgaaaaaagcaagaccaagctttgcggttcaagtggcccgtgcttgctgggcctcagtttcctgatctgtagaatgaggctggataaatctaagtttctctccaactctacagtctgatggttctagtactacaagatcaagatttttttcctaaagagccatttgtcttattttagcttcaagccaagccagggcatctgagaaataccaagcctccgttgtgatgtgtcgccatgaaaatgttggctgccctctggatgcaagtctgcttgtgctgtgctgtggctcagagttaaatttagataaaaatcagttaggagctaagaatattcccagctttcctgacaggttgtatccatcattatgggaggaaaaacaaggaactggctgcctggcgacagggagcgggccaggctgagtgtgaggtcaggcctcggctggaatctcacggacttgaaaggacagagacgtttcctgagatgtctgcggcagaatgtgggaggcttcagcctgaggaaagttcaagttggagagaaaggttgccagacctttgagtgacccacactgcttataacttctagaaggttcttttagggaaacctgcttagaatgaaaccctgaaacgtcctttgctgcctccttaacaacttgcattagagagtttcttcagccaaaaggcgaatgtctgttgagtggaaaggagaggacggagtcgatgttgtcccctgtgagatgtcatgtctcaggcagtatgctggacattcccgagacgccagctctgctcaggtgacttgtgtgccctgcccttgtaagcctcgaattactcatcgtgaaattgaggtcaagccactcantcacagacagggctgtggtaacaataaaatgaagggtgcttagcacattgaaaataactcaggcagtgttccattattgctatgggctgggcgtggtggctcacgcctataatcccagcactttaggaggccaaggtgggtgaatctcttgagcccatgagtttgagaccagcctgggcaacatggtgaaacttcatctgtacaaaaaataaaaaattaggcaggcatagtggcacgtgcctgtggtcccagcaactagggaggatgaagtgggaggattgcttgagcctgggaggtcgaggctgcggtgagctgtgatagcaccattgcacaatctaaactgggccacagagcaagacctcgtctccaaagg

SEQ ID NO: 237174 - DNA, 379 bp, Homo sapiens
cagggttgctggtcattactttcctcctggccccatgccctttgggtatgcatgacctgataaggagcttaagcaaacccacattaatagcactaaattaggctctatggaaagagaactccacagtcaggatctttgtgcactcaggacgggaagcatggacaccctggagagcatttgtattagcatgagccactgtgcccgacccctgtcagcagttttgctcttcccctctctccctccaggccagaggccatgatctacatccaacttctctgcaaattcctgaactctgactcgattgtccctgtcaatcctgcctttgtgtcttccctttgaacctcactttctgattctcctggcttctcttcttgactgt

SEQ ID NO: 237175 - DNA, 378 bp, Homo sapiens
agtccccatggagtctgttgccccaggaaccctgaatctgaggcttctgtcctgggaagcagactcttgaaaggcagcagtgtgaggctctggtgagtcaaaatgactgcgataaggtccctgttctccaggtgcttacaggctggcagacttggaaatatttttttggggtagaagacagcatcacaattaaatatatgcaaactctacaacagacatcccctgtgagaattttagagaaatataaagccctgaagtacttaggcactggatcaaatacagtttaggagatacaacttttgtataaagttaaggcttttttgaagattgaaataaaattgttttaaggttgaagcatccttaatgcaaaaaatttca

SEQ ID NO: 237176 - DNA, 1476 bp, Homo sapiens
aacgtaatgaaacctcgtctctacaataagtagaaaaattagccatgtgtggtagtgcatgcctgtggtcccaggtacttgggaggctgaggcagcaggatcacttggacctgaggggtcgaggctgcagtcagccctgattgctgccactgcactccagtctgggcaacagagaagactgtctcaaaacaaaaacaacattactcaggaatgaaggaaatggtggaattgagaagacgggactaaagccaattaatggggtatggcaatagtctagttggaagaggttaaggtcatgcagtaggacataatagggctgaagaagtatggatggaattgacaaacttttaaagggtagaattcacaagatttgatgaacaaatgcatgtaagagaacatatacaatgcattgtaagggacttactgctataattaaccattgtatgtttccaaaatgtatgtgtataaatagtcaacagtgataacaggatccaatcatggacaaccagtttgattggatataaattttgaaagaaagtgtgtgtgtgtttgtgtgtgtgtatgtgtgaatgtgtctggggaagttaagaaaaattttgagtttgccctattgatggcagccagctgcagcagggaggtgtgactggggctgcacactccatggagcctgtgggagccccgccccttctgagttgaggcaggagcccctggtgccattgtggctgccctcccaggtgcaggacctgggcatctctgcagcctgcacccttgggggaccagcaagacaccctactgcaatccctgcaggctcaggagtgtctgttcccaccgcctggactctctctactcccggggcctgctccaatctcagagcgggcttggggccaagaatggcaatgggaggcagattgattccagggtagaagtgggtgagtccccagtaagaccccaccttcaggtcagggagggcctgaagacaggggtccaggctgccagtcctgcagactggagtagggactcgtggtgcatcttctggcctgcccatggaccaatcggcatgtacttcctcccctcggaggtccataaaaaccctgggttcagccagagtagggcagaggactgccagaggaccaagagggcagagacctatgggtcaacaagcctaagagaggagctaccctctctgctgatagttggagatgatggaacagccagttgcagaaaggacctaccctccctgctgacagctgcagagacaacctgtgggcagagaagagccaccctctccagggcctcctctcttctgagagctgcagacattaggacgatcagttgcagagaggagccatcctctccagggcctcctctctactgagaactgaatacctgatggacaacctgcctacagagaggaaatacccactggaggtctctgagctgttgtaacactcaataaagttcatctttgtcttgttc

SEQ ID NO: 237177 - DNA, 891 bp, Homo sapiens
ttttgagacggagtctcactgtgtcacccaggctggagtgcagtggcatgatctcggcttactgcaacctccacctcctgggttcaggcgattcttctgcctcagcctcctaagtagctgggactacaggcgtgtgccactgtgtacagctaatttttgtattttttgtagagacaaggttttgccatgttggacaggctggtcttgaactcctgacctcaggtgatctgcctgccttggcctcccaaagtgctgggattacaggtgtgagccaccgtgcctggccgccaaacttgcatttgaatctgtccctaagacatctctctttggatatctaatagtaccaacaagtgaaacatgttcataatggtatttttgacctgtattgtgcaaatctccctcccgtgttaccattttagtaaatggcatcacaatgtgtaaaaccgtccaaaacaaaaaccagtactcacccttgagatttctttttccattatccagtatatccaatacattaggaaagcttatcagcccaatttacaaaacaccagtccaatccacccatttctctccttctcccttgccagcccttgttcaagccatgtaaagtgctttaaaccattgaatagcttccaatcacacttaggataaattcaaactctttactatggcttaaggccctacatcatcttatctctgtttcttctacatcatcttggtatacccttcacctccctaactcttttcagttcctagaacttgctaaagcttacctgtcttggtgcatttgtacttctctttcttctgcctagaatgttctcccctgacctgcctttttatccttcccaacctttaggtctctgttcaaaatcacctctgccgagagggccttcc

SEQ ID NO: 237178 - DNA, 709 bp, Homo sapiens
ggagctacaagggacatagaataatttggactccattactaccttaagagaccttcccctgacttctcttttaaaaaacctatgagtctctgtacccctgaacttactttccacacctatttctctcttcacccccaaaatccatattagaatgcccctgcaggctataaagcctttcataaaagtaaaatacccagtcttttcaagagaacaataaaataggcagtctcctacctcttgtcttactctaatataaactccatgaagataagtattgtatccatactgttcatgctgcacagcagttgcccttatctgcagggcgacgcatcccaagacccccagtggatgcttgaaactgcagagagtaacacacgtgattgccaccatcggaacacatttctgttcacgtcttccacccacagatttaatgccttttccatcttaactaagcactcatcatggactgtggccataacttttgcagttttagatgcaacagcaaaactaacattaattttttcttcttcttcacaatttcatgggtagatttgttcttaccgtagatcttagcaacctcagcatatgatgttttttcttttgagaactttcaccttttctcttaaagaaagcactttacagcttctctttggcatatctcaactgccagcatcactgctcttgaactttggggccattattaagtcag

SEQ ID NO: 237179 - DNA, 1386 bp, Homo sapiens
agtctctggtactcaggctggagtgcggtggtgtgatcttggctcactgtaaactcaagctcctgaactcaagcaattctcctgccttggcctcccaaagtgctgggattgcaggtgtgaactgccacacctggctccccgactattcttgtatcagaaatgtaactcacccactcaccaccagcccacactctgggttctcctatcactccactgcctgctcctcggctgatcacaatggaagaagagatcatggcacttgtcattgacaatggctccagcacatgcaaagctggctttgctgggtatagttccccgagccatgttcccctccatcactgggtatccctggcaccagggcatgatggtgggcataggccagaaggactcctacctgggtgatgaggcccagagcaagtgcagcatcctgaccctgaaagtgccccgtggaccaccgcatcatcaccaactgggatgacatggagaagatctggcaccacaccttctacgattagctgcacgtggctcccaaggagcacccagtgctgctgcctgaggccccgctgaaccccagggccaacagaaagaagatgactcggattgagaccttcaacaccccagcaaggtacacagccatccaggctgtgctgtccctgtacacctctggttacaccactggtattatcatacacagctgagacccacacggtgcccgtctacaagggctatgccttcccccatgccatcctgtgtctggatgactggcacctgaccaaccaccccatggagatcttcagggagcccagctactgcttcaccaccacagccaaacgggagatcttgtgcaacatcaaggagaagctgcggaaatggccaccacagcgtcctcctcctccctggagaagatctaggagctgtccaagtggttccagtgtctggaggtgctgttccaggcctccttcctgggtatggaatcttgtggcatccaccaggccaccttcaactccataaagtgtgatgtgcacatccgcaaggacctgtttgccaacatggtgctgtctggtgacacccccgtgtacctgggcatcacctacatgatgcagaagatcacgaccctggtgcccagctccaagaagatcatcaccttccctgagcgcaagtccttgtgtggattggcagcaccatcctggccgccttccagcagatgtggatcatcaagcaggagtaggatgaatcaagcccctccatcacccactgcaaatgcttctaaatggactgcaagcagacacgtgtcatgtgcttcatggattaatgcagaagtataaatttgcccctggcaaatgcatacacctcatgctagcctcaataaaccagaataagcctttc

SEQ ID NO: 237180 - DNA, 606 bp, Homo sapiens
ccaaagtactgggattacaggcatgagccactgcgccagtcctctggagctattaaaaaggcttctaattggtttccgcacttccactctggtttccgcacttccactctgatttgttattatatcttgttattgaggtgttattcacatgccatataattcatcctttaaagagaatttttttaaaaatttttgtggatatatagtaggtatatatatttatgaggtacatgagatgttttgatacaggcatataatgcataataatcacatcatggaaaatggggtatccatcccgttaaacatttatcttttgtgttacaaacaatccatttatactcttttagttgttttagaatgtataaattattactgcctatagtcaccctgttgtgctatcatgtagtaggccttattcattctttctatttttttggtacctattaaccacccctacctcccctacccttctaaaatatacagtttggctgggtgcagtggctcacacctgtaatcccagcactttgggaggctgaggtgtgaggatcacttgaggttaggagttcaataccaggtgggccaacattgtaaaacctgatctctact

SEQ ID NO: 237181 - DNA, 422 bp, Homo sapiens
gagactgagtctcgctctgttgcctaggctggagtgcagtggcgtgatctcggctcactgcaatctccccctcctgggttaaagtgattttcctgcctcagcctccctagtagctgggattacaggcgcatgccaccacacctagctaatttttgtattagtagagatcgggtttcaccatgttggccaggctggtctcgaacacctgacctcaagttaatccacccaccttggcttccctaagtgctgggttttacaggcatgagccaccacgcccagcctccctttgcatgttttttaaaaaggcattaagcatcttgcacatgttctttagtttcagtttgcatgagtcaacctgtgtgcatcattttccctttcactatttcttgtctttgctggtgaaattttaaagcttcagttta

SEQ ID NO: 237182 - DNA, 239 bp, Homo sapiens
ataggtatgggagaagacaataaacagataagcaaataaatacagctgacccctgaacaacacagaggttagcaccaatcccccatgcaatcaaaaatatacatatggtcaggcacagtggctcacacctgtaatcccagcactttgggaggccgaagtggatggatcacttgaggtcaggagttcaagacaagcctcgtcaacatggtgaaaccccgtctctactaaaaatacaaaaa

SEQ ID NO: 237183 - DNA, 447 bp, Homo sapiens
ggaggatcacttccggtcaggagttcaagaccagcctggggaacatagtgagaccagtctctacataaaattttataatttaaccgggtgtggtggtatacaactgtagtcccatctcagccttcaaagtgtgggattacagattcgaagcttcttgagcctgggactgtatcttgatcattgcagaatccttgccacctaatgcattgcctggcccaccatcggcacttggagaaatgattgttgagtgggcaagaagagggcaatatggcatagttgaactagcatgggatctggagctggaaagatcttcccagtgactggcagtcaccttgggccatccccaaactccccaagccccagtttctttctcagggaaatggggtggaggacatcacttcgcaactcaccaggttgttctgaaaaatacagtgagatgacataagg

SEQ ID NO: 237184 - DNA, 1712 bp, Homo sapiens
  misc_feature (137)..(137): n is a, c, g, or t
  misc_feature (1093)..(1093): n is a, c, g, or t
  misc_feature (1270)..(1270): n is a, c, g, or t
ctgagcgctgtgactttggaccactgtccatgtccttgagggggtcatatcctgaggagctggcacacatttcagcagatatctccatatgactgggtttagtggtggcctgtgggaccacgtgggaaagagacccncctgagatgggaaattctgaaaggtcagagatggtgggggaacggaaaagtttaacagttgttgactgtgaagtgcctgcaggaaatgaaagggaggtgcccaagagctaagaagtctggtataggagaagcatgagtaggagctgcaacagggggctaagaggtgacctgtgcagtagaaggaaagcactcgcgttctcccaggtgcggaacgagcaaacgttgatgacaaatgactttgcctaccatcttgaaccctttcggcttctcttcttgcacaggtcttcattctcaccctgctacacagcccctaccagaacgttctgaaatgcaaacctaacaactgtctcaccccagcaggaaactccccagggtcccgggccccctgcggggttgcaggcctcactcttcgcgcccatccctccgccctgaccgccctgagctcgcccccagtgctggcccttcacgtccagttatccctcccagcctccaaggtccccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctgggccctcgcctcactggcggtttctcccgcgagccagcctcatagacattccttggtgctgattggctggcggccagcgcagtcctccttcctctggctctctcgcggccccttgcgggaaggcctcccagaggccgtggggtcgtttctggcggcctaagtgggcctaacttttagagtcccgagggtcgtcgctgccggggagatctccgccccatttccgtgccgccttgtcctcngggcccaaagccccctgcgctaagggccctgtcccatctctgccctacacgcgggagtcagcctaaggcggagccctaggacagcagccgcgcctgacgctgctcgcctgcctagcacaggcagggggtgagcggagtcggctgcctccctccccagggccctccaagggagtgggntccacatccatgggcccgaggaatctgcggagagacgggaagagcaggggacactcacagggcgggggtccaggcgggagtccagtagtcctcgtggagacagctgggaaaggcctcggggcaagggacctcggatttcctcctctgcctcaaaacagacagtctaagctgggtgcggtagcttgcgcctgtaatcccagcactttgggaggacgagttgggtggaccaccaagtcaagagatggagaaccatcctggccaacatggtgaaaccccatctctactaaaaattagccgggcgtggtggcgcgcgcctgtagcccctgctacttgggaggctgaggcaggagaatcgcttgaacctgggaggcagaagttgcagtgagccgagattgcgcctctgcactccagcctgacaacaacagagcaagactccgtctca

SEQ ID NO: 237185 - DNA, 299 bp, Homo sapiens
tatgtgcattttattgtaggtcattgtttaccttgttagaactataaataaatagcttgcaaataaatagttcaattatcccttagaataatttagtagaatgcagcactttataaaagtaataaacttacaagctatttatttaagctcttcctattaatcagagtgattcatcattgatggtaaaggaataaataatcacccatagtgaaaaaatatctgtgttcctagtaacaaacagagaaagggtgcaaccatgaataagagagtaaagaaagatgaattgtaagttatgactt

SEQ ID NO: 237186 - DNA, 411 bp, Homo sapiens
tgttctgctttgctttgtttgtcaccactgacaaataacctagacagacttactaggtttttttcccagctttattgaggtataattggcaaatagaaattgtatatattcaaggtgtacaacatgatgattggatatacatgcacactgtaaaatgattaccacagccaaattaattaacatatccatcacccaacctaagaaattaaacactgcaaaaacttaaaatctattggtaacaccctttgatcacagccaagtccctttaccttcatggcatagttaatttggtgtttatgatttaagtatatgtataaaattgtactatatacatatatatcattaaataaaacataatgtatcaatacttctaaacttatatacttggttacatactatatgtgtgttctg

SEQ ID NO: 237187 - DNA, 213 bp, Homo sapiens
gagacggagtccagcccaggctggagtgcagtggcgcaatctcagctcactgcaagctccgcctcccaggttcacgccattctgcctgcctcagcctcccaaagtgctgggattacaagtatgtgagccactgtgcctggccagatttcctcagttttatttgtcccctttggttcatttacgtctttaaatggacgtgctgcactccacaga

SEQ ID NO: 237188 - DNA, 692 bp, Homo sapiens
gtcagttgggccaggtttggccccacttcaggccagggttagattggccgccaccactgaaaacttaccgaatttttctatagcactcaaatgtcagcatttttccatctgttgggggcctttcctcgttttccattctccccaaatattttatcgggttcaaagtttagagggttattgtgagattgttgttattcaggtgccggattcctcatgtgattcagcgtgccagacaggacacacacagagagaggattgatgtggtctgtggggaacagagaccacacatctcttgtaaaggcacaacagttgcccagctccaattagatgtctcctgctaaccagagtacactatccacagaaatttccttgtttccaacagaagctagaaaaacagatttttggccaggtgcagtggctcactcctataatcccagcactttgggaggtggaggcgggcagatcacgaggtcaggagatcgagaccatcctggctaacacggtgaaaccccgtctttattaaaagtacaaaaaaaaaattagctgggcgtggtggcgggcacctgtagtcccagctactcgagaggctgaggcaggagaatggtgtgaacccgggaggcggagcctgcagtgagccgagatctcgccattacactccagcctgggcgacagagcaagactccgtctcaaaa

SEQ ID NO: 237189 - DNA, 926 bp, Homo sapiens
ggcgggatcactagggccacggtgctaggcagaagggaacctgggatgacagagccactatggagcgctccttccactcctctccaaattgtcctttgttgctctggagctgacggtccctgccctgcaagaaggtgcgtttcctaaaacacccgggaagccaacccagctacacttaagtaacccagccacggacagtgcccgacgcgtccgtgggcctctgaggttggccttcaaagaaatagagccgtccaaacgtgtcatcaggcccacacaaagctggtgtcaaagagaaagaggttctccgtgccttgcaaaaaaagattctcacaaaagacttaagacttggcagcaggtccgactgtgccctttcaggataggaactgctcaggtgtgtgagagaaagagactcgagcacaaggtgtgtcccttccccctgtatttaaacctaaattaatttcactgggaggaaataccatgcagattttttttaagtctgtttcacgctcccagcgggctaatcggttctttcaatcctaaagcaacagaaaactgtgaaatttgaagagaaattgttagatcaaaggaaaaagcaaacattaaaggaatgaaagtactctcattatatagcaaaaatggaaagtgttcacattggggtagttcaactttttaaaacatggttaaaagaacatagtcaatttaaaaattatcaggagtgacacagaacagcagctaggccctggggatccacatcaaccaagcacctaacatacagtgaataatgaatgttaaataatcacagtacgcacccacgtcacattttctagttgattagaacttaaaaaaaaaaatccctccaggatactatcccagtgtgtcttctcattaaggtccattttttaaaaatacaccttgctaaactgtta

SEQ ID NO: 237190 - DNA, 486 bp, Homo sapiens
acaagttaaagtaaataatttttctagatgccaggaagatttttatgagaaattgaactttgaaatattttgaagcaaaaagcagtgtttcctttgtgtttgagggtgcagtttttagataaaggagaaatatttacaaagaaccccaagtacaaaacagcacgttatgctttgcaagatgtaaaatgctgtatgatacaaagtgatttattcacaaccccaaaatcagaaaaactcagaacattgagctggctttaccatgtttggtgaaaaactgagatgctacccaaattgatatgttcctttataatcttgatttaactcactaaatatttatataactttgatatagaaatattaatacacttggctgggcatgcctgtaatcccagaattttgggaggccgaggtgggctgatcaatttaggtcaggagatcaagaccagctgggccaacatggttaaaccctatttctactaaaaatac

SEQ ID NO: 237191 - DNA, 721 bp, Homo sapiens
caatgtcagtctatagcattttgtgcacttttagctttaactttttgctaaaatagctcgtttattaattttgcaatgttatctccataaacttagcctagaattctttctgtggttacatttatagtttttagatgaaatattatatttgttaaacgagccatttactgttgagactatcacctcattggtctttcttccctttagtggctcataatgaaagggggaaggtaatcgttcatattccatcactgaaacaaaatttagcaaatactataagccgagacgtattagaaacatctgtgcttacatttactgtatattccaaaccttttacatgacataatttgttataaaacttgtttattcagatcttttgcaatgtcgactgtgtttttactgggaaatacattcaaaggaatgtattttagcctgctaaccacgttgttttccaaggattctttcagccatttttactaaggcaagatgaacatgtttcctcaatgagtctttagatcattggctattcagtgaagtttttcattaaacattaattgggtgttacataactaaacatcacaggagaaatcacagaatatatttaaaatgtcttgctaacagtgatgactttgctctatccttagctaacatctcaaggcacatttttcctctaggtcaaggttcactttgaaaaagagtaaggggctatctatattttaat

SEQ ID NO: 237192 - DNA, 524 bp, Homo sapiens
tgggtttgtttttaagggtatccttgttttagaagggattgccatgctgtacagctgttagaattcacttgccaaagaatagaatttagctgccctttaggatttgacggtatctttgttctaaaacaaatccaggagtttacatttgttttgttttgttcctttagggtaaacactgacattttatggactagaattatgagatccccaaaattgtgggaagtgaaatacaagcaatttcagaaaataggttgggaatgtttctagcacaaagaaaagacaaatatttaaggtgttagatatcccaggtacagtgatttgttctttataaattatatgaatgtactaaattatcatatgtacccccctcccaaaagaagaaaataggttggatgcacagtacttctggctgtcccaggaaatactcattttcctttgctccttaaagttcttaaatggaaatatttgataagcaaatttgataatggactgggattaaatcaagttcatttcacacatgaaaa

SEQ ID NO: 237193 - DNA, 434 bp, Homo sapiens
ccttctcttttctaagtttcttcttgctcaactatttccaactgtatgatttggctcatcttccttactacatttttcatgtcatcagtttaagttgtcgagtggcactaaatcttaaaacaaatcagaagaattattagggtaaactgaaaacaccaagtaatctctcttagcttcttttagttagatgttcaattttgaagtatctggatatctctttagggcatatacttctaataactaactgcccttctccttgaagacactattttagcaacagcgggaacttaaagtcccataatgtctgtgctgacacattttaggcatcgtctaggctaacccaagctccttatcttacaaatcaataaactgagcctcagagggaaaattttttcctaagatctttacccaataaatgatttctcaccttgcga

SEQ ID NO: 237194 - DNA, 1137 bp, Homo sapiens
agttattttttctccttaatgctgataattggatctcaattataattagtttattgatgtatttcatttcttaggtgtttaaggttctttatttgctctcttgtctttcttttttcataccatctctttatattacatttttaatgtagtttcccaaaacttaatcataattattatagttatgtttctgtaccagtctggtgttccttttctattgaagtaattcattaaaatttccattccatttcttatcttttccttcttccttctgaaactgtgtagattttcatgtgaggtcaattaatcatcttgcttttactcatgtagtaagcacatttttctttgcaataactatcttcctctgtagaaggagaatggtctaattttaacaatgggccaaattcgtaactggggaactactcctacttattacttaattggtgattctctaactagagtttaaaatatttgtaattctttcaaagattattgcttaaagactgaaaacactgtacatgcctgggtggggaataggaatatagtgatatttagagaaatctttaagaccagcataattctttaaataagctcgagaccctggtccttgttcagttacaataaaagattaccattgggatttttaatcaactaatttatgatgcctttagtttcctattatattaaaatgtttcttaatgtcttaatttttagaagtattttatagttaaataatttgagaagcctcaggagaataaaatcaaattaatgatgaattctcatggcaaaggaaaaaatgccctttttttcccactgcagtttccttttttaaaaaataagaaattagttcggccaggcctggtggctcatgcctgtaatctcagcactttgggaggctgaggcgggtggctcacctgaggtcaggagttccagaacagcctgggcaacatggcaaaaccccgtctctactaaaagtacaacaaaattagccagatgtggtggtgcgtgcttgtagtcccagctacttgggaggctgaggcaggagaattgcttgaacctgggtggtggaggttggcagtgagccaagatcacaccactgcactccatcctgggcaaacagagtgagactctgtctctatt

SEQ ID NO: 237195 - DNA, 291 bp, Homo sapiens
gaagagggacaggctggtcaccagcaggctcctgcggtgagcccacctgtggcaagcactagacctcaggcccccagttggcagcgctcatgggtgggtactaaaggtcagttccctatactcagagctcccccagactccttcagatcaaatgtcaccttttccatattgcaaaagcctttattgctctaaggaaaacatgctaaattaaaaagaaccaaattattcttttaaaaatagaaatattttaaatggaaaagttcaaagaaaataaaaggctttccaatcctc

SEQ ID NO: 237196 - DNA, 247 bp, Homo sapiens
cagcagcagaagcaagtctcaaaagaccatatactgtgtgagtccatttacacgggatgtgcaaaataggcagattcatcgacagagaccttggatcggcggtcctcaggggctgggtgggatgtggggagtgactgctaatcgggagggggtttccttccctttcgagacggtgaaaatgtttcagaactaggcagaggtgagggttacataatattgcgaatatactaaaatgaactgaattgta

SEQ ID NO: 237197 - DNA, 302 bp, Homo sapiens
aacagttgttatactatactgtttagggaatagtgacaagaaaattgtgtgtgtgtgttcagtacacgtagttttttttctaaatatttttgatctggggtttggttgaatccgcagatgcggaatgcatggatgcggagggctgactgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaat

SEQ ID NO: 237198 - DNA, 554 bp, Homo sapiens
gacgagggctcagagcctggcactgccgacccctttgtcagggctccgtgcggcacagcagggccaatctggcctggggtgggacgacacctgtgccagaggctgtagacggacggtcccagcgtgcccgacacaccctgcaccggaaggcaccttagcatgtggcatctcccagcacaccgtgcctggcaggaggctccgagaaagtcaggcccctggcatcccggcccagaagctaccccagagaaacccagtcctgcagggttcattccggcataactccaactctttactagactttcctgataccaggaagggagcacgtggcacccatcaactctcctgaaagcccctcctcttcctccactccccttaggcacgatgcccaatgcctttcgtctgccccaggcttcttgaaatcaacacaaaacaagcctacttctccccggtccctaaattctccccagcctctaacttctccccagcccctagccctggggtttctcatccttgttaatattccttcccttctgctaagcctgtttaaagaatga

SEQ ID NO: 237199 - DNA, 423 bp, Homo sapiens
ccgcgaaggtctgcagcttcactcttgaagccagcaagaccacaaacccaccagaaggaagaaactccgaacacgtcggaacatcagaaggaacaaactgtggacacactaactttaagaactgtaacactcacggcgagggtccccggcttcattcctgaagtgagaccaagaacccaccaattctggacacagaagaactcaaacacccttctcattatcccttcctggactctttcttggctctcaacttatatctcatgcaccagctacctgaagatttcttacagcctcagcacatgaagattcccttcaagactctcattgtcctttcttctagagagtcttccttatcctaagcttaaccaagtgagagaaacttctgaacctccaacatttgggataaaactctataatggctta

SEQ ID NO: 237200 - DNA, 220 bp, Homo sapiens
aaaacaaagcaaacataaaacagcctgagtgtccatcagtgcaagactggttaaataaatcatgatctattcatacagtgggatgttatgaagctggtaaaaacaggtaaatttccaagtgccgatttaaaatgtattccaaaatatattttgtgagtaaatcaaagtggaaatctgcgagttcatacttttgcaaataaaaaaagatccattaacatat

SEQ ID NO: 237201 - DNA, 2187 bp, Homo sapiens
ttcagattgcaaagttatataagaaatttcacaaaggggaaaacacaaaactggtacaactaagtgactgggaaagatataaaatcatgtagactcacttcacccacaaaatggtaactcctgaattaaacttcatgtgttttatttaggctttgtcaagttagctatggttgtattaaagcagattgtttgattttgataaatagttttccttaatacatgggaaaatcgagttgtgtgaataaagaaatataaaatagcttttactcagttgtcccatttgtcagcattgatgggtaataaagattagtgttactttttcttctctagtgtagatattttctcaaaattgtgtgtttgctattgttttatttttgaaggggaaaaaggtatacattttatagctactaggagttcaaatacagtaattagaaaggacacacgaattttgaaatagtattttatgcctcttgatctcaggtacaatacacgagatgaagcagttaaatagcaaagcaagacagaagggtcagagaattaaagtaagtgttttctatatattgcatctgtgttcccattaatctctgttttgttatgtaactgctccttctgaatgttctgaatgtgaagaaaactatgagtaagaaaaagggtgtgttttaaagttaggtttaaataaagccagaagagtaaaatgtttttactcttagttctgtttgaaacagcacctgcctataaattataacctaaatgtttttggataagaaaaaattgggttgtgatgatgtaagcacctttaaatctcttgctagcagatatttaaagtgaaagaaagcacatactgatcagattgcccatgtttccattttaagacaattaaagcttctgtttttttcagactagcctttcttcctggggacaacacttactgagaggctttgctgtggatctttttggaaataaccttcatgtcaatttctcaccttactgtgattaactttctaggcccatgaaataacatcttgatcaggactgatctaatctttatagttttcttttttaatcttctaactgttcagattttaaagttaacaagtaaaaatcaaagcatattaatctttgaatctttatgtccctttttgtaattgttgaggtctttcttgacagcctgtttaatattttttccctaagtttagagattgcttatttgtgggaataaaaagtagggtgacacttttttgtacccacttgggtttttaaattaataacaatgaaatcataaccagcacttgtcacaatttagtttacacactttcatgttacctgctttgatcttcacacgagctcaccaagaagccatttttaaaatcttctccattttagaggtgacagaattgaagctcagaaaaggtagataacttatcagatattaaatgcttaggactttatccaggctgtctctaaattactttccctttttactgtgttgcatttgccaaattataaaagagacccccagaacagttatttctacttgtgcaggacttgaaggacagagtcactagaagtttttttgtttgtttgtttgttttttgagacggagtctcgctgtgtcgcccaggctggagtacggtggcgcaatcttggctcactgcaagctctgcctcctgggttcatgccattctcctgcctcagcctcccgagtagctgggactacaggcgcccaccaccactcctggctaatttttttgtatttttagtagagacagggtttcaccgtgttagccaggatggtctcgatctcctgacctcatgatccgcctgtctcgtcctcccaaagtgctgggattacaggcatgagccaccacgcccggccttagaagtttcaggataacggtactgccatcttacttcttataaaagcagtaattcgtattttatgtattaaaataaatgagccataggatgaatcagacaggtttgcttctagttttcaccactctatttgaccttggacaagagagttaattcccgagcctcagatttctcatctccaaagagctttttctcataggaagtgtgcaagaattaatagaggaagttttatacagtatttagctcatatagaaatctatacattgttcttctttttacattcccatgagaaatttcatgcccattttgatt

SEQ ID NO: 237202 - DNA, 489 bp, Homo sapiens
agtaatgggattgttgggtcaaatgatatttctgtctttaggtctttgagaaattgccacactgtcttctacaatggttgaactaatttacactcccactctcagtgtataagtgttcctttttctccataacctcaccagcacctgtttttcttttcacattttaataacagccaaagaatggatgattttcaaaacaggatttattggagaaactttattgttcaagtagaatcttacctaagtgcttgatacacaagcaaaactagataatatcagatctgctgtgattgtggaaaaataagacaagaaacttccttcacataagccttgagatgcaccttaaagcaacctctcagagtccagctctttaggattacctcggaaaccactgggatagatcaactctacatttaataacagtttatgattatgcttctaatttccttctttgatctcaacatatagtattttctcagttccaatgct

SEQ ID NO: 237203 - DNA, 438 bp, Homo sapiens
tcaatttaatttttttagtattttaggcttaaatatattttgatatatgtcaaaaaatatggatatatatatatcatatatctcaagaatgaatgctagctaacattgaaacttgtagatagtagaaggaaaattaatttgccaataggacattgttgagaattatgttattgccaacctttaacatttattgtaaagtctatgcaatagctgttcttgcttatgtattgaagtgctcaggtagataaattcagcggaatccttaacacttgcccgtagcttggcacctagcacctaggataatagataacaagaaaggccaggcacagtggctcatgcctgtattcccagcactttgggaggccaaagtgggtggatcacctgaggtcaggagttcgagactaggctggccaacttggcaaaaacctatctctacta

SEQ ID NO: 237204 - DNA, 1733 bp, Homo sapiens
  misc_feature (882)..(882): n is a, c, g, or t
  misc_feature (988)..(988): n is a, c, g, or t
  misc_feature (1013)..(1013): n is a, c, g, or t
  misc_feature (1021)..(1021): n is a, c, g, or t
  misc_feature (1029)..(1029): n is a, c, g, or t
  misc_feature (1042)..(1042): n is a, c, g, or t
  misc_feature (1050)..(1050): n is a, c, g, or t
ttgagcaagtggcatgtaaactgagagtgaaataatgagaaggagccagtcatgagaaagtggaaaaaagagctttccagcgtagggaaagcatataagaaggccctgatatggagcagagctgaacatattggaggaactgaaaggaaggaagtggctggtatgtgctgggcatgagggaacacaaaataagtgaagatggaaggaacatggagccagaaaataaaattcgttgtggactgtgtatattagggttccctagagggacagaactaatggaatatacatacaggggagttgatcaagtattaactcacatgatcacaaggtcccacaataggctgtatgcaagctgaggagcaaggaaggtagtctgcaccaaaactgaagaacttggagtccgatgtttgagggcaggaaacatccagcatgggagaaagacgtaggctgggaggctaggccagtctctcatttcacatttttctgcctgcttatattctagccgagctggcagctgatcagattgtgccaacccagagtaagggtgggtctgcctttcccagcccactgactcaaatgttaatctcctttggcaacacacccacagacacacccaggatcaatactttgtatccttcaatccaatcaagttgacactcattattaaccatcacactgtataagaggttataaagccagtaaaaggttaagtggcattttaatttaattaaattgatcagtttatttattttgagatggtgtctgaccctgtcacctaggctggagtatactggtacagttgtagctcactgtaacctccaactcctgggttcaagggatcctcccactttagtcttctaagtagctggaactatagatgtntatcccatactcagctaagtttttatttttagtttttgtagagacaggatctcactctgttgcccaggctgatctcaaactgcggaccttaagtgattgttctgcntcagcctcccagaagtgctgggatnatagttgngagccacngtgccgacattanggcatatntagaactacatatatatatatatgtatgtatgtatgtttatgtatttttttttccattaacttttaagttctagggtgcatgtgcaggatatacaggtttgttatataggtaaatgtgtgtcatggtgatttgctgcacagatcaacccgtcacctaggtattaaccccagcatccattagctattcttcctgatgttctccttccttccaccctgcacccccgaggggccccagttcgtgctgttcccccgacagtgtgtccatgtgttcttatcgttcagctcccacttataagtgagaacatgcagtgtttggttttctgttcctacgttagaactatatttttaagggattatactgattgctatgtagagcacatgaggtaaaatgaaagcagaggtgggcgcagtggctcactcctgtaatcccagcactttgggaggcgaggcgagcggatcacttgatcccaggagttcaaaaccagcctgggcaacatggtgagaccccgtctctacgaaaaatacaaaaattagccaggcatggtggctcatgcctgtaatcccagtcacttgggaggctgaggcaggaggatcacttgagcctgggaggccaaggctacagtaagctgtgaacatgccactgtaccccagcctaggtgactgagtgagacccctgtctcaag

SEQ ID NO: 237205 - DNA, 614 bp, Homo sapiens
gttagaaaggacgtcttagtaaaacatggtctgatttttatcaatctagagtgggaagactcttattctcttttctccacatttagcccagaaatgcaggttgggggaatagaaatgatgcctaaggctccttgctgactcttcagatggaactaacataggaaaagaaattagatcagaaagtatttcaagaaatcccagtcacctcactttgtcatcaagctttataacatcgagcagcttacctcactccttgggtttgtttcctcatcttgagtttgtcatcttcaaggtttcttgtgactgcttacgttacatggcttttctatgctagattttctcgtgaagctcactgagcactgaaaataattctaagaatgtatttttaggattgttataaatgttcagcttcttttgtgacatctttggacgccattgggtgaatgagttctagtgtgttggtcatttttagtcattttttatataaggaggaagtcagtggtatgtggtatttatattttgaaggagcaatctagaaaacaaaacacaatcacagtatcagtaatgaaagcactgaaatcattgcagatccttacagatgttaaaaggataac

SEQ ID NO: 237206 - DNA, 381 bp, Homo sapiens
gggcaggacaagacagctgaatgatatccatctgagccactgtgaatgcactgcagaggctctccaatacctggggacagaaaagaaaggcagaaaggagtcttctgagaagcaaaaggctggaagttgaactggagagcaaagagagttgtccagcaacccaaaaggttggcagcctggcttaaagctgatacaaatctcccatagctaaaacatgagggctgggcaataaagcacaaagagatctttagagtctctccagtgctcatatcccaagcccagtttgagggaaagtcctaatcccttcctcaaaatatttgcagccaaggtgagtgaatctagctaaagctgcaaccaagtccaactacagattaaattgac

SEQ ID NO: 237207 - DNA, 534 bp, Homo sapiens
ccacaggtttacctctgcagctttactctttcctaaacattgctttcgtgtattgcttatgcatgctttctgcgtcccaaaaagtatgtagagaataacagtttaagtcctccagaggagttactacctctactacatgtttcattctcattacatgttgcattgcttattaatatctgtgttttgtagtggacttcatgaggacaggtaatgttaccaactgaattgtgtacccccaaaattcacatgttgaaaccctaatccccaatgtgactgtatttgaagtagggcctacagcaggtaattaaggttaaatgaggtcataagtgtggggccctgaatcgatgagattagtgtccttataagaagaaacagcagagaccttgttctctccaccatatgaggacacagtgagaatgtagccatctgtgagcaggaagggaggcctcaccaggatccaaatgagccagaaccttaatcttggacttctcaccctgcagaactgtgagaaaataaatttctgttgtttaagcc

SEQ ID NO: 237208 - DNA, 661 bp, Homo sapiens
  misc_feature (450)..(450): n is a, c, g, or t
ggtttcaccatgttggctaagcaggtctcaaactcctgacctcatgatcggcctgcctcggtctcccaaagtgctgggattacaggcgtgagccaccacacccggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttnttttttttaaatcagcaaatggcttgatctgctgcttgatagcagacccattaaccacccgtgtatccacatatcaccccttggctggggtggggtcctctccttcctggaggacacctccacttcttcaccaatccagctgtccagcctattcaggtactttactctgtcctttttctctgcctttatcttcagcccatcctttctatcg

SEQ ID NO: 237209 - DNA, 757 bp, Homo sapiens
  misc_feature (450)..(450): n is a, c, g, or t
ggtttcaccatgttggctaagcaggtctcaaactcctgacctcatgatcggcctgcctcggtctcccaaagtgctgggattacaggcgtgagccaccacacccggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttnttttttttaaatcagcaaatggcttgatctgctgcttgataggtaaaataatcaacacttcctatgttcagctcaccctcttgtccctcttaccaccagacccattaaccacccgtgtatccacatatcaccccttggctggggtggggtcctctccttcctggaggacacctccacttcttcaccaatccagctgtccagcctattcaggtactttactctgtcctttttctctgcctttatcttcagcccatcctttctatcgcctataaacatactgaagtttctccactgaaaacaacacaaa

SEQ ID NO: 237210 - DNA, 504 bp, Homo sapiens
gaaatatgctgtttgagattttaagaacataatttttaagttaatgctggcgatgtttcttttgcattttttaaaaatgttgctgactgagaacccaactctcaccaacccctcccttctcaccgtactatattcctggaattcacactgcaaaggcgggtgctttcaaaattcactttttcccacaagcggattcagaaatgcggaggttgcctgccgccttttctaccggacaacattcccgagttattggtgagctggaatgtgactgacttgcattccagggtttcttaaagtcaaaggttgactaaccagcagattccctcagggaaaagaggcagtaaatgtatctttttcaaggtaacattgcatgaacttgtcaaaagacaaaaaggatagaggggtttgtattaaaagaaatgattccaaggtacctagaaataaaagtaatcttgctattcttccaaacaagtgagaaggtctgtggctttcaattttgtgtct

SEQ ID NO: 237211 - DNA, 527 bp, Homo sapiens
tctacccccattttctgtgttctttctgcaactcttgctattagatgctgaacctcttagattgtcatttaaatatttttctcttctcttttccatctctgtttttctttttgtttgttcttccgcaaaattccctttatttcccaagctttctatcagtgtttcattcctgctgtaatatttttttgacatcaattcttctgatttttaaattaacctttttattgtaatataaagcacagatatcagtcatgcccataatcccagcactttgggaggccacggcgggcagatcgcttgagtccaggagtttgagaccggcatgggcaacgtggcaaaatcccatctctacaaaaaataaactgagccgggcatggtggcacgcatctgtagtcccagctactttggaagctgaggcaggaggatcgcttgagctcaggaggttgaggctgcagtgagctgtgattatgccactgcactccagcctaggtgacagagcaagaccttgtctaaaaacaacagcagcg

SEQ ID NO: 237212 - DNA, 2012 bp, Homo sapiens
  misc_feature (1508)..(1508): n is a, c, g, or t
taatgcattatttgttgactgacttgctcatacagtttgcatgactttgcagttctttggaaaagaggtattgctggaaagggagttttatctggaagtgtttcataaagcctactcttatctccattgtgccccaggcaaacttagccactgtgtcctctgtgctcactctctctctcttacacacttcattgccctccttctttcagtcttttttcctcagtatatctccagtgttgaacacagggcctggtagaccgtagacacttggtacatctttgtaaaagaataaatgatgaatgaatgatattgaggtctaaaagctcaggatgagaaagagaggcaaattcagttgcaagtctggcaagtggctcagttggaactcctcagcaggcctggcttgctagaggcctgtgttgagtttgtctgggacaggcctcctgtgaagactcacatctatgatccagcagtaacagctttcactgtcaggcacaaacttcttggctgactgaaagagcaacgtgttagtctctagaagtggagtggactggtgtctgaggtgagtatagcccacttggatacagatgcccagtatttggttacctgccctggggagaggactggtttctccctggtgtatagactcataggctggctacagacatatatacacacacacccaactactgatttgccttgggagtacactgtgcttacttaatattgtacaagctggtgaccagattaccttatgagaaggcacatgatgtagagtgtaaaatccactagatttgaatttagaagacacagattctacttccaactctggtttgccctgagtgtgtaaccttagaagggtcacttcactaggcctgacttctgtctgtaggatgaaggcattaggctacataatctcagagtttaaagctagaaatttccaaagctggaatgagttgcctttgtaggcagtgagtttccaatagctggctggaagttccagaacagggattcttagccttagaagtgtagttgtgttgggcctttccaacccgattgagtaactttcagctgatttggaatcccatcagcatgggccaaactgacgtcagcagggagacagacacagcattacgttgtttactctgtacaacctataagtgaattaatgacctgccatgtcactattttgatagcaacaacatcacccccattgtctaccatttatgaattatcttttttgggcttgtcaattgattggacatctgcatatcctagggcatgtgcagatccacatggtcacatgctcattctctgggtcttcctcctctgagaacctagcatgtggtgttctttgtgacttgcccatataaactgctattaaagccaaagactgggtgccctgtgctggctgtgtccctctgtgagagactcagatgctgaggtctccagtggcacttaatgctccaattgccattgtttgaagaacgacatctaccctgtagtcatangtgcctatgttgacatctctttccacttactctttgcaattctcttctggtgtccatgctgctggtgatctttattaacagtaaaattcttcaagagctccatagccctgaaagaagaattatgccatcacttccattttactcaatttcatttttctggaagcattagaagatgagtgttcacattttccataaatttatttgcagcttgaaagaaggaaagattgagcgctgtggctcacacctgtaatcccagcactttgggaggccgaggcaggcagatcacctgaggttaggagttcaagaccagcctgcccaacatggtgaaactccatctctactaaaaatacaaaaactagctgggtgtggtggcacatgcctggaatgccagctcctcaggaggctgagccaggagaatcacttgaacccaggaggcggaggttgcagtgagccaagatcatgccactgcactccagcctgggtgacagagcaagactccatctc

SEQ ID NO: 237213 - DNA, 3830 bp, Homo sapiens
  misc_feature (3239)..(3239): n is a, c, g, or t
  misc_feature (3562)..(3562): n is a, c, g, or t
  misc_feature (3802)..(3802): n is a, c, g, or t
gactagggaccgcctgggtgaggtgaggacctggtggccgcagttgtggcactgtgcgcaggcgctgaactgaccggacggagcgggcggctgtggcctcgccagctggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatctcgctggaaatccaggcccccctggaagatgaggtgacaaggaacctgtcactccaggttgctttctctggggcaacagcttgcatggcccatgttgatggaattcacttgcacgtggcaaatgctggtgactgccgagccatccttggtgtccaagaggacaatggcatgtggtcttgtctgccccttacacgtgaccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcagcattctggagaggggcttcaataccgaggccctcaacatttaccagttcacacccccacactactacactccaccctacctgactgctgagcctgaggtcacataccacaggctgaggccccaggataagttccttgtgctggcctcagatggcctgtgggacatgctgagcaatgaggacgtggtaaggctggtggtggggcacctggctgaggcagattggcacaagacagacctggcccagagacccgccaacttggggctcatgcagagcctgctgctgcagaggaaagccagcgggctccacgaggctgaccaaaatgcagccacgcggctgatcagacatgccatcgggaacaatgagtatggggagatggaggcagagcggctggcggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaatttgataattctcctgaattcacaatcatggacttgtagactatgaagagatattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaacccctcattcaccctgcacctgccaactgcaaaatattgtctgaaagaatctttcacatgttcctgcttcctatggctgcaggaaaggagaaaatgtgattgcatgtggtagttgtggtgatagacgtttagacaggacaggttaatttagcggattgtggacttaagattcaacctctatctggagaggtgaaaacacaaaggcttaaggacaacagtttctaaccaagtttctctgaatcctttcctgagaggtggtgggcaggagggaggagtgagacttatcagatgggacgcttgccccaagactgtgggataaaccaccattgctagtcctcaggaattagaccatatttagtataggagttggggcaaaaataaaagtgtaatttgtaatggtttctgtgggctgtagactctttgtatttacttggaaattcagttatgtggatccattttggagatgaatttcatctcatgagttgctgtggcatttaaacaacaggaaatgtgtccctaaatggaaacaaatataatcccacaaaaccaacanttttatttgcctctactacgtcaggcagaattcttcaattaagttgaactacatttgttgatcccttttctcatcttacccctttatgccacctactgaaaagaaaaacaaatagctaggtttggtttcctgttttttgtctatgtcccagctgacattcagtcaaatgttgggatacttctaatttggtggtgtttctttgtacatttttcagtgcaactgtttagtcatgtgttttcatctaagaaattatcttttgaatatttaagccttgatccttttattctgaaaccattaatattccttcttggctgggtgcagtngtttacgcctgtaatcccagcactgtgggaggccgaggcggatggatcacctgaggtcgggaattcgagaccagcctgaccaacatggagaaactccatctctactaaaaatacaaaattagccaggtgtggtggtgcatgcctgtaatcccagctactcgggaggctgaggcaggaaaatcacttgaacccgggaggcggaggttgcggtgagccaagatcgcaccattgcactccagnctgggcaacaagagtgaaactctgtctc

SEQ ID NO: 237214 - DNA, 3778 bp, Homo sapiens
  misc_feature (3187)..(3187): n is a, c, g, or t
  misc_feature (3510)..(3510): n is a, c, g, or t
  misc_feature (3750)..(3750): n is a, c, g, or t
gactagggaccgcctgggtgaggtgaggacctggtggccgcagttgtggcactgtgcgcaggcgctgaactgaccggacggagcgggcggctgtggcctcgccagctggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatctcgctggaaatccaggcccccctggaagatgaggtgacaaggaacctgtcactccaggttgctttctctggggcaacagcttgcatggcccatgttgatggaattcacttgcacgtggcaaatgctggtgactgccgagccatccttggtgtccaagaggacaatggcatgtggtcttgtctgccccttacacgtgaccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcagcattctggagaggggcttcaataccgaggccctcaacatttaccagttcacacccccacactactacactccaccctacctgactgctgagcctgaggtcacataccacaggctgaggccccaggataagttccttgtgctggcctcagatggcctgtgggacatgctgagcaatgaggacgtggtaaggctggtggtggggcacctggctgaggcagattggcacaagacagacctggcccagagacccgccaacttggggctcatgcagagcctgctgctgcagaggaaagccagcgggctccacgaggctgaccaaaatgcagccacgcggctgatcagacatgccatcgggaacaatgagtatggggagatggaggcagagcggctggcggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaaattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaacccctcattcaccctgcacctgccaactgcaaaatattgtctgaaagaatctttcacatgttcctgcttcctatggctgcaggaaaggagaaaatgtgattgcatgtggtagttgtggtgatagacgtttagacaggacaggttaatttagcggattgtggacttaagattcaacctctatctggagaggtgaaaacacaaaggcttaaggacaacagtttctaaccaagtttctctgaatcctttcctgagaggtggtgggcaggagggaggagtgagacttatcagatgggacgcttgccccaagactgtgggataaaccaccattgctagtcctcaggaattagaccatatttagtataggagttggggcaaaaataaaagtgtaatttgtaatggtttctgtgggctgtagactctttgtatttacttggaaattcagttatgtggatccattttggagatgaatttcatctcatgagttgctgtggcatttaaacaacaggaaatgtgtccctaaatggaaacaaatataatcccacaaaaccaacanttttatttgcctctactacgtcaggcagaattcttcaattaagttgaactacatttgttgatcccttttctcatcttacccctttatgccacctactgaaaagaaaaacaaatagctaggtttggtttcctgttttttgtctatgtcccagctgacattcagtcaaatgttgggatacttctaatttggtggtgtttctttgtacatttttcagtgcaactgtttagtcatgtgttttcatctaagaaattatcttttgaatatttaagccttgatccttttattctgaaaccattaatattccttcttggctgggtgcagtngtttacgcctgtaatcccagcactgtgggaggccgaggcggatggatcacctgaggtcgggaattcgagaccagcctgaccaacatggagaaactccatctctactaaaaatacaaaattagccaggtgtggtggtgcatgcctgtaatcccagctactcgggaggctgaggcaggaaaatcacttgaacccgggaggcggaggttgcggtgagccaagatcgcaccattgcactccagnctgggcaacaagagtgaaactctgtctc

SEQ ID NO: 237215 - DNA, 406 bp, Homo sapiens
agaaaagggagtcctgctggagcaatgttcttgagtagataaaagggactggtacctagttcacaagtggagggattagttttagtgtaaaaaccgaaacagtcaatttgtagtctcactctgctggaaggcaaagtttctgggcaaagatgctgatgggtaggtgtggctcactgtttagaattcaactcagatgtcaccccatctgaaaggagctactcctgccaccattttttttttttttttttttttttttttttagtcagagtctcactctgttgccaggctggagtacagtggcacgatctcggctcactgcaacctctgcctctcaggttcaaacgattttcctgcttcagcctcccaagtagctgggactacaggtgcatgccaccacactcagcta

SEQ ID NO: 237216 - DNA, 727 bp, Homo sapiens
aattgtcactttttcatttgtttatttccttctaaaaatgtgagtaaatgttttttggtgttaggttgcaaagtatgtactttaaaaaaatcattaggcattcattttcagggatcttatctactttctcatctccatattttgttaaagataatattgccagatgtaaagaaaatggtttattctacctaaagagtggataaggagagaaaattatgatgaaataaaaattataagcaaagtttatttaaactaaatttaaatgtgaaacatcacctttttcctaatcagatttgatattgctacgaatatatattgatgatattgtcactatataaacataagagaatttaactttctattaccaaatataattgaatatatttataagttcatctgtactgttttattgtaatgagttaaaaatatgagataggggctgggcacggtggctcatgcctgtaatcccagcactttgggaggccaaggcgggtggatcacctaaggtcaggagtttgagaccagcctgaccaatatggtgaaaccctgtctctactaaaaatatgaaaatttgccaggtgtggtggcatgcgcctgtagtcccagctacttgggaggctgagacaggagaattgcttgcacccgggaggtggagattgcagtgagccgagatcgcgccactgcacttcaacctgggcgatggagcgatactctgtctcaaaaaaaa

SEQ ID NO: 237217 - DNA, 405 bp, Homo sapiens
aaagacagagtctcgctctgtcgcccaggctggaatgcagtggcgtgatcttgtctcactacatcctccacctcctgtgttcgagtgattctcctgcctcagcctcccgagtagctcggattataggcacctgccactgctactggctaatttttctatttttagtggagacaggtttcaccatgttggccaggctggtctcgaactcctgaccgcaagtgatccacccacctcagcctcctaaagtgctgggattaccggtatgagccaccacgcccagcaccttcttaactctttctgggctacttttgattttgggtaaaattgtttgagatttcaagccggttgcagtgatgtgcacatgtagtcccagctagatgggaggctgagagaccctatttcttt

SEQ ID NO: 237218 - DNA, 411 bp, Homo sapiens
atgtaaatgagattattctgaaatgtatatataaaggcaaaggaactagaatagctcaaataattttgaaaaagaacgataagatgggaggagtctgcccaatttcaagattactacatagctacagtaatcaaggctgtggtatggatacagtgatagacacatagatcagtgaaacagaatggaaaacccacagacctgagtaaatatgcccagtcatgttacacatgattttggacaaaggtgcagaaacaattgagtggaggaaagatatctttcagcaaatagtactggagcaattagacatgcgtcggcaaaaaaatggatatcaacccaagtctcataccatataccaaaatgaattcaaaatggtttatggagttaaatgtaaaaccataaaacttctagaaa

SEQ ID NO: 237219 - DNA, 1381 bp, Homo sapiens
ctttaccactctaatttttttttgtttgagtaaatgagagcaggccttctcagaggcagctgacatcagacagagacttcctttgcggcctctctggttctgttcctctcttccccgtagctggtatttgtagtgacacctgggagccacagatttgcttagcaacctttctccagggtgaacagggtattcacaactcctgaaccaaggcgtgtggctggtatcattttgtggggccagaacgcattgcgtggagaaattcagtgatgacctggtccccacgcctgctgctcagggccccatcaccctcgtgactgtcagtggtgctgcttcccacgtctcctaagagggcttcaggagaacgtagaacgaggtatctgtctcttcctttcggacctggcctttccatttggccatatgtcagaatttccagctgccctaggggcccaggaatctgtattttagttgctttccaaataattctgctgcccagctgtatttggagactatagccttaaatcagtgattccccgtcagtggtgactcatgaagagcttagatgtgggcctggtgtgtggttggtggcaaggggagtctttcagatcccttctgcttgttgctgttggtggcaggagcgtgcatgttatggtggctcaggcctaatcccatctgtttgggcatctcgcctgtctggaaaacaggtcccggagccatgcacaccaagctcctagggaaggcagagagcactccccgactcttaacaaagacatgtggaggtggacgtctgcccttaagcactcagggttcaagaaatgctgcaaagaacaagagctgcagccaccaggagatgcaggtgactcccatggaccagaaaaaggacagaaacatgacagaaaactggtagaagaaccaaagaggtttggcatttcacagggcacctgactctggagcccacagtcaccctcctcggggccctctccatcaacgtcatggatcaagttcctcctgatgaccaagccaccaaagagagctgatggttatgttcagttgactctgctgaggcagtcagggcagtgtgatctcctcctgggaattgctgtatttgaaatgattgaaataggctgggcgcagtggcttatgcctgtagtcccagcacttgggaggctgaggcgggcggatcacgaggtcaggagatcaagaccatcctggctaacgcggtgaaaccccgcctctactaaaaatacagaaaaattggccaggcgtggtggcaggtgcctgtggtcccagctactctggaggctgaggcagaagagtggcgtgagcctgggaggcggagcttgcagtgagccgagatcgcgccactagagtgagactccgtctc

SEQ ID NO: 237220 - DNA, 478 bp, Homo sapiens
gtagccaggaacatggaacttgcaaagtccttttatgaagaaacaagatattctcaatcccattggcagactacccctttgaagactggctaaattgggtcctgttgcccttaccagctgtgagggagcctgcaagagggagtgttgagcttttccagcagctatagcggaaggaaggaaggaaagaaggaaggaaggggagaagggctagaattgcctgttgggtaagctaaccaacagtgcgtgctatcaagggctaggctgggatgtcacagcttcatggccttgctctggagtgacagaaagtgagctccatcaaaaaaaacatggaaactactgtttcagaacagtgatttttgggccaggcatggtagctcatgcctataatctcagcactttgggaagctgaggtgggaggatcacttgaggccaggagttcgagaccagcccggccaacatggcaaaaacctgtctctac

SEQ ID NO: 237221 - DNA, 613 bp, Homo sapiens
acagattgctaaattttatcaatagatatttctgtttactgggcacacagttaaattctatttctctgccagcctccttgtatcaacttacagctaagtggttgagtctgactgattgaatgtgggctaaagtaatatataccactttagggcctgactcgtaaatatatccttatgatctctctatctctacctctaattcctttccagtcatagtggtaggaagcaaatgatttcaaagcccagatgatgacagagacccatcttggaaggggcttggatccctgagtcactgcttggaggagagctgcctgagatggcttcctgatcatgaacatccacgttggactttgcctgagcaaggaataaacatcctatcttaagacaatgtgatttggagtttttggcatatgaccagcttcaattacgctgcataatttacatgtcttttccctctttcccaggtaactcatatgcctcccagatgtttatatttggaaagagggaagaagacccaaataataactgagatcaaatttctcaccaactcactgggactctgagagatgcatttcatttgatttaaagaaaataaattactttgaaactagac

SEQ ID NO: 237222 - DNA, 449 bp, Homo sapiens
gcaaattccctggacaaagagacatcctctgtcttgctctctatcttagggaggaaacatttgatctttcaccattaaatatgttagctttaggtttttggtaaatgttttttaaatcaggctaaggaagttcctcttttccccctagtttgctgagagtttttcttatgaatctatgttgacttttcgcaaatgatttttctgcatctcttgagatgatcatttaaggaagaaataataccaattctacataaacataaaagaggggagacggccaggcgcggtggctcacgcctgtaatcctagcactggcgctctgggaggctgaggtgggcggatcacctgaggtcaggagttcgagaccagtctggctggtgaaaccccgtctctgctaaaaatacaaaaattagacgggcgtggtgatacactcctgtaatcccgggtacttg

SEQ ID NO: 237223 - DNA, 386 bp, Homo sapiens
tgctatctacacatgatttgacttaatttcattatttcacttgaatattacctgtattttactacccacattttctatttccgcttgaagcccaataacctgcatcaactttttcttattattaaaatcactggttacactgatgagataaaaagtataataacaatattaatttcaggtataaattggaaccttattaactaaaaaattttaaggcttataattgattttagagaaattaaattagttgaatgctgtttataaataccacattttataaatcctgatagggcttataaatgagtccattgtttttcttttactcacactcagtgattaagtaattagcaccctgttattgtcttacgtgagatatagtacatgtt

SEQ ID NO: 237224 - DNA, 500 bp, Homo sapiens
tgttatcattatctcactatcacataaccactcagtaagatacagaacactcacagaccactgagaccacttttataactgaaatgtaaaagttaagtgattttccatgattgcatagctgtagaatggtggatataaactagattcggatttcttgacttttcatcttttttcccccaatatgcctatacagaatgtttgtttccttttaaagtactgagtttaagagtttaaatccaaatcaaacctgagaattaattttcatttctgatgctaaataccaaggatttctccattagtccaggtaacttcattgtgaagaaatgataaagagaataaaagggagtaagataaacactgtgcaggtataacattaaattaccctttttttctaattttatacaaatgaaaaaaaggatacccaactgcaaagtccctgagatgctatttaaattcaagtacttctgaaatacaaatacatgataacttaattatttgca

SEQ ID NO: 237225 - DNA, 439 bp, Homo sapiens
gtgctgggattacaggcgtgagccccatgcctggcctccagtcctgcttctttgggttcagccctatgctataaaatctcaccttcctcaggccttttgcagacacatcagatcctctggctttgtatctgttcttggtgctttggacaccacctccaccccaatgcctttgtttttctccaggccctctttcttcatttattcatctgcctctgcatttctgtaactttctgagtagtgggtgctcaggttgttcacgtatcttcatcaagaagtctgtctgggataaagcagaagttgcaatgattgccttctgaatcacccctcagctgaggagcaccagcaggcaaaaccagtccactgagcttgtaagcaggtctgtggcatcagcttattcttgttgctagagagaattcggagtaggtgctacaaggtgctt

SEQ ID NO: 237226 - DNA, 504 bp, Homo sapiens
tgcttctatttcataggagctagaaagggtacatagctgaacagaaattatatccaatcctccacgttgtttaaaggttcaaacttaggggaaaagtgtgtctggtctttcaaagtgaaaaaaggaaggccaagatcaaaaaatcaatcacatacctcccaaactcatccaatgactaatctgtactactgatctattactggttggtttacggtggggactaagtgaaagagttttataaaaatatatatccctggactctacactgaggtaactcctgtaaaatcagattaataaaggattcgtgcactttttaaattcagacatttctgtaggaaaactacattcaccttgatgtatctgagataccttatagagagaaaaaaaagaatttgggaagcacttacagaatggcagaaaaaagtataacttaatataaactcaagtgacaagacagccaaagtgctgtagtgggtaattttctttaagtgaaaggaagctgag

SEQ ID NO: 237227 - DNA, 406 bp, Homo sapiens
gattatttgaaaatcaatgtttcaatgtttcctatttccatttacctcttgatgaacatttgagttttttcgagtctggggctattataaataaagctgctgtgaaaatttgtacacaagattttatgcatgtatgtttttatttgtcttcagaaaatagctaggcttagaatttccaagtcattaagtggatgtgtatataattcttttccaaagtagatgtattatattacaatcccacaaggaatatatgagagttccagttgctccacatcatccacaacacttggtattttcagctttaagacttcaatctagtgagtatgaactggtatcccattttgcttttatttgcatttttctgatgagtggtggcatgcatccttcatgtacttattggtcattt

SEQ ID NO: 237228 - DNA, 152 bp, Homo sapiens
caaggacattctggtgtgtcggtcatgggctgtacggatggtcacacacacagctgactcaaaatttcagatgtgcctcaattactctgaaaatgaaagtactgatttcttccaattttatataaaatatatatttaggacttacagactgt

SEQ ID NO: 237229 - DNA, 251 bp, Homo sapiens
catgcataataaacacagctaaagacaattcactctcttcttttatgtatctacagctggattcagatagagctcacctaataataaatgctaaaagataaaattaataataaaataattatttaagatatctcaacactaagagcatgcatggcacattattttgaagactcaaggggtaaatatgatctctgaaatatatataacaggaatgaagaggaaattttagaatcttatgtttcccaatctca

SEQ ID NO: 237230 - DNA, 187 bp, Homo sapiens
attttaattcatataaactacagatcctttatgcagaaatcacataccattaagacaaacaataacttaaaaaaatccagctagtgtgttttgtatctgttaaaatgttgactctcaaatgttaaaaataaaaatgaaatgttcatgctcttcttaatttattcccttttctctctctctgtctcta

SEQ ID NO: 237231 - DNA, 1824 bp, Homo sapiens
  misc_feature (1747)..(1747): n is a, c, g, or t
ggcacgaggctgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaanatatacatgtatacctggatttgcttggcttctttgagcatgtaagagaaataaaaattgaaagaataatttttcct

SEQ ID NO: 237232 - DNA, 1856 bp, Homo sapiens
  misc_feature (1779)..(1779): n is a, c, g, or t
ggcacgaggctgggggtcagagagaagggagaggcctccttctgaggggcggcttgataccggtggaggtaagctggccgaggctctgtgaggagtcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaanatatacatgtatacctggatttgcttggcttctttgagcatgtaagagaaataaaaattgaaagaataatttttcct

SEQ ID NO: 237233 - DNA, 300 bp, Homo sapiens
attgatgggatgttaaggactgacaaggaaaaaggaagagaaaagagaagattatgaaatgcaaatgtgtatatttagcaacaaatcagatggccagagtaaatgacaaataccaataaaaaatggctgagatttcattctttggaaagtcagtctcagatgaggaagctgtaagtattcacaaagttcatggaaaacactaaatttctttaggtcatcaaaaaaatatgagaagatactccttcaaacatgaaattattctcacattcataggagtattctaatttaaaagtattccta

SEQ ID NO: 237234 - DNA, 455 bp, Homo sapiens
ggtttttttgtttgtttgttttgttttttacatctttgccagcatttggtattgtcagactttaaaattaaaaaaaaaattcagatgtgaagtggcattttactgtggttttaaaatgcatttccctgattgtttccccttttcatgctttttggtagtttctgtttcctcttctgttaatgcctgtataaggtgagaatttgtccactttttactctcccttctgttacttctttttcacgaatttatggtagtggctcatacattagtttgcctgcttttgcctttgtccctatagtctgctttcacacacagtggccaagaatgagccttaaaataagtaatttatgttctgccacttctgtattctaaactctgtagtggctcctcatttcatgcagagtagaagccaaagtccttatagcgtcccttctgtcttacatgatcattctcca

SEQ ID NO: 237235 - DNA, 453 bp, Homo sapiens
aggttcatgtagactggacacggctctccttcgcgagatattcttggagtcattgcatttgtgctgttgatcctgggagctgggctatacctctggaagaaatgtgggaagaagaagaagaagaaagatgaagaggaagaagaggaagaggagcagaaggaggaggaggagcgggaggagacaggaataggcaggttgcatttctccatcgaggcccagatatctcccctcccccactagaatctgggttctctttctcctgaaagaatgtcattgtttagctatatgaataaccctagatatagcatcgagttaacatgtccaagatatttgttactggaaaaaactgaacagcaatgcatggtatgatttaatttttgtaaaagtgtatagataggtagatagaaagataagcacagaataaaatctatactacatgacagattaaaaaca

SEQ ID NO: 237236 - DNA, 2210 bp, Homo sapiens
  misc_feature (1738)..(1738): n is a, c, g, or t
aattccctaccctcgacctgtcgatgccccgcggccccgcccgccctcttaagcctggctcagccctcagggcccgcccgaagtctaccgagcccgagtggcctaccgagcccgagtggccccgcagcgtccaggaggcgcccgctccgcggtggcgctcttggaggtggtgtcggagagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccaccgtggtacccaattccccacgtccccagggaagtgccgcccttcctgagcagcagccacgagtacgcgggtgccagcagtgaagatctgggccaccaaatcattggtggcgacaacgagagtggcccgtgttgtggacctgacactttaattccaccgccccctgcggatgcttctctgttacctgaggggctgaggacctcccagttattaccttgctcacccagcaagcagtcagaggatggtcccaaaccctccaaccaagaagggaagtcccctgctcggttccagttcacggaggaggacctgcacttcgttctgtacggggtcactcccagcctggagcacccagccagcctgcaccatgcgatttcaggcctcctggtccccccagacagctctggatctgattctcttcctcaaactctggataaagactcccttcaacttccagaaggtctatgcctcatgcagacggtgtttggtgaagtcccacattttggtgtgttctgcagtagttttatcgccaaaggagtcaggtttgggccctttcaaggtaaagtggtcaatgccagtgaagtgaagacctacggagacaattctgtgatgtgggagatctttgaagatggtcatttgagccactttatagatggaaaaggaggtacggggaactggatgtcctatgtcaactgtgcccgcttccccaaggagcagaacctagttgctgtgcagtgtcaagggcatatattttatgagagctgcaaagagatccatcagaaccaagagctccttgtgtggtatggagactgctatgagaaatttctggatattcctgtgagccttcaggtcacagagccggggaagcagccatctgggccctctgaagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaagtgttctacatgtgggaaatgtttctctcagtcttccagcctaaacaaacacatgcgagtccactctggagacagaccataccagtgtgtgtattgtactaagaggttcacagcctccagcatactccgcacacacatcaggcagcactcnggggagaagcccttcaaatgcaagtactgtggtaaatcttttgcatcccatgctgcccatgacagccatgtccggcgttcacacaaggaggacgatggctgctcatgcagcatctgtgggaaaatcttctcagatcaagaaacattctactcccacatgaagtttcatgaagactactagccctgccaggcacaatgactcacgcctgtaatcccagcactttgggaggcagaggtgggtggatcactcaagtccaggagttcgagaccagcctgggcaacatggtgaaatcctgtctctaccaaaaaaatacaaaaatcagctgggggtggtggcacatgcctgtggttccagccactcaggaggtcgaggtggcgggatggtttgagcacaggagacggaggttgctgtgagctgagatcgccccactgcttttcaacctgggtgacagaaccagaccctgtctcaaaac

SEQ ID NO: 237237 - DNA, 332 bp, Homo sapiens
aacaggaggcaaaccctcctcctctactccctaacgtccccaacctcttgacttaataccagcaaagaccattgttacgttggagtcttgtttgctaagctacacaacttacagagccattcatgccagtgacatcactgacaagagacaaagaaatcatacgggacaatttgaacaataaagaacgaactacctttgtttttcccagtacccagtgatctaatctggacttttccaagatagccacacagctctctttgctagcaagaggtgtttgatgtgctgtgaatgccaagtaataatacctgcaaaataaaagaattaagtgaagc

SEQ ID NO: 237238 - DNA, 1705 bp, Homo sapiens
  misc_feature (1128)..(1128): n is a, c, g, or t
  misc_feature (1218)..(1218): n is a, c, g, or t
  misc_feature (1321)..(1321): n is a, c, g, or t
  misc_feature (1414)..(1414): n is a, c, g, or t
  misc_feature (1440)..(1441): n is a, c, g, or t
  misc_feature (1578)..(1578): n is a, c, g, or t
  misc_feature (1580)..(1580): n is a, c, g, or t
ttccacctgacagcaatcgagtgaactacgtctactgcaggctccaaaaagtcaggttagaacccagatgagtctgatttcacagcctgagcacctaatgtcactctgacactctgcccgccacggccctatgttgttcctggcctggccagaacctgctcatgatggcctcacatcttgcttatggaccatcctagcagtttctcatctgcgagtgactggattcatcctgcagtcagcatcctgctcacccactcctgagtggccacctaccacaagtgggaggaagtacagctcctcgtttggctccttgggcctcccagatctgtcctgactttccatcctaatcactcccagttgtcctgactgtactgtctccacagccttcccatggtgccgaagtcagagctgactttgtacagcctttgctcataccctgttctgatccttccctctgacgtcctccactgcaacccagcccagttccaacttacttgcatagagctcccataagcattcagcccatagaacccggacatctctcccttcctctggacttaactgcattgatctctttcagttatctatactctgcataaacttccttgtggcatactttacactggtgttttgtttaactgaggtactgtggataacaccaaaaccttcttgcataggtgtggaaaaggccttttgtgagctggtccctgtctggctttacatagaacaggctacttaacttcgctaaacttcagtttcctcatctgtaaaatggggaagaataatagtatctaccacatagggttgttttgaggattaagtgtacttaacttagtgcctggtatgtagtaatgctcagtaaaatatattgtgttgtcatttcccaccatttcttcccacctgcccctgtatttgttactccagtcatgttgagctacagctctctaatccctctgcctggagattcctcctctgaccattaacccatttatgccggaagttgcaagttttttttttgtgaaaactcagaccttggcgatgaccgtgagcgtcggatataaataattccaccaagcttaatttttttttttattttgagactgggtctcactgttgccaaggctggantgtattggcgcgctcacggctcactgcagctttgacctcccaggctcgtgtgatcctcccctgtcagcctccctagtagctgcgcctacnggcatgtgccaccatgcctggctaatttttgtattattttatagagacagagtctccctaggttgcccaggttggtcttgaactcctgggctcaagtgatccnccttcctcggcctcccacagtgctgggattacaggcataagccattgcacccagcctaaaatgcaaactaatttaacattgagtcacatttangctgggcgtggtggctcacacctgtnntcccagcactttgggaggccaaggcaggcggatcacgaggtcaggagatcgagaccatcctggctaacacggtgaaaccttccctccgtctctactaaaaatacaaaaaaatagctggacatggtggtgcgcgcctntngtcccagctaccccagaggctgaggctggagaacggcgtgaacctgggagacagagtgtgcagtgagccaggatcgtgccactgcactccagcctgggcgacagagcaagactcagtctcaaaag

SEQ ID NO: 237239 - DNA, 607 bp, Homo sapiens
aaacagaaggtcatatgcaaagcatagtaattcatttcatgataaactggatgctgtggaaagtgacttgagcaggcagagttcctttcttctcagttaatttactcacagctgtagataacattcatggaaaggaaaagagatatttggatgatatgtaaacagatggatttatgtttgactatgtgcatgcaagagagttaagtatacatgatggacatgttttctgaaatgtattgtttttcaagtttttccacttccttgggcgactacctcttcccctgctacatgtacccattttctctgaatagaatttgtacggcaaaaacatagaaacaaaaaaaagccccacacaaacaaaaaaaaaaaacaggaaagagtcgaagttaagcttttgacatttaatatatacttttctgagctcacggaatacaacagtcttcaaaacaagactgttgagggagaaaggggttttctaggttcttgatgtttttttggtaaacttttagattctcttgccccagaggcagggaactaaaaaagtagcaaccctagaaaatttgaatgtaagctcaaagcaaataaaacgaaaaacccacttcctgta

SEQ ID NO: 237240 - DNA, 392 bp, Homo sapiens
ggaattgaaggtttaaccctacccagtaggtcctccgatactcaagaactccttcccggagcggagacacagatcatggctatcagatgggtcccttggcagctcagctgcagtgtcactctgtccacccaggctggagcgtaatggcacgatctcagctcactgcaacctccatctccagggttcaagcaattctcctgcctcagcctctcgatgaaaccaacttcataaaggctgtggcatttcttccaagacactacgatgaagatgacatcatcaggagacttagggaaagctacgacttttcaagtaactaaagtgggtgaccctcactactttgtgggctcaatagctgtgtcttcatttataaaaataaaatggtagagactgta

SEQ ID NO: 237241 - DNA, 1881 bp, Homo sapiens
  misc_feature (890)..(890): n is a, c, g, or t
  misc_feature (1114)..(1114): n is a, c, g, or t
  misc_feature (1535)..(1535): n is a, c, g, or t
attaatatatgaagaaaactgaacagtccttaatctgtgtaggcattacatccatttgtaggaggtatttggtgacttggtacaggtttctttgttttgtgtggtttgttgaagatgcaatgaccgggatgaatgagtgaacagctgggtgaggcaggggatgggcattatgaagttgggggatatattgtagatgaaacagatgaccctaaggaggtaatgagggggtggactaaagaatgacgaatgggagaagggaaaatattgaattcatcttagcacaagtatatcatcctttgaagaataatccaaaacacattccagacattaattgtgaaattcctgaaaaatgtgggtgtgcttaacatctcccaggctatggtgcaagcagagatgatagtgttgctttagcctgtaaatacaagagggtaggaggtggtaaaatgagtggaagggaaatacatttagtgaagcgggttcctgtaacactgtgttccgtatggcacgtttggtatcaggattttggagacaccccagtaaagctcatttaattatttgagggagaaacagtagactagccaagcatgcatgaataacacattgaaagctttccttctcagaggtctaattctgcaaagctgcattttcaaagatctgacttgcctttgcatggaaatcagtcattcattcattggtcttctatgctgtacaaggccttctgctggggtgagggggaaactagggagcccggggacctctccaacatattctttgctctgtacacttaatcaagataagaaataaagacagcaagactgcaaaaagtctattatgtagacttgcaaaaagtctacataataatataaattcaagccaagtagaagtgattntgcaagtctgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcancatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcacccaccctgctgcttgccctgggcagtagcctggtcacatctttgaaaacctctgtttagtcaagacttcctaagtcaagacagaggaatggttgaatatacctctatgtaagaataccctcaaggtaaacactaaactcttacgtgttttatcttgggcccacatgaaaaaagtaaatgtttttaaagaacctattttcctttgttagttgcaaagtgaacaggtatcaattccttacctccctcctccagtcccngttaattccccacatgaaaatacctacatgttggtggaaaagtgtaatgttcaagaacttggggccggccgtggtgtctcatgcctgtaatcccagcactttgtggggctgaggcagatggatcgcctgaggtcaggagttcaagactagtctggccaacatggtgaaaccttgtctctactaagaatacaaaaaaattagccaggcttggtggcaggcccctgtaatcccagctactagggaggctgaggtgggagaattgcttgaacccaggaagcagaggctgcagtgagctgaaatcgcaccactgcactccagcctgggcgacaaagcaagaccctgtctc

SEQ ID NO: 237242 - DNA, 330 bp, Homo sapiens
caaatgttaattcagtaatggttgtagaatggattgtgtacaggacagtctaggttagtggcctcaaacttgatcatgtagaagaattacctgtgtgttttgtaaattcctggcttttattccaccttccccagaactggttcaggccacacttaagcacctgaagtatgctgatccaaattgtaacatgctgcaagtgtaaaataccagatttcaaagacatctaaactaatggatataaagtattatgttaatatgttttctaattgattacatcttgaaataatattttacattcattgaattaaataaaatgtattattaaaatga

SEQ ID NO: 237243 - DNA, 429 bp, Homo sapiens
tgtatctaagaccttccttggacatctatgataaatcaaaatatctttatcatgacaagaacagtgatatacacccgggtggaatcttgatttcatgagtatgtatttgacataatttattacgaaaaagtgaattaaaactttgtgttacaagtctttccatctaaattagaccccaagatcaagagatttggtgtttgtcttccttacatctgccattggtagccccaactttccagagaaaaagcaacaactgttagaaatgttatagatataccaagggtatgctaaatcaaccagtgatgtatgttgtgaaagtgacaagcttttgatcaagatagaaaacaagataaaaactatgagtgttttaggatgaggcatcttctcattaaagttcagttacattgtctctgcccagcttttttactg

SEQ ID NO: 237244 - DNA, 439 bp, Homo sapiens
gtggggatggaggtatattgtgtttttttaaaggccataagaaaataattgtcttgataaaattttaacttaggactgggtatggtggctcgtgcctgaaatctcagcagtttgggaggctgaggcaggaggatcacttgagcccaggaaggagaccagcctgagcaacatggcgagacccctaatctctacaaaaaatgttaaaatttgccaggcatggtggtgcaagcctgtagtcccagctgtttgagaggctgaggcaggaagattgcttgaacctaggaggtcaaggctgtagtgaacagtgtttgctataccacattccaatctggtgacaaagcaagaccctgtctcaaaaaaaagaattttttttaacttgagggaaaaaaagttttacaaactgtagacacacagcaaaacagaaacaggaaaaaaagta

SEQ ID NO: 237245 - DNA, 238 bp, Homo sapiens
gcttgaggccttatcatagttagtggtctgtgaattttgtcaagagagggtcacaggccaagatgcagactgacttcctttttacttgtctggaatcttattactcagttcctcaattattttttactcaataattggacattttccttagaatccatgttgttcgaggtctcgtcctgtaggtaaggtgtgtagctcattgaggctttgagaatatggagagaatgttaagagtttg

SEQ ID NO: 237246 - DNA, 435 bp, Homo sapiens
ggttttaagctacccagtttgtattaacagtactaggcaatcctaggacactaataaagggactgtgcagcttttgcagtaatttaaagcatgttcttgactattttaaggcaagaaaaactgcttacaatatattaataactgaagagcaggttataagacattctatatgctctgtcctattatctaaaaaatacctaaatgtatatacgtatattccttcaatttatttcctatacatcatagagttaaaacaagttttttttctaattagtagcatattgaactttatttcctttattatattttcctgaattattcaaattttataaggagatacaaatctatgaattttttttgaagaacaatgtattttacttggttttttctgctgtgatttaggcatctatgtcacctaataaaaaacacaattat

SEQ ID NO: 237247 - DNA, 254 bp, Homo sapiens
gaagatatggtggttgaagttacaaggactccttgttgtaaccaggagccgatcttgatcaatggagctacataaagcatgttgaaatgcaaagaaagatagaaggagcctgtggtactgaaaacattgaggattctctgaaccagccttggctaccccaccatttaacttgagaaaaaatatttctttcctctttaagctcttcttctaccaaatgtatcaggaaataaaaatatattaaattaaaacaaata

SEQ ID NO: 237248 - DNA, 401 bp, Homo sapiens
agtcatttgcaggataaatgtttgtatatattcctccttatattaacttaggttaattttcttacagagggattaagtcctagcaaatagattatccacataaggtttatacttctgttgtcaacaattatttctttacgtgtggtattcttaactgctctcattccttctgacatgtaattatataatgtattatactatttaaatgtcttgtgtgattataaagtatctctttaatttgattaaaaaggtaagatataaattactttaaaaggtaggatttatccttttcttcatgtgcaactgtataaactggcaaagcaataagatttaaattgtttttattgtattaattactccaaataattgatatttgatgtgaataaacttaatttcggtta

SEQ ID NO: 237249 - DNA, 528 bp, Homo sapiens
ccaacaagtctgaattgctcccccatcacctacactgataaacaaccaccagtgatctgatgcatttcccaattcatgagccacagctctgacttaaacagtacgtgccagccttcatggagtttaggatctaattagtaaacattatcaataccaggacaatctaaataaaagcggaagggaaaggacactctaagcagaggaaatagaaggagcaaatgtgtccaggcaggtgtgtgcttatatgagcacctatccaaattggacagcaggatttgttataggggaactgggggagatgaggcaagtctcaaggacacagaagaacagatttggggtgggggtagggcttatatttaggaccaccaacctaagagaagccagagttttctcatgagaagtgtccaacaataaaatttgttaccttgctagtggctgtgcattcccagtccttgaaataatctgttcaaggagcatttgtgtgacttttgtctgcctggataataaaataacttctaaagaaaaaaa

SEQ ID NO: 237250 - DNA, 238 bp, Homo sapiens
ccaacaagtctgaattgctcccccatcacctacactgataaacaaccaccagtgatctgatgcatttcccaattcatgagccacagctctgacttaaacagtacgtgccagccttcatggagtttaggatctaattagtaaacattatcaataccaggacaatctaaataatctgttcaaggagcatttgtgtgacttttgtctgcctggataataaaataacttctaaagaaaaaaa

SEQ ID NO: 237251 - DNA, 1008 bp, Homo sapiens
  misc_feature (800)..(800): n is a, c, g, or t
  misc_feature (805)..(805): n is a, c, g, or t
catttctacagagtggcttgggctgaggtaaaagaagctagagaagagagccgctgatgcactgcacctgcctaggctggagttaaggtactaatcacagcagcagtgctgggaaagatgcctaggaaggatgaggatgacaggcactattttggtgtgctccccaccacagcaataacagaaagatagtccaggtgcagtgtctttcacctgtaatctcagcctcccgagtagctggaactacagccatgctacacctagctaatttttgtatttttagtagagacagggtttcaccctgttgcccaggctggtctcaaactcctaagctcaagagtctacctgccttggcctcccaaaatgttgagattacagttgtgagccactaaacctggctagttttaaaagtttgctagctgatgccaaattggtttccatagaggttgtaccaatttacagtctcaccaacaatctgtgagcctgcttgtttccccacaccctcacgaacacaatatgttggtctttgccaatctgataggtgaaatatagcatctcattattttaatatgcatttctcaagaggcatggtgactcacacctgtaatcccagcatttagggaggcagaggcaggaggatagcttgagttcaagacctgcctgggtgatatagtgagaccccccccccattctccacaaaaaggaaaaaaaaaaagaccaaaaaacagtgtaatttgggattcctttccttatgaatatggttccctgtgtttaaagccatttgtatttccatttctatgttnatggnatgcctgcacattgaaagcggctgatgtatcataccaaaagccttacatttacagatagccttgccggatggttcaattctttcccggttaaaccacaagggggcgctaaaatccgagccagtacgtccctttgacaggccctatggacgataacagcaggccgcacagcggcgacgcacgaactcgcgacaccgggcaggca

SEQ ID NO: 237252 - DNA, 823 bp, Homo sapiens
aaacccactctatgtaaaatgcactatttatttctcataatatactctttaatgtgcttatattctaggtatcattgcctttaagttgcttttttaaatgaagtatcattattattattatttgagacagattctggctctgttgctcaagctggagtgcagtggtgtgatcttggctcactgcaacctctgcctccctggttcaggcaattctcatgcctcagcctcccaagtaagtgggactacaggcgtgcgccaacatgcccagctaatttttgtatttttagtagagacagaatttcactatgttgtccaggctggtctctaactcctcaagtgatctgcctgcctcggcctcccaaagtgcctgtgcccagccttttaattggactttaatgtgcaaatgcagtctcttcagaaagcctttttttcttctttttttaaatcagcctacatcatgctatgacaattttcatataaagatgctgtctcggaaagaaaaggattgggagtttgaaagatctatggcttccattccaaaaaggattactacagaagtaattactttgaaagaaaagtgatatatgttttggagaaaggtggaaatgaagcaaggccctgaatatattaccaagatgcatattacactgaatgaaatcatccgttgcccttccggatctatcccgtggatgcagagcaagagcaacccatctttgttcagcatcccaggagacaggcctctattgacagcatcagtctggctcctttgccctctgatttcccattgaatgtggccagtgggagggcccagcagatggagggc

SEQ ID NO: 237253 - DNA, 775 bp, Homo sapiens
catttctacagagtggcttgggctgaggtaaaagaagctagagaagagagccgctgatgcactgcacctgcctaggctggagttaagataccgaaactggcaacacccagagacatttccctcctagtcataaaggaagccagcagcagagccagaaataatattcaaattctggatccactagaccatattgcccgtctgacaaattatacgcttacatcctgcttcagttctaataaggtacccacaatgccgggttctctacccactgggagcaaacaagggaacgtgcagacgctggacagcatacgatggatgcctgcaactcctgtacctgcccccgaatgccaccagaaatatgccatctctactgaaacagcttttccaaccctgagcacgtttatgaacacggaaaagagtgtaaaggggtcaaatgcagactttacaaaaagaaacccaagatggagattcctgttcgggatatactgcaggtggggttcataacaacatagtcctttacttgccaagtaatctgaaagcaactaattagagaacctgtaagggatgccaatcccagttttcaaaatggcatttcaaggaaattaaatcttatcatgtaaataggtcaagaaatccgtttaaataacgtatctgcttctctctaggtaatctacaatgttgttagactatcaagccagtagttttaaatatgtgttggagctccaggattaatccctggttgatctgagggagtcactttgtctaaccaaataca

SEQ ID NO: 237254 - DNA, 1154 bp, Homo sapiens
catttctacagagtggcttgggctgaggtaaaagaagctagagaagagagccgctgatgcactgcacctgcctaggctggagttaaggtactaatcacagcagcagtgctgggaaagatgcctaggaaggatgaggatgacaggcactattttggtgtgctccccaccacagcaataacagaaagatagtccaggtgcagtgtctttcacctgtaatcccagcactttgggaggctgaggtgggaggatcgcttgagcccaggctggtctcaaactcctgagctcaagcgatctacctgcctcagtctcccaaggtgctgggattacaggtgtgagccattgcgctcagcctggtcattatcatttctatcaccagataccgaaactggcaacacccagagacatttccctcctagtcataaaggaagccagcagcagagccagaaataatattcaaattctggatccactagaccatattgcccgtctgacaaattatacgcttacatcctgcttcagttctaataaggtacccacaatgccgggttctctacccactgggagcaaacaagggaacgtgcagacgctggacagcatacgatggatgcctgcaactcctgtacctgcccccgaatgccaccagaaatatgccatctctactgaaacagcttttccaaccctgagcacgtttatgaacacggaaaagagtgtaaaggggtcaaatgcagactttacaaaaagaaacccaagatggagattcctgttcgggatatactgcagcctacatcatgctatgacaattttcatataaagatgctgtctcggaaagaaaaggattgggagtttgaaagatctatggcttccattccaaaaaggattactacagaagtaattactttgaaagaaaagtgatatatgttttggagaaaggtggaaatgaagcaaggccctgaatatattaccaagatgcatattacactgaatgaaatcatccgttgcccttccggatctatcccgtggatgcagagcaagagcaacccatctttgttcagcatcccaggagacaggcctctattgacagcatcagtctggctcctttgccctctgatttcccattgaatgtggccagtgggagggcccagcagatggagggc

SEQ ID NO: 237255 - DNA, 1117 bp, Homo sapiens
catttctacagagtggcttgggctgaggtaaaagaagctagagaagagagccgctgatgcactgcacctgcctaggctggagttaaggtactaatcacagcagcagtgctgggaaagatgcctaggaaggatgaggatgacaggcactattttggtgtgctccccaccacagcaataacagaaagatagtccaggtgcagtgtctttcacctgtaatcccagcactttgggaggctgaggtgggaggatcgcttgagcccaggagttcaagaccagcctgggcaacatgagatggggttttgttgtgttgcccaggctggtctcaaactcctgagctcaagcgatctacctgcctcagtctcccaaggtgctgggattacaggtgtgagccattgcgctcagcctggtcattatcatttctatcaccagataccgaaactggcaacacccagagacatttccctcctagtcataaaggaagccagcagcagagccagaaataatattcaaattctggatccactagaccatattgcccgtctgacaaattatacgcttacatcctgcttcagttctaataaggtacccacaatgccgggttctctacccactgggagcaaacaagggaacgtgcagacgctggacagcatacgatggatgcctgcaactcctgtacctgcccccgaatgccaccagaaatatgccatctctactgaaacagcttttccaaccctgagcacgtttatgaacacggaaaagagtgtaaaggggtcaaatgcagactttacaaaaagaaacccaagatggagattcctgttcgggatatactgcaggtggggttcataacaacatagtcctttacttgccaagtaatctgaaagcaactaattagagaacctgtaagggatgccaatcccagttttcaaaatggcatttcaaggaaattaaatcttatcatgtaaataggtcaagaaatccgtttaaataacgtatctgcttctctctaggtaatctacaatgttgttagactatcaagccagtagttttaaatatgtgttggagctccaggattaatccctggttgatctgagggagtcactttgtctaaccaaataca

SEQ ID NO: 237256 - DNA, 1067 bp, Homo sapiens
catttctacagagtggcttgggctgaggtaaaagaagctagagaagagagccgctgatgcactgcacctgcctaggctggagttaaggtactaatcacagcagcagtgctgggaaagatgcctaggaaggatgaggatgacaggcactattttggtgtgctccccaccacagcaataacagaaagatagtccaggtgcagtgtctttcacctgtaatcccagcactttgggaggctgaggtgggaggatcgcttgagcccaggagttcaagaccagcctgggcaacatgataccgaaactggcaacacccagagacatttccctcctagtcataaaggaagccagcagcagagccagaaataatattcaaattctggatccactagaccatattgcccgtctgacaaattatacgcttacatcctgcttcagttctaataaggtacccacaatgccgggttctctacccactgggagcaaacaagggaacgtgcagacgctggacagcatacgatggatgcctgcaactcctgtacctgcccccgaatgccaccagaaatatgccatctctactgaaacagcttttccaaccctgagcacgtttatgaacacggaaaagagtgtaaaggggtcaaatgcagactttacaaaaagaaacccaagatggagattcctgttcgggatatactgcagcctacatcatgctatgacaattttcatataaagatgctgtctcggaaagaaaaggattgggagtttgaaagatctatggcttccattccaaaaaggattactacagaagtaattactttgaaagaaaagtgatatatgttttggagaaaggtggaaatgaagcaaggccctgaatatattaccaagatgcatattacactgaatgaaatcatccgttgcccttccggatctatcccgtggatgcagagcaagagcaacccatctttgttcagcatcccaggagacaggcctctattgacagcatcagtctggctcctttgccctctgatttcccattgaatgtggccagtgggagggcccagcagatggagggc

SEQ ID NO: 237257 - DNA, 539 bp, Homo sapiens
tgcaaaatatcaggttgttaaaggtgacttaatgatatgttaaatagctgacactcattgctataaaaatgtagtgcatccatggtccgcatgcccagccatggcaggtaggttaagttcagccctttggaaagcaatatggcaacttgtgtgagtaatcaggaaaatggctggaaccttggttcccatcattgccactgtgggaattttactttgaggaataatcaccccaaagggagagaggaagtgagcacggacatgttcattataacattatttgtaattgggataactggtgaaaaacccatgtcagtcaaaagcttaaagaagaatctaaatggagaatggatttgtaaattacaccttctcagtggcatatcattatccttaataatgataaaagtgtatggggacaatgacaatgctcatggcataatgacggcaaaaacggtctctgcattgtgattacaatgaaataaacttatatttgtttaaaagatttgaaaccaaatataaaaaataaaaacaatatgaattct

SEQ ID NO: 237258 - DNA, 472 bp, Homo sapiens
  misc_feature (357)..(357): n is a, c, g, or t
  misc_feature (377)..(377): n is a, c, g, or t
cctttcatggcaggctgagggggttatactatagggaggattttaaaaagaggagctggtggactggtgagcagggcatataggtgacacctagccaacttgagaggtcagaatacatgattccagaaggctaaggagaaggctgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcnccaggtttctattttagaanccttcagctgtcttgcttatgtactgtatgtaaatttattctttttaaaaatcacttttatttgattttgacttattaaatgctttaaaagccca

SEQ ID NO: 237259 - DNA, 397 bp, Homo sapiens
gcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctcttt

SEQ ID NO: 237260 - DNA, 477 bp, Homo sapiens
tgttccaaagaatatggtgacagccatgaggtaagaggcacaggtggagaaggctttgtgcctgccctctaacgaaggcatcttcaagacggcaatgaagatacacaggtaggaaatgaggacaatcataacacagctgatgacaataaaacttgagaatgccatgatcacaatgccattgaagtgggtatcagagcaagagagtttgagcagtggcggggtgtcacagtagaaatggttgatcctattagaaccacaaaaggacaacctaaaagtcatccctgtatgtatggctgcatttccacaacctgctaagaaggaggtagctattagcaaaaagcaaattctcccagacacgagaactgggtagagcagggggttccaaatggctgcatagcggtcatatgccatcatggccaacaggaagcactcagtccccaggaaggagccaaagaagtagaactgggcagcacatcc

SEQ ID NO: 237261 - DNA, 307 bp, Homo sapiens
agcatgttactgtctgtaatttatttatttatttttaaattttttcaccagtagagcgctgagaggaatctgtaatttagtatttgctttgagataagcgaatgcttcctttgtagtcactccttttcactcattttctgaaaacgttttcctttagaagtatgaaacttctggttttccttctttcaaattcgaatctcttcagacatatctaagatgattgccctacaagccaaccttgtatagctgaggagaaaagaaaatcagacttgttcccagcaactaaataaaattgtttttaaaaatc

SEQ ID NO: 237262 - DNA, 562 bp, Homo sapiens
acattggggattaacacttcaacatatgaattttggagggaaacattcagtccataacatatatcttttaaacttacaacatctactcttaggagatgaggtgtttgaaattgtttccatgctttgtgacagagtcctgaagaataaactgttttgaatcatagcagttggttttcaagtcaaagaacttagagcaatttaaaaaagaaaagaaaacaaataatgcatttgccagagtaataaaggcatcttcacatcggcacacacaaagttattgagaaaagtacaaagaaatgatcaaatggaatttcactgatgattgtataagatttcagttaaagcacaaaaccactaatgatatccatttaagagtcatcctccttcactgcctacttcctcctccacttccttccccagcatttcagaattgtgactgtttatgtcctgtgggcaaatattaattgcagtacttactcctgcatgcatgaaatgtttccatatttttcattagttaagaaatctttcagtctcccaacttggaacatatagtatctttaaaaaa

SEQ ID NO: 237263 - DNA, 502 bp, Homo sapiens
caccctgactttataatttttagtacacaatatttctactccccatatctttgctctgcacggtcaccttgcccctcccccaccacctaagaaaaaacgatggtcatatggtcatgccaacaggtgaagtgtataaggtgtctgcatattttgtgtaacttcagagttagattgaaattaccaggcacagatttaggcttgtcattttgtttacacataggggaaaacaattccatttattaaacgttttgtgtaactgcaccacccaagttttgccaagccgaaaacttggaccttttctatttagtgactttttagttttagttttcataacctggagatgaggccgttgtttttgcatgatgtatgtagtgtctcataactggagtttgctttagttttacagtatctgtactccttggatttttcaagagttattttataaacaggtgatgtatttctcattgaaaacaccatttaaaaaaacagccaatctcaaaaa

SEQ ID NO: 237264 - DNA, 412 bp, Homo sapiens
ggtctggtggtttgtttgcttgtgacagagtcttgctctgttgcccaggctggaatgcagcggcacaatctcagtttactacaacctccacctcctgggttcaagcgattttcctgcctcagcctccagagtagctgggattacaggcattgcaccatcatgcctggctaattacaattttagtagagatggggtttcaccatgttggccaggctggtcttgaactcctggactcaagtgatccacccacttcagcctcccaaagggctggggttacaggtgtgagccaccatgcctggccctgaattcatttttggtatgttagagtccttgattgaagagtaaagcaaagagtagaaataaatagtcaagtatgcaaatgaagcagcactcacagtgaggactgctccac

SEQ ID NO: 237265 - DNA, 585 bp, Homo sapiens
cccaaacataccccatatcctggaagcaccttacttgattttctttgtagtaattttttctgctatggaaataagccgatttcaggaggagtagagatggggaaggtaggggaaaatattacagaaaagttaacgtttgagaccatttatgccatccatcaaagaaggctgtgtgatctgaaattacacaatatgatcagaaaataattgacagacgtgatggatgaatctgcttcgacacagccgtgtaaaacgaaacataatttcttcttgtttactggcacacgtactgttcgatttgatttgattcatctgaaccatgtgattgcaacagtttcttcttctttccctcatactttctctctgtggactgtattcacatatacagtgagtaatacccgtgcgtttatttttatgcgttagaaagcaggaagggtaaacagatacgcatgtctgatgctcagttttatagatagaatttatgatttcaaagaggtccctgatgtgttctgtctgtggtcttcagatattgttcctccgttcagaagggagtgaaatcagagtgtaggattctgcattaatctc

SEQ ID NO: 237266 - DNA, 245 bp, Homo sapiens
gatacaagtgttccaaaattgattgtggtgatggttgcacaactctgtgaatatacaaaaaactattgaattgtacacttcacacaggtaaactggcacgtgaatacctcgacaaagctattgaaaaaaagaaagagatccttttgtagttcatgggcataatgattggtattcacgcacatgtgtgagatgtgccacactcaaaccttgttatgacctcggcacattacccatctgacctgaaa

SEQ ID NO: 237267 - DNA, 1938 bp, Homo sapiens
  misc_feature (935)..(935): n is a, c, g, or t
tgatatgtcatttttttgtttgtttgtttttgttttgttttgttttgtttttgagacggagttttgctcttgttgcccaggctggagtgcaatggtgcaacctccgcctcccaggttcaagcaattctcctgcctcagccttccgagtagctgggattacaggcatgtgccaccacgcccggctaattttgtatttttagtagagatggggtttctccatattggtcaggctggttgtgaactcccgacctcaggtgatctgcctgcctcagcctcccaaagtgctgggattacaggcgtgagccactgcgccttgcctgatatgtgatttttaatcatttgaacaagactgttattctgggatcaaaagattttattatgtttttaagtgttattataaagaagatgtagttatcactgctgcaatcctagtgggatttgtacacattggtgtatagcttggtataaaatttgagtttataatggaaataaatatttaaaaagttaacacttaaaaaagaagttaagtggtatgagagtttttataatgaaaccttttagacatttagagaatagcaccacatccccattgaaaatttaagtgaaagagagagagagaatgtgtgtgtgtgtgtgtgtgtgtgtgtgtgtgtgcacatgcctaccagttttttactatggagtctctgttttcttaagttataaatagaaacaacaaaaatatcttattagattactgtgaggataaaataatatctaaactggaaggttgtaattacttgataaatggtagccattattagaattgttattattaagaacaatgtacagtttctatcttttcagcatcttaaggaatttcataaatgtcatatacctatggtcccatgaacttatcctccttcttatgtttaaggactataattagattattnccttaacttgattcagtattacgtttgttctttcttaagagcaaaaccgaaagaaaaacacaaatttaaaaacaattttatcaaaattgcaaatgcagttaagaacttcgacaaaacaataaaaaagaagcacccaggggaaataataataatgtctataattatattatccagaaatatcctctgctaacaccttggaccatttctttctagttttgtgtgcataggcatgtgatcttatttactaaaatggattcatattgtagatatagtagcatttcagatgtttaatgatgatgatggtgttgatggtggcagtgacaatgatagttaacaatttatcatgtttactatgtgtcagtcactgtgctgagaccttttcatagattgactcatttaactcttaccctgagaagcaggtgctcttattatcttcatgtaacagatgaggaagttgagattaatgatttgctcaagatcacatagcaagtcacatgtgctcaaggtaacacagccagtggcagagtgggcttaacccctaatttatacgtatctgctcaattaaactttctattaagtcattagtgattcatctccttttatcatatgaaaagttaatgattacaacatataatatagtaatttgttttggaaaatgccctctttcaaacactgttagtgtttcacaaaactttaaaaaaaaaaaaacttactaggggccgggcgcagtggctcacacctgtaatcccaacactttgggaggctgaggtgggtggatcacctgaggttgggagttttcaccagcctggccagcgtggtgaaaccctgtctctacttaaaaaaaaaaaattagccaggtgtggtggcgcgcgactgtaatcccagctacttgggagactgagggaggggaattgcttgaactcgggaggtggaggttgcagtgagccgagatcacgccactgcgccactgcactccagcctgggtgacagaaacagacgtctc

SEQ ID NO: 237268 - DNA, 809 bp, Homo sapiens
ggttgttgttttacaccgtagataaccaggcaggcagaattcatctccgaggaactggttctttttccttgaaagctgattcatggccctttggttatggcaggaagggtcccagttcatctgcagagatgagctgctctgcacagaggagcgataggaattcaggagttgtcttcttgcagctaaatgatgagttgtaggggtaagattggaactgggagaagagaggatacaggagaaaagcttgagtaaaaagaaggtgaaatggtagaaagctggactctaagaaggaaagtaactggtgagaaattctgacggatggccaaggaactcgaggaatggagatgtctaatgttctattttaagttggttcctgctccttggtgctgctctattacctcgaaactttcagaaaaagtctgacagaagagacagaaactataaactataatttggtttcagttcaggtcactaaatgccatttctggcatccctgaacttgtgaatgaccaatgatcatatgatcatgtgagttactatcatctctaacctgtgtacaactgccacagcatgaattagtgaaaggatacagagtaaagtcagcaaagaagaaaggctttggagcaaagccaggagaaaccacaggcttccaagtgaaccctcccggtggagttgcatgaggactcacttcattctcccagcaacagtgtgtgacaacccatggtggtgttgccaattggaaaagctcacccaagccttgttgtccaaagctcttaatgaggagtcagtcatggagacatacaaaaaaa

SEQ ID NO: 237269 - DNA, 1575 bp, Homo sapiens
tggatagagtttcactcttcttgcccaggctggagtgcaatggtgcaatcttggctcaccacaaccttcccctactgggttcaagcgattctcctgtttcagcctccccagtagctgggattaaaggcatgtgccaccacgcccggctaattttgtatttttagtagagatgaagtttctccatgttggtcaggctggtcttgaactcctgacttcaggtgatctgcccgcctcagcctcccaaagtgctgggattacaggcgtgagccaccgcgcccggccaagatcctgtatcaaaaagaaaaaaagaagtagcagacacagtgtagtccccgtggaccctgcactggcctcccttggtgtggtcactgttcttcactgtggtgttatgtgtcacagtcacagagccacattgggacactctgcagaccacactaactgaagactgtggctttcccatgcgtgccctttctgttctgggaccccatccagcaaccacactgcatttgtttggttttttgagagagggtctcgctctgttacccagagtgcactggtggaatctcagcttttaatatactttgggttttggaataattttaggtttacagaaaagttgaaggcgagtacagtggcttacgcctgtaatcccaacactttgggaggccaatgcgggaggattgcttgggcccaggagtttgagaccagcctgggcaatatagtgagacccccatctctataaaaaaatacaaaaattagccgagcatagtggcacatgcctgtagctccagctacttgaggggctgaggtaggaggatcacttgatcctggaagtacaaggctgcagtgagctgtgatcccgccactgcgctccagcctagtgacaaagcaagatcctgtatctatttatttacttattttgagacagtctcactctgttgcccaggctggagtgcagtggcaccatctcggctcactgcaagcttcgccttccgggttcacgccattctcctgcctcagcctcccgagtagctgggactacaggcgactgccaccacacccggctaattttttctatttttagtagagacggggtttcactgtgttagccaggatggtctcaatttcctgacctggtgatccacctgcctcggcctcccaaagtgctgggattacaggcgtgagccaccgcgcccggccaagatcctgtatcaaaaagaaaaaaagaagtagcagacacagtgtagtccccgtggaccctgcactggcctcccttggtgtggtcactgttcttcactgtggtgttatgtgtcacagtcacagagccacattgggacactctgcagaccacactaactgaagactgtggctttcccatgcgtgccctttctgttctgggaccccatccagcaaccacactgcatttgtttggttttttgagagagggtctcgctctgttacccagagtgcactggtggaatctcagcttttaatatactttgggttttggaataattttaggtttacagaaaagttgaaggcgtgagccaccgcgcccggccaagatcctgtatc

SEQ ID NO: 237270 - DNA, 617 bp, Homo sapiens
cacagcaatgttgtgggggaaacatgtataaatagcaaacttaatcaatcccgaggatagacatagatgactttagcttcctatataatcgttccctttaaattttaggaaatgcaattttcattgccccattttctttggagaaaatcaagacttgaattcattaacatggaggaagtaatggaacagatagtcgtgatgtgaaaacttattagtaaacaagagctgcatctgaaaaaatattgtcattaaaagctatgtagtagttaattgagtttgatatgaaatttagtgctggaaagttaatgactaatgcagctatttcacagagcttggttactgcaggctccataatgatctccttctgctttggagcaacaatgaaattaacctctcttttgtcctgcaggtgttgtgttctgataatgcatattctttacaactttgggtaaattatttgctttgcatataaattaactccaaagctgaatcaatattagaataataaaaatgtagagaatatttttattccaaggaagcaaagatttatagcaaaatatatccaaatcctagatgcaatttcaggaggatagatttaaaactatttatcatactcc

SEQ ID NO: 237271 - DNA, 414 bp, Homo sapiens
gcaaatgttttatgtgtcaggttgagacgtatttaaatctctttaaaagctaaatgagtctcttgctagtttttcatttcagttatttttttttcttggggatgtttggaccttctttttgaaacgcaaacatcgaggaagatgagctctgtcttcctgttcctgtgggagtttcagcctacgtgcttgactcctagtgtaacttcctgcttttcacaaaaatataagaagttttattattatttttgataaagacaattcacatgtatgtaatggattgcatctgctttgctatacaaaatggtgtgatttctttccatttttacaatccccttagccagttgcatgtgatgctccttacattatagtttaatgcttatggaataataaaattgtttttttttcttctacctt

SEQ ID NO: 237272 - DNA, 333 bp, Homo sapiens
catagcaagaccccatctctacaaaatatttttaaaaattagccgggtgtcagccaggggcggtggctcacgcctataatcccagcactttgggatcacaaggtcaggagttcgagaccaacctggtcaacatggtgaaaccttgtctctactaaaaatacaaaaattagccaggtgtggtggcggtcgcctatagtcccagctactcgggaggctgaggcaggagaactgcttgaacccaggaggcggaggttgtagtgagccgagttggcgcgacagagtgagactccgtctcaaaaataaaataaaataaaataaaaattagctgggtgt

SEQ ID NO: 237273 - DNA, 590 bp, Homo sapiens
tttctctatgcattcattcattatttcaacaaatatttatcgggtgtttaatatgtttatagccatgtgctaagcactgaggttatactttgtcgtgactccatggttaaactccacagggacaagatccacacaaatattctgtgtgaaggacacataaatagtttgggggtacatcatgcctatgactgatatgaagaaggtgtaaacaaatgtatattgaattaaagaataccttaaatatttgtttgtaagagatatagttttaggatttgttacaatagttagaaaagggtttcatgaatatggaatgaaagcttagactgcaactgttttacaaagcgcttttaaaagtaactactaaaataatctagtaacacttttagagtcatttagaaaagaataaaataatcttagcctagctaacaggatgttccaataaaactattgtgaagtggtaggactcttgattatggtgagaatgggtcagaatggatgaatcaacacatttgtgtaaagaataatatctagaaatgatgacaatgtatatttgaaagaaaagagtattaaaaatgtctttaaattttcca

SEQ ID NO: 237274 - DNA, 360 bp, Homo sapiens
tgccatgttggccaggctggtcttgaactcctgacctcaggtgatccacctgtcttggcctcccaaagtgctggtacaaagcaagggaacaggctcaaagtgattaagcagcttgccgagggtcacacgctagtaagaggcagaactgactcataaatgagggttttaggaggcagaggaaaccatgacataggtgggtaggtatagagggaggtgtggggagatgctgctgcctcggttcctcacacctccctgttgcagcccgcacctgcccagcagcaggggccgctattccttgcctgagattcctgtgcttttttccagagccatcttgtatgggcctctgtagccttcgaccag

SEQ ID NO: 237275 - DNA, 233 bp, Homo sapiens
aggtctttgagtgcttagtagttctgctctagtagccattctattggttggtttggtggctgtctctttatatcaagccagcagttgcttttattactacaaatattccagtttcctgcaatatacctttatattttaaaagggccttctgcttatgtttatagttcttaatttttcgagtaggtttgcttttaccattgaccttgatagtaggaaaaaataactgttgaaca

SEQ ID NO: 237276 - DNA, 1764 bp, Homo sapiens
  misc_feature (747)..(747): n is a, c, g, or t
  misc_feature (1007)..(1007): n is a, c, g, or t
aaaacatgaccaggataggcatgccctcagggcagaagaaattatattctgcatgccaaagtcaaatataaatggcgtggtatatttccattttttgtgttacccagaccactgcttccttgtattttcttaaattatatagaatcattttgcacctatttcgttgttctttagtttttaaattcaccactgtgaagctgcagtatcagtttagaagagattagtataacagtctctttatatctctagaggtagcacatagtgacgcggcagtagctgctctttcctgcctgaatcatattgctgtccacctgcacactaggccctgtctttgaaagttgtctggtgtaatgaccagtaggaagtgataaaatgtaagtgacccatcagggaattataaggatgttctgggaaggtaatgatccttcatcaaaggtgtgtccagcctcttgacaagcagtagctatccagcatccccatgccagacactcccttccagaatagctgtaactgccaggtgaacagtcttggtgacttcgtccatgatgcacagagttttagagaaagtaagcccaaggctggcagatccccagtccaggttagaatcgactttataattttagaaagtcttaggttttaaaacttgatgtctgttaagaattcatttagatattacatatattgctgttgtccaactgtgtcaatgtggccaaaggccctacagcactacagcacagaaagatatcngttcataaagaaaaattgccactgctgtgattctatattaatcagacagcaataagcatgtttgttgtttaagaagatccctaccgttttttcaaagctggcctcacaaaccagagtcaaagtcataaacctggccacatgcagtggcttacgcctgtgatcccagcactttgggaggccaaggcaggaggatggcttgagcccagaagtttgagatcagcctgggcaacatagtgagacctcatctctatttaaaaatnaataaataaataaacataaacctttcagcactcaagagtagtgaggcaaaatcaagtagggaagctacaaatttgtacccaggtaaatagattaaaaaaaaaattttattttgcaatgccacctcattcttctccaaaatcaacattaagcacaaaacaaaagtttaatacacacctctaataatatacaaaatgatttgatagtaccagcacacatttagggagttatatgtgatgactcgatgaaaaatttattcccttggtacacaatttgggttgtctgcaaaataagaactgacgatatctatagcacaaaaataatattttgagtgttcactgtctgccaagcacttaacatatttaagcctcctttcatccctatgaccacattgtaaagcagggaagtaatgctatgtctactttggagataaggaaaatgaaattcccagaagcaatgtgcccaaggagaggaagaggcaggaagagctcggtgagcatgatcatggctcaggttctccatccacatgcctaagacaggggtgagtgtgaagatgggaactgactcagaattaactgtgtgatcatgggcaagttgccaagttaaccctcatatctaaattcaggtatccttgaacaaacatagacagatactgatgatccgccatgtttactataaccataaactctttgtgaattaaaaatggcctctcaacctggaaaaaatgtaaaataatattgagaatggaatccactaaac

SEQ ID NO: 237277 - DNA, 461 bp, Homo sapiens
ggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgttt

SEQ ID NO: 237278 - DNA, 718 bp, Homo sapiens
ttcctagtaacaataggaagtgtccgtagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagcacccccgacagccaccccttggggcgcgcggctgcagttagggtaagggtcccagtgcgcaggcgcgctcttgttcgcggtccccaactgacgcgcccgcggcgggaaggagagggggccgccggtgcgaggtaggcgtcctgagaggaaattggcagacgagatgagtgaggtcagaggacttcattggtggttgactaggggaggggacttttgatcaaaggggctttgtgaggtgagaattccgggggcaggttcagtgaaggggtttacggtcggagacagttgtactggggtcccatgggaagaagagtcagagttggagaaggacaagacgatgtagggggcatgagagagcaagggctttgggatgaagaccgcctcagtcagggggtttgctgttacgtgaactagaataacaggcattgccgtgtgttctgaggattgagtaacacaatgaatatagttagcacagtgcctggcacatggtaatataatactcttcatgagttgctgtcatcatcagtattaagagaggaggcag

SEQ ID NO: 237279 - DNA, 559 bp, Homo sapiens
aaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatggaaagagaattattttatgaaactttggtttcttacacatatcatatatacatattatgtactggtttgatcccataaaatgggagtttttttttttatcgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgg

SEQ ID NO: 237280 - DNA, 374 bp, Homo sapiens
tgaaagtagtatatgcttatttaaaataatggagaatatgaaaaagttagagtcttattcttgtcactcaaatacaatttttgttagcattttgttgcattttcctgtcattttctcattcgtgagtgttcagtttttataaggtatattactaattattatatacacacagttttgtatcctccctttttcgcttataggaggcatttttcatgtagttatgtaatcattcatcttctaagaggtgcttaagtaacattccttataatggacaaatcgtagtttacttgataattctactactattaaacatttcgtttcccccctagtttttaatattattagtaatggtatggtgagcatctttacgtata

SEQ ID NO: 237281 - DNA, 244 bp, Homo sapiens
agttttctgtggctgaagagctgtcagcatctgattttcccctcatcacagggctctctccactgatcacacagtcactgagttgcgtgactatagcatagttcccagcctacagtccccagagccttagtgttcctcaggatattttcagtttttgtttcttaaatttaaaccaaaacataacatttgttcatggaaggcccccaggcaattatataataaatgtagtttgttcattaaacaa

SEQ ID NO: 237282 - DNA, 624 bp, Homo sapiens
  misc_feature (21)..(21): n is a, c, g, or t
  misc_feature (493)..(493): n is a, c, g, or t
  misc_feature (556)..(556): n is a, c, g, or t
atatcagctcggtaccgtcangccacaaggactaaaggggagaatccagaacagtcactgccacacctaacagtgaccacagtgccctggggcttctgaggcagagccacctatgggaatctgagtcaggggataaccaggaggtgaccctgcccgccttaatagagaagccagccgggcatggtggctcatgcctgtcatcccagcacgttgggaggctgaggcgggtggatcacctgaggtcaggagtttgagaccagcctggccaacatggtgaaacctgtctctactaaaaatacaaaaaattagccaggcgtggtggcatgtgcctgtaatcccagctactcgggaggctgaggcacaagaattgcttgaacctgggagggggaggtttcagtgagccgagccgagattgtgtcactgcactccagcctgggcaacagagtgagactttctagaaaaagcctaacaaacagataaggtaggactcaancaactgaaacctgactttccccctgtaccttcagcccctgtgcaggtagtaacctcttgaganctctccctgaccagggaccaagcacagggcatttagagccttttagaataaaactggtgttctttaac

SEQ ID NO: 237283 - DNA, 419 bp, Homo sapiens
gtggagaatagggtctcgctatgttgcccaggcaggtctcgaactcctgggctcaagctatcctcccacctctgcctccctgagagctaggattacaggcatgcgccactgcacctggcaaaaccagaaggttctattgaacagcactgctcttggagaaatcatctgactgtctgaaaatgtaagcctgagccatggtgctaggggacctgagtttctgtccagccccatcactgactggccaggcagtcttggacaaaccacatacctctgcgcctcattctctctatgaactgtgggcagaggtgggatcaggcaatatgtgagtctccttcaagctctgaccttctggggtgaattccatgagctctgaattcagtttccagctacctccaccccagtccctctggagtgtctca

SEQ ID NO: 237284 - DNA, 492 bp, Homo sapiens
gtgacaggcggcccacgctgtcccacccagcatgtctgcacagggaaagaattgtcccagctccaggaggtcatgattctgggtccacatcttagggccctcttacctggcagccccagagttcctgtgtatttggttggctctgcgccttggcattgtgggacactcctaggcgacaggctgcaaatcccccctgcagagttgggtcatggcttggtttgtggcatctgtgccctgtagtccctgaacagtgtactataactgatgacatcagccatggagatcattttgtttaaatgccgtttaagggtgtagtctgtgggtttcaccaaataaaataattaccatcaccatttatcattgaattaagccatgtaatttagcattaattctgtagatatgtggctttgagaggctaatatttgcataccaataaagattcaatttctggtatattttaaccgccattcaataaaatctcatgttatttga

SEQ ID NO: 237285 - DNA, 658 bp, Homo sapiens
tgaatggaaatagaatgcaaatagttacttgtgaattagattctggagaaagagaagtactaagtactactgaagtatttagataatagggaaagagtagtccaattgctactaaagaactttttaaagaatagtataattttctcttcctgcttcttaggctaaagtatgtttgcaattctataataaaaaaaagaattttattttatattaaggttgatactttgctagatctgtaatgatttattagagacttaactttcattaacttatgtgctttgtgagttaggaaagtagagtaaagatgaggaactggaattttaaaagagaacttctacttactcggagctattataatttacttttacgcatgacacactgaagtactttcttcagactgaaacacttcaggtcccagaagctgtgacatactgggtcgctaagataggatttagaaaggaaatcatctgagttgtagtaatatatgatctgtatctaaaaatatacaaactttaggagatatggtataatttcctaaggaattggtccgttaagggaaaatgttttactatggaagtaaattgtgaattctcatttcttgttattttttcttttttctttttatttgtttgagatggagtcttgctctgtcacccag

SEQ ID NO: 237286 - DNA, 234 bp, Homo sapiens
gctttctgcccaagtgtcttcttcaaacactaggctaaaaatttactggttttgcaactagcaaaggttaaaaggtacctctccagactcctaattgctattcaaacaagtttccttaaatcttcttaaatttaaaatggtttaaaaatataattagagtgtttacatttccagtaaaggaagactggcttcctgctgatgagttctctaactgagatcaactataattgctgg

SEQ ID NO: 237287 - DNA, 500 bp, Homo sapiens
tgagtagctaaggtcacaggcatgagccaccaagtcaggcaagttttgtacatttttggtagaaacgcgtttcactacgtttcccaggctggtctcaacatcctgagctcgaaggatcttcctgccttggcctcccaaaatactgggattacaaggataagccaccacacctggtctacatagtacttttcaaaagggatatcaaaacgtggtggcccctgccattaaccacagcactttgggagacagaggcgagtgggtcacctaaggtgaggagttcaagagcagcctggccaacatggtgaaacctggtctctgctaaaaatacaaaagttagccaggcatggtggtgtgcacctgtagtcatagctactggggaggctgaggcatgagaatcacttaaacttgggaggtagtggttgcagtgagcaaaaatcctgccactgcactgcagcctgggtggcagagcaagtctccatctcacaaaaacaagcaaacaa

SEQ ID NO: 237288 - DNA, 484 bp, Homo sapiens
agagaaggggtctcactttgttgcccaggttggtctctcccgcctcggcctcccaaagcgctgggattacagctgtgacccaccgcgcgtggccaaatctgtctcttctcacactgctgcaccaccttcccttcaacctccttgggtcttcacccctccccatttccctgggaccctccctgcaacaaccaagggtcttaatttcacctgctgctgtcactagtaactcctaagtccacacaggactatgggcacactcatctctacctattatcctcatgacagaaccctgtgcgccccaaggatggagaccatctctacctattatcctcatgacagaaccctgtgcgccccaaggatggagaccggcagtgtccttcagactcagctgcacctccaaactctgactctgtactcccaagtacaaggctgaagctaaatctgcctcctcagagtctccacatggcctcgtgccgaatcctgc

SEQ ID NO: 237289 - DNA, 538 bp, Homo sapiens
agagaaggggtctcactttgttgcccaggttggtctctcccgcctcggcctcccaaagcgctgggattacagctgtgacccaccgcgcgtggccaaatctgtctcttctcacactgctgcaccaccttcccttcaacctccttgggtcttcacccctccccatttccctgggaccctccctgcaaccccctaggctggctttggcccttggcttcccagcatccttcccactcttttaacaaccaagggtcttaatttcacctgctgctgtcactagtaactcctaagtccacacaggactatgggcacactcatctctacctattatcctcatgacagaaccctgtgcgccccaaggatggagaccatctctacctattatcctcatgacagaaccctgtgcgccccaaggatggagaccggcagtgtccttcagactcagctgcacctccaaactctgactctgtactcccaagtacaaggctgaagctaaatctgcctcctcagagtctccacatggcctcgtgccgaatcctgc

SEQ ID NO: 237290 - DNA, 374 bp, Homo sapiens
tttaaagtggtctttttgaagaatgtttatgcaaaggaaaagaaacgaaagtgaaaaaaggaggctgcaaagcgtacgagcccactcttaggaagcatgtatagaggaatgaatgacatagctacatagaaacatgatggccatcaaccacgcccatctgtggcagggagagcaagaccctgaccccatcccctgctctcctgaggatggtagggatgccacaagcccatttagtgtttcagagggtagaggtgaggctgggaacctgggaagagcctggcgaaaggttgacggggagagggcaagagagcaggatgtttgtgttcaccaatgacagtggccatggtcccatggtaggtcagtggcccagaaag

SEQ ID NO: 237291 - DNA, 408 bp, Homo sapiens
tgaactgatagtgaactgtgaccatgggcatacagctagttgaatttttttgcacataagcacatatgcatgtatgtgtgtatatgtgtgtgtgttttctaattatagtccaaaatccaaaatgaaaattgtatgtttccaggggttttagaaggagctggagagtagtatggagtccagggtatgtgtagcccattactaggcagcaaggatatttgtctggcaggtatggatgacccctcagcccccatgcagtggagcacctgttggtgaggatggcagctgtttgcttcagttaacagctcctcccctggtttactgccagggccaggccacttcacctgatacttctcaccatccttgattaagccttctgcattcatcagtatattataggtaacctctttc

SEQ ID NO: 237292 - DNA, 513 bp, Homo sapiens
gggcgcctggagaaaacactcctatacgccgctctgcattcgtagatggtctcctgggtagtaaaggtcttagcgagcgcaatgatgaacagggaggactcgaggttcagctgggccagggtttaggcaatgtgagttcagctcttctgagtttttgcacataagcacatatgcatgtatgtgtgtatatgtgtgtgtgttttctaattatagtccaaaatccaaaatgaaaattgtatgtttccaggggttttagaaggagctggagagtagtatggagtccagggtatgtgtagcccattactaggcagcaaggatatttgtctggcaggtatggatgacccctcagcccccatgcagtggagcacctgttggtgaggatggcagctgtttgcttcagttaacagctcctcccctggtttactgccagggccaggccacttcacctgatacttctcaccatccttgattaagccttctgcattcatcagtatattataggtaacctctttc

SEQ ID NO: 237293 - DNA, 2111 bp, Homo sapiens
  misc_feature (435)..(435): n is a, c, g, or t
  misc_feature (1165)..(1165): n is a, c, g, or t
  misc_feature (1168)..(1168): n is a, c, g, or t
  misc_feature (1177)..(1177): n is a, c, g, or t
  misc_feature (1182)..(1183): n is a, c, g, or t
  misc_feature (1189)..(1189): n is a, c, g, or t
  misc_feature (1191)..(1191): n is a, c, g, or t
  misc_feature (1199)..(1199): n is a, c, g, or t
  misc_feature (1207)..(1207): n is a, c, g, or t
  misc_feature (1212)..(1212): n is a, c, g, or t
  misc_feature (1221)..(1222): n is a, c, g, or t
  misc_feature (1228)..(1229): n is a, c, g, or t
  misc_feature (1237)..(1237): n is a, c, g, or t
  misc_feature (1243)..(1243): n is a, c, g, or t
  misc_feature (1270)..(1270): n is a, c, g, or t
tgacaggtaaacagaagtaactatcatttggggttgtcaagatatgggtagtagatacctaattccatgaatgccttctctgtgcaagtgctggaaagtaacctcagacttccagactcatcactgagattctttttcttaagcaaaatagtgacgctctgcaggatttctataactgaagttctctaaaagataaatttatattgcattaagagggtagagggtagtatttagagctatgctctcttaaaaagagtaaagatttcatgtatatgaaggaacagaaagcatggggataagttttatacaccctagagtggacttttatgataaaaagtaatttacttgttaatcaatttaattcagcaatgggaaaagatctttctcttctttctgaaatcttacacagtgaagggatgaaaatggttatactantggtaatcagagatgttcctattttgttttgatgtgtagattccgtagtacctagtgttgttggatattaagaaaaattctaatccctgttcttgtgggaattgcacaaggagcaatgtaaacacaggtagtggaggtagagatgtgctgtcgtctacttctgctctaacttgagcagccacatctcactcagggtcatcccataggatgtccaggctgtggttggagagaagtggggggatgaagacgtggggtgcaataatgggaggaggatgggctttgggaccagaaggttgtgaatttgagttctggtccatcttcttggcagctgggtcgattagggtggtgaattagctggctgaattacttcacacatcagagcctcactttcctggtttgtaaaatgcagattgtgcccctctcccagggctgccatgagggttagggaggccaggaattaaaacatgtaaaccatgcattacactgcatttcaacccctgcaagggtgatgcagctagctttacctgattttacttggattgtttcttttttttttttgagacggagtctcgctctgtcacccaggctggagtgcagtggtgtgatctcggttcactgcaagctccaccttccgggttcacgccattctcccgcctcagcctcccaagtagctgggactacaggtgcccgccaccatgcctggctaattttttgtatttttagtagaganggngtttcaccntgttnnccaggntngtctcganctcctganctcangatccgccnncctcgnnctcccaangtgctnggattacaggcgtgagccaccgcgccnggccttttctttggtggtaatttcctgatctgttgaaaggccaaaagtacactgtggattttagaagtgatgtcttttttttagtgatgagggtttttggtggtggtgtttgttttttgagaaagggtcttgctctgtcacccaggctgaaatgcaggggcacgatcttggctcactgcatccttcactttcttgggctcaggtgatcctcccacctcagcttcctatgagtggctgggactgtaggagtgtgccaccacacgtggctaattttaaaatttttctgtagagatgaggtcctcactgtattgcccaggctggtcttgaactcccggactcgagtgtttcttctgccttagcctcccaaagtgctgagattacaggcatgagctactactgcacctggccttttttttttttttctttttttaaaaagacatttgtggtgagtaagaattgctttggggtttatgcccacctgttcctcagagctggctatgggtgatcttatgagtgagttgtcactaatgtttgtatcgggactggaattctcagatggttgcaagtcatttgaggtcccagaagtccagcatagagatagggagattgtgggcagatctcttgagcctaggagttcaagacaagccttggcaacatagtgaaaccctgtctccaccaaaaaatacaaaatttagccaggcgtggtagtgtgtgcctgtagttccagctacctgggaggctgaggtggaaggattgtttgagcctggaaggttgaggctgcactgagccaagatcatgccactgcactccagcctaggtgacagagtgagaccctgctaag

SEQ ID NO: 237294 - DNA, 313 bp, Homo sapiens
aaagggggaggggggggtaaatcatgttaatgttgttaaggatctaacccatgcattgctaactttttccagatcgagggctcagatgcacatcagtatctataggcacacagaaattattgcacagcgctgttcacagacagatgtgcttcttgaagactctattactgtgagactcgaagaagtttcttaatgtctgagcctcagttccattatctgtagcctgttagtgatccatattgtacaggggtgttatatacaataccagttgagaagatgcatataaagtgctttaaaaataaatgatatagaa

SEQ ID NO: 237295 - DNA, 371 bp, Homo sapiens
gacaaaagcagatggcacaggtgatgcacttggctccatgcctgacgctgagtgaaccctcaatagtcgccttggaattctcacaagctacgattagagtccgctgcccccctccctgcttcccaagagaatcttcttttctgacctgacccactgggatttggatccagcatcatctgatccccggatccaattgctagagggtatgcgggctggcctagcactctgggaaagccactgggcggtaatgagggaaatgaagatgctgctgccctgtgacccaggaatcccacttctgggtatatttcccagacctgggaccacaaagggttgtggcagacattgtcagtaataaattatttgcactcaaa

SEQ ID NO: 237296 - DNA, 311 bp, Homo sapiens
tgctaaattagaatttattttaatttttttggacatggccttgctctatcacccagactggcattcagtggcacaaacatggcttattgcagcctcagcctcctgggctcaagtaatcctcctacctcagaccagcctgggcaacatcaggagatcccctatctaccaaaattaaacaaacaaaaaaacccaaaaacaattagccaggcgtggtggtgcatgtctgtagtcccagtttctcaggaggctgagatgagaggataacttgagcccaagaggtccaggtttcaatgagtcatgtttgtatcact

SEQ ID NO: 237297 - DNA, 428 bp, Homo sapiens
aaggttccccatgttgccatggcgggggtggggggcaatacggggccgccaagactggttgaggggcaggtcataagtctagggtttcccctggggccggtccaggattctcacccttttgggggaacctcagggcaaaatgttgaagtgggggaggagaagccagcaccctgcgcgcctgcggggtctccccgcggagaaccggggaaggagaaccgggaggcgggaagtggggaccccggggtaggtgaaggagcgaggaggtcgccgtgtggccggggccgggccccatccccgcgggcctcagtttcccccctgtactgtggggggccggtgggctgccgggaccgctgggggctcgcagcgggtcgggggaggccacgtctccctcgcggcgcgctgggagcagggagggggcgcggcggccg

SEQ ID NO: 237298 - DNA, 175 bp, Homo sapiens
cccgtgataccagcaagcctcccaatggccagatcccagtatgccatgtccctgtgtgaccccctggccccagtgtgtgccaaccaagatgtctccttggtgacaaagaaaaggggccttatgacataagacgacacagggaagaaaatttgggcaattaagaatgtgtagattg

SEQ ID NO: 237299 - DNA, 1799 bp, Homo sapiens
ctgtcagttcatcaaactcatcctccgtccagttttgtttccttgctggctaggagttgtgatcctttggaggagaagaggcgtttttcagcctttttcagctggtttctctccgtcttcatggatttatctacctttggtctttgatgttggtgacctttggatggggttttggtatggatgtcctttttgttgatgttgacactgttcttttctgtttgttagttttcccttttctgtttgttagttttccttctaacagtcaggcccctctgctacaggtctgctggaggtccactccagaccctgtttgcatgggtatcaccagcagaggctgcagaacagcaaagattgctgcctgttcctttctctggaagctttgtcccagaggggcacccgccagatgccagctggagctctcctgtgtgaggtcctgactgtcccccagtcaggaggcacgggggtcagggacccacttgagggggcagtctgtcccttagcagagctcaagctctgtgcggggagatccactgctctattcagagccagcaggcaggaatgtttaagtctgctgaagctgcacccacagccaccccttcccccaggtgttctgtcccagggagatgggagttttatctgtaagcccctgactggggctgctgcctttctttcagagatgccctgcccagagaggaggaatctagagatgcagtctggctacagcggctttctctggctgcagtgggctccacccagttcgaacttcctggcagctttgtttatgctgtgaggggaaaactgcttattcacgcttcagtaatgacagatgcccctctcccaaccaagctcgagtgtcccgggtggacttcagactgctgtgctggctgcaagaatttcaagtcagtggatcttagcttgctgggttccttgggggtgggatccattgaggtagaccacttggctccctggcttcagccccgtttccaggggaatgaacggttctgtcttgctggcattccaggcaccactggggtatgaaaagaaacccctgaagctagctcgatgtctgcccaaacggctgcccagttttgtgcaggaaaccagggccctggtggcataggcaccagaaggaatctcctgttctgagggttgtgaagactgtgggaaaagtgtagtatctcggctggaatgcatagcccctcacagcttcccttggctaggggagggagttccctggctccttgtacttcccggatgaggcgacgcccaaccctgcttctgctcgccctccgtggtctgcacccactgtctaaccagtcctaatgagatgagctaggtacctcagttggagatgcagaaatcacccaccttctgcattgatcttgctgggagctgcagaccagagctgttcctattcagccatcttgccagccctttgacttgctatatttttcatgccgactgtccctgtgcagacaggatacattcttgttcactcttccctgttgataggaggttttgtaggttttgtgtgcagtgtttctattcctgctgatttcttagttgaaaactggtgtaatacctcaagggatgtagacaaatactcaaggttattttataataaactgtgatgtactaaaatatttaaatgtagttttaagaaaaatgaatgcaggttgagcatccccaatctgaaaatccaaaatcctaaatgcttcaaaatctgaaacttgatgagcacccaaatgccgctcaaaggcaatgctcattataagtataatgaaactattccaaaattt

SEQ ID NO: 237300 - DNA, 488 bp, Homo sapiens
ttaaagacaggggacttgctctgtcacccaagctggactggagtgacgcaaccatagctcactgtaactttgaactcctgggctcaagtgatctcctgcttcagcctcccaagtggctggaactacaggcacatgccaccacactggctctcattctctttcattctgatgtctcctctatgcatctcaaatgttgcctctcttcccacattcaacttcccctcagaggaagaatatgataaggtcatttagtccctattctatatggagagtccctattaggtgtctttttcctcaggtacctaatcctcactcattcatcctggccaaggtcaaaactcataatccacaatccataaagaacttcccatttttctcaaaaggggagagagggaagaaccagaaagattaacagaagcatagaattatattgtttattggcacatttaggataatttagtgtctaattacctttaagaaaaagacaa

SEQ ID NO: 237301 - DNA, 434 bp, Homo sapiens
ttaaagacaggggacttgctctgtcacccaagctggactggagtgacgcaaccatagctcactgtaactttgaactcctgggctcaagtgatctcctgcttcagcctcccaagtggctggaactacaggcacatgccaccacactggctctcattctctttcattctgatgtctcctctatgcatctcaaatgttgcctctcttcccacattcaacttcccctcagaggaagaatattcctcaggtacctaatcctcactcattcatcctggccaaggtcaaaactcataatccacaatccataaagaacttcccatttttctcaaaaggggagagagggaagaaccagaaagattaacagaagcatagaattatattgtttattggcacatttaggataatttagtgtctaattacctttaagaaaaagacaa

SEQ ID NO: 237302 - DNA, 411 bp, Homo sapiens
ccaaactataacagggaaaaacatttgctgagccagcgaattatgctgctgctttaaaaaaaaaaaaaaaagagagagagaagcttttttttccttttgttttgcttcttgcagtgatgaggtgctagcttagcccacacagtgtgacctttgttagaaaagtcacctgctgttacaagttactctggtctcctgttgttacagacttacacgtcgattgtgttctatgtttataacttgaattcatatgggatttcacaggaccactgctcttttcttgttaatttaaggaaatagaaaaatagacttcctatctgagggaaatcagacctcatttttattgtcactgaagtcgtacttcctggaagacctatgcatccccagaattttttgaggatcgaatataaaatc

SEQ ID NO: 237303 - DNA, 370 bp, Homo sapiens
tgtgttccaaagtgactgtatgttctcaccagcaaagtatgacagttccaactgttccacattttgaccagctcttggtatcattggctttttatttttcacacctttttttttttgagacaagatctcactctgtagcgcaggttggagtgtagttgtgcaatcatgactcactatagcctcaacctccctgggctcaggtgatcctcccactgagtagctggaactgcaggcacaccaccatgcccagttaattgttttatgttttgtagagactgggtttcctatgttgtccaggctggtctcgaactcctgggctcaagcaatcctcctacctcagcctcccaaagagctgggattacaggcatga

SEQ ID NO: 237304 - DNA, 229 bp, Homo sapiens
actcaagcacttactatctgacagacactgttgtaagttattccaggtatgaatttatttttttacaactagtggcctccaagagctctgaggcctacagtttggaaattattatacctcctttccagataaggaaactgaggttataggtaggagacaacaatcctgattctgggacccaaactttttcctaaaatcctattgagcttggagtccacaccccaggaac

SEQ ID NO: 237305 - DNA, 798 bp, Homo sapiens
cggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaaaatacccctatcagccaatcacaactgaccttcactactattacatccttggagctgtcgaataataggccctctgatgattactcagttcacctgattatcacacaatcaaccgacttttggcattcatgttccttgaaacacct

SEQ ID NO: 237306 - DNA, 1037 bp, Homo sapiens
cggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtaagttgctgtttttctttttgaaagaaaagacctaagtactcatgccaaccctgaggtgaaaaataaaagatctgtgcaggcttcagcagcccttaaaaagctgcaatctggtgggaaaatagttcaggaaaaacacaggaaacagtagtttgtaagaatttgtgacttcccctttggatacagtaaataaatttcacttcttaatggagtttctacaaagtaagcatattataaaaggatctacaatggtctttttaatcagtcatctttgaaatacagcattaaaagttgttacttttatagatgtgggtagtttgaattttagtaaaggcaaaggcaacttaggttcttcctactaataaaaactgagatattaggatatattatcagagggtcgtgacaatcttctgtattcctggagatttaagaaatggctctattatatttctgggtgagtttaatgaagcattgcttgaag

SEQ ID NO: 237307 - DNA, 428 bp, Homo sapiens
gttaagtgagcacgtaagcagacatgttgagaatgagaaccaggcttcttactgtctgggaaaaaattcacaaatttggaaggagagaggctggaaagaaacctgaagaactggagtagaattagatttcttggtaggaagtcatgggttttcaaatatataggtagataaagaagtagtgattgtgtgtttatataaacacgtgtgctctgtgtatacagttgacccttgaactatgttggggttagcacccctgcgctattggatgtctgcgtgtaactttgacttcccccataatttgactactaatcgccaactgttgatcagaagcctcacccataacagaaatagctgattaccacacattttgtgtgttctatgtatgataaactgtgttcttacaataaagtaagctagagaaaagaaaa

SEQ ID NO: 237308 - DNA, 460 bp, Homo sapiens
caaagatgttcaaatatgtgaatgtgttcaaacaatgcaagcattcactcctatttaaatctgggcgagggttcttccaggtttttctcattccactaagaacatgatacccaattaatggctagaaagcagctatgtagtcaaagaggatgcccattcttagatatcaaagactcctcaaaatagaataaaacacaatggaaagcatcgtctttccaaacctctctgacttcatattcgcaattatcaagagtcaagttaaaaaaacaaactgaaaatatgcaaaattgaaagtcagagtaaattcataatgtgttgtggtgctgcctgtggacttctattgtcattattgtttggatgaatggtgaacagaaatgtaaaataatatgctattaagggcaaataatttttgcctgaatacattaatttggaaaataaaaatatgcatgtttcaacttgt

SEQ ID NO: 237309 - DNA, 374 bp, Homo sapiens
tctctctctctctctctctctctctctctctctctcctcgtgccgaattcggcacgagctcttccatatctcccaagggcccaatagcaatgcacttctgtgtctgacggtgctcctaccttggtccatgctgatccacaactgcagctccagaaatggcttgtaagcacatataaccagtgagccatacattacagggcacttcaaacagcccagtgatttttcagtctaatatttcccaggccatttttttcctcatctggaaaatgcagttactgatgtctgggtttaaatagctaagtagatttgtaaaatttaaaaaattaaaataattttaaagattattaattgtaagatgatataatacaaccatc

SEQ ID NO: 237310 - DNA, 440 bp, Homo sapiens
ttaagagaaagggaattagttaagaggtagcagggcaggcaaacaggcagagaactgacacatttattactttctttgttccaggcactttatatgccatggcaactaatcttaattaacctcaagttatagatgaagacatatatttgcctaaggtcacacagtaagcagcagtgccaggaagtttaggattgccttatttttaaaaaaacaatgtcttatattttcacataaattacttattggaatccctcaaagtctagtgcagactaaatttagggtatatatccaaagaaagtgaaattactattttaaaagcaacatgtgcactcccatgttctttgcagcaatattcacaatagccaagctatgtgcactacttttgttgagtaattcattacagattaaatgtatctgatattaaaaataaagaacagaaa

SEQ ID NO: 237311 - DNA, 367 bp, Homo sapiens
agcttttaatttcccctgggaaggatgaatgttttaaaaatgtattaatatttatttatttatttttataataaatgttattttgtagagcagttctagtttacataaaattaagcaaaaacaggccaggcatggtggctcatgcctgtaatctcaacaattttggaggccaaggtgggtggatcacttgagattaggagttcaagaccagcctgggcaacatggtgaaaccccatctctactaaaaatataaaaattagctgggtgtggtggcacatgcttgtaatcccagctgcttgggaggctgacgtgggagaattgcttgaacccaggaggtggaggttgcagtgagtcaagatcgtgccac

SEQ ID NO: 237312 - DNA, 2053 bp, Homo sapiens
  misc_feature (1301)..(1301): n is a, c, g, or t
  misc_feature (1367)..(1367): n is a, c, g, or t
tgtcttcatgcttgttgcttcagtaacaaaatagctgctgaggctgcaggcatcacaccacattcaaggcaagaaaaaggaagaagtgagaatggtgccagccacatcatcttctcttaccaggaaaggcaaaagtcttcctagatctcccagcaggtttctgcttatatgtcatttgctagaactgtgtgccatgaacaccctggatacaagcaaaaacctggaaaagcacatattttgcctgggtctgggctcattgccatcctgagagaaagcagacttctggtagcaaagaaggtggaaataggtattgggaaggaagctaacggtgtctgctacaacacagcttaataaatagtagttttatatgcataataaatagtagctactccttggcataaagtaaaaataatgataacaaaaatacttacataattatattgtgtaagtgcttactatgtgccaggaactgttctgaatgttttaaatatgttaactcatttaatcttcacagcaattttgtgaggtaaatgttactatccttggtttttttttttttcagtgtttttaattctactttatatacatacaattagattgatcataatccctggttcatgacataccctcattggtccatgcatggctctcttttgtttactttttaaatattagttattgtaaataatatatagacaccttcaaatcccctgtccaaaataaaattagtgtctggtcagcaatttgcatctggctgtatggtacccccaacacattttacttcctcccctggccaaggtgatcatcatccagaattctgagctcattatccttcactttgcttttcatacagttttagagttttcttgcatctatataaagtcctaaaaatatgtgtgtgtagtgtgtgtgtatatatatagagaaagatggttgtttttaactgtatgtctttagtacttttttcacttgatattacattgttaagattctaccatattgttgtatgttgctacagttgttccttttgactcctgtttaacactcccattgtgcaaatatgtagcagtttattcatcctgaaaccattctttactgaagtgcctataacattcttattgattttctcttttctggttattaactggtctaattctgttacattcaagctttgcatatgattctagcagttttccaatatcctttttaatgtctgcatgaagtcctgaatcttctgcaagacttgcaataatttcttgcaaacgacttgccttgtgttgtgtgttgtcagatatttacantgggctaccagagagaggctgaccaataaagattttgacttgatggggtcttggtgcacacagagngcccttcatttcagcaaggaggaatgttgcaggactgagggaggcagagaatgtcaattcacttgtgaatattttcttgtcatgatgacttttgtttccctgggcaacctggcaaatgcgggaactttgattgtgaacactcagatactcagaagtccctacatcttggcaaattctttaacacttctcccacaaaaggtagaatctaattcctctccccttgaatatggccttggtgactcacttctaaagaatagtgtccaggaaacgtgttgctatgggacttctgaggctagaataagaaaaggtgatacagcttccatctggcttgctctttttgggacactcattctggagaagccagtcatcaggctgtgaaggagcccaaaggagcccacacagagagaccatggagaagcccacatggatgggcactgaggcctccaactgacagccaagagcaatcgccaggcatctgagtgagtctcctaggagaggctacaaagtttgaggagaagtagcaagtcatcctggacatgccctgtctaaattccccacaatgtacaaaattaagctaactgtgctctgtctgaaggcctcacccacagaatccattcacataataaatggttatcttatgctactaagttttggggtaatttgttatagaaattaataaaattagt

SEQ ID NO: 237313 - DNA, 208 bp, Homo sapiens
gaaggctcattcctagagttgtctgatttggccatccggcagggtcccacagtgctaggaagtcttgttcctggagtcctctcatttgacggtaatagttttaagtattagcgatttgaaaatggggggagacacagcctgacctgatgtactagccaattctttaaggggtaaaatggagtcaggcttatggtttagacaaaaaaaa

SEQ ID NO: 237314 - DNA, 264 bp, Homo sapiens
agacaagcaactgggtggcactgcagagcctggggattctgatcctcagctgcagctcttactaccactaattcagcatggatgagtggttttctgtggaatcagcagggatgctgggcaaatgccacacacttactttccacttaaaagatgttgccacaggggccaagtgaaatctctgttctgattgacacaggatggacaggtggaggtgaccatccatcagtgtcaggaaggacctgaagcacctggctagtcaggtga

SEQ ID NO: 237315 - DNA, 1753 bp, Homo sapiens
  misc_feature (944)..(944): n is a, c, g, or t
gtgtgctccacttaaatgagaaaagcaacgagcaataagcccagggtgaagatttggttacataccctgcttctcaggttttgcttaagtttagcgcccaccaggaagaaagaaaacgattatctgcctccttgacttttgcatcatttgtctttcttctgatgaaagtgggactaatcactgagttagggtttccttatttttagtctacaccatgttgctttatcctaaaaggataaatatgggctgtgtgatggttgaccacctttcttcttccttctatgaaggtctgaaagggcacaagacaggtaaaaaggaaacagcttttctttagtaactaagttgctagatttttgatctcatggccctgagctacacgtgaatgactttgacctgtaatctgaaataagatagacttcagagttcacctctcccaccatttcactccaaaggtgagataaggtagagttgctaaaggtacagtatgaagggcatgtggcattttagtgttgacagtatgccagctctaagacctgcttcttccatctccaaccattcctggactctgcaggtgacacgagccactgtgctcctggatgcttcagaacctgtgcagatctctgtcttcactcctactatggcatctcctagcatgttctacactgagctccactgggccttgcatgtcagtatcccgaattctgaatgaagcttggaacatgggaggtgcatccactaacaacatgaagaatgaagacatgtattgactacctttgacaaaagtatgtcaaaagcaatacatcttactagtggagcgaagacactgcatgctgacaaaggtgatctcagatgtgaggtcgatggtgcgccatgcaatcagcttgctgagtgagcctacttatgccccatcccgggggcctagggtaagaaaagtgccaagcgangctgaggatcagactaaagctggaaggtgtcaaggcacaggctgagtcatcagaacaccttccctgaattgtgtcaaacaagtgtacatgtgctcaagtgtatctggattctgatttggctgcacagtcactgttttccagatgtttgcagaagaaatatgagctggaggagactcactgaaagctggaactagaaggatgcacactgctcatccaagccaattcacttattttaccaatgataaaactgagtctcagagaagtcatacgcttgcccaaagacacagcttgtggtggaggagtcaacaccagaactctggtccaggactgcaaaaaaacacttaacatgtgctaataatgaggataaaagatacttcaaattctgggagttctataatgtttgagcacatataccattgaatccttttaataacccatcgcttacacagatgaggaaaccaaggctcatagaaataaagtgctttgccaaaaggcacaaaactggtcagtaataaatctgatctccaggttcccagtccagaactttctgcagcactatctttttgttccctttaactaccagaagctttaacccaaaatgaggcttcaactataaaagctatttaagaccttatggctgcgtatctctgccctaagttttctcttgatccttattttatattctaatgtttaaaacttgttccccaaatttttaaagtttgcattcattttatttcaataagccacgccaaaatctgtgtgtcataagctatctatacgtaaataaatgaacgaatgaatgagcaaac

SEQ ID NO: 237316 - DNA, 372 bp, Homo sapiens
caggttgcaatgaggaggaggttgcagtgaggaggaggttgtagtgaggagcaggttgcagtgaggaggaggttgcagtgaggaggaggtcgcagtaaggaggaggttgcagtgaggaggaggtcgcagtgaggaggaggttgcagtgaggaggaggttgtagtgaggagcaggttgcaatgagtaggaggttgcagtgaggaggaggttgcagtgaggaggaggtcgcagtgaggaggtcgcagtgagaaggaggttgcactgaggaggaggttgtagtgaggaggaggttgcggtgaggaggaggttgcagtgagccgagattgtgtccctggactccagactgggcaatagagcgagactatgtctcca

SEQ ID NO: 237317 - DNA, 213 bp, Homo sapiens
gagctggggttcacttctatttctcttttgtctattttgtttcaatattttcatcagctattagattcatcaagcccaacacttatgacttttttttccttatagctatttttattcagcaactatcctaccttgaatttatgatcttgcttacttatttccaagtggaaaactgacttcatgatcacccataccctactgaacgtcagtatc

SEQ ID NO: 237318 - DNA, 437 bp, Homo sapiens
gggagccagtcagagcacgactgaaaattgaagagtctgtgccgtaactcactaaatgctctgtctgcagttagtttatctgttagtgtagcagaattgttactcaagcagcatgataaagatctgcgggagcatgcaaaaacgtaaacagtgttgggcgcggtggctcacgcctgtaatcccagcactttgggaagccgagacgggcggatcaccgaaggttaggagttcgagaccagcctggccagcatggtgaaaccccgtctctacgaaaaatacacaaaatactgggcgtggtggcgggcgcctgtaatcccagctactagggaggctgaggcaggagaatcacttgaacccaggaggtggaggttgcagtgagctgagatcgcacctttgcactccgcctgggcaacaagagcaaaactccatctcaaaaa

SEQ ID NO: 237319 - DNA, 4255 bp, Homo sapiens
  misc_feature (172)..(172): n is a, c, g, or t
  misc_feature (224)..(224): n is a, c, g, or t
  misc_feature (1087)..(1087): n is a, c, g, or t
  misc_feature (2031)..(2031): n is a, c, g, or t
  misc_feature (2475)..(2475): n is a, c, g, or t
  misc_feature (2670)..(2670): n is a, c, g, or t
  misc_feature (2687)..(2688): n is a, c, g, or t
  misc_feature (2692)..(2693): n is a, c, g, or t
  misc_feature (2695)..(2696): n is a, c, g, or t
  misc_feature (2699)..(2705): n is a, c, g, or t
  misc_feature (2707)..(2708): n is a, c, g, or t
  misc_feature (2711)..(2712): n is a, c, g, or t
  misc_feature (2715)..(2716): n is a, c, g, or t
  misc_feature (2719)..(2720): n is a, c, g, or t
  misc_feature (2723)..(2725): n is a, c, g, or t
  misc_feature (2729)..(2729): n is a, c, g, or t
  misc_feature (2731)..(2732): n is a, c, g, or t
  misc_feature (3410)..(3410): n is a, c, g, or t
  misc_feature (3638)..(3638): n is a, c, g, or t
  misc_feature (4174)..(4174): n is a, c, g, or t
ccaaaatggatgccccattatcaactaagacagaaaggtgaaggaaacagagttacctacaggttgaaggttcagggcctgtcggggcaaatcctctaagttcctatggccaaactccctaccaataggagctacagctctgagtcacaacccagaccactgcaactctgantggccagaggaccagccttgaaaacactctttcctgataagcagctgtagancttgagcccatttcggcagctcatagaggctgcatacagactgtctttgtgtcccatagctgaccttttgatgtaaagagccaaatgccattttcttttcatggtaaaaaccccaccccaaagtgaacatgggatgtatggtacatgtatgtttacctattgcacatgtgctcagctccccttataaatatgtatagctttccccccaaacctgctgatatgtatgactctgttgtgtgatacagacctggtgaggcataaaagccaacctgtccttctttctgaagagagagcaccttcagtccatgctggagactcttcccagcttgcaaaccgataacccccataaagctctcctttctactgtccagccatcctggtggtcttttagacaacaccatcttctatccattccatgtgtcagtgctgcattaatttttataaacattggctcctgacacaccactcatctgttcagaatccttcagtgattcctgtcgaatccagaacaaagcccaaacctcaagatccctctattctgtgccttcacagtgtggctctagtctacggcaagcttatttcccagcattctcttacaagtgtttgaagtgccaggcagacaaagtatttgccatttgccacacacgcccagcactgcattccttgtgcttttggtgctgtctggcccatgcacagtggagctctccaggaaaacccctgccagtttggaatgctctaggtctacacagtccctgcagagcctctagtcgcaggggtctactgagtattttcagtgtggttattgtgactgagagattgacttctgaggtttatttcatttgtattaatttaaattgaaatgnccacatgtgactaatggcttttgtctgggacattgcagggacagcacctccttgccttcctccttatgcctgcttaaccagggcccttcatttaatactaattgaaaattccaccctttctaagaaggaaacccgacctgattattcaactggctattttatctccctcatcagcatcctctctgtatgtcacttgccatattctgtcctttagtataagttttagcccttcctcatttatagtaagtcagtcagagaatcagaaggccttggctcttcccatgcccattgcaacatctctgagccccagattcgtcatctgttaagcatagggaatgatgcactaatacccttctgtgtcacgggattactgtaaggattacagaataaattgagcatctgttgtgcctgtttccacttctgcaaactcaccttctcagccattcctgtgcacaaccaccaggctgtgggtccttccaggtaggcccagtagaagcaattggtcaagaacctttccctaaatctggccacagggacggcctctctgttgtcagagatggtggagtttgcaccttgccttgaattccttcaattctgtaggtcatgaattatctgtttctgctggaaatagcagcaattcctaaactagaattgctgtaactttaacacaaaactagaagtcaaagaggagattggcagtgtggcctgtgatgattcccatccagacactgccaggcttcacgccactacccccagcacatcagccaagaaaggaggcactaacgaatactgagctatcagcagcaggagaaaggccttctacagactcctcaacaccagctcctccaggaaagatggttccctggctgccctggtgaacctggaggttttctctgcctgaaaacctcagttcccctctgtaaaaagttcaaccaaagagctcnatttgtcatgttcacaaattagcccaaagataggctttttaatcccttctcagcacaatttaacccaacatttagtgctgtacttactgtatctatgacactaataatccaaagatagttataattcacttgtcctcaaagaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaacccttnccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattctttttnttttctttttttttttnnggtnngnnttnnnnnnntnngtnngtnngtnngtnnngttntnngagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccaccccacccggcccgatttcgttttttatggctatgtagaaaatgtgtatataccatattttctttatccagcctaccattgatggacacctgggttgattccatgtctttgctgaggaagcattttaaatggcaggagtgagacagtaaccacttcagcagcataaggaagggaaagcacaggaaggggaggaaatggcaagatggagaaagagctagtggcctgcctgatgcagctgatgagggaagaactctgaggccgggaagctaactgcaggcttgttgatgaggatttgaaatgtgtttctaggaaggaaggagaggtagcaagtgggcagtgtgtgtgtttgtttgttcactttaatggaaggcattgaggtagtgaatcgtgttctaattggtattgaaaancaatcttggtgaccattaagaaaaggctgagaaaggctatggaagagtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggagaacttgagaatgaaccagggtttctaccactgtganttgggttgctataaaggatattaaccaagaatgggtatctctttccagcccacccccacacccccaaataaaagtaggtgtaaggagaggcaatgtgtttcatcttggacatgctgagtttaagaagctgaatgagcaataatgtggtgctttccaggaagctcaagagagagatgtgagctgaagacacagaaacaaactatgaaatattagcgtccccctttattcacaagcatctactgtgtgttaggctttggctgcactgaggatatcaagatgaaaagacatggcacaaactatgggacaaaaaggcaaacaaaaaagagtataatgcggctgggcgcagtggctcacacctgtaatcccagcactttgggaggccgaggcaggtggactgcctgaggtcaggagtttgagtccagcctggccaacatggtgaaaccccatctctactaaaaccacaaaaaattagctgggcgtggtggcgggtgcctgtaatcccagctacttgggaggctgaggcaggagaatcgctngaacccaggaggcggaggttgcagtgagcctagatcgcaccattgcactccagcctgggtgacagagtgagattccgtctt

SEQ ID NO: 237320 - DNA, 809 bp, Homo sapiens
aaatcaaatgctctcatgcttccctgaatggacacacacagagtctcttcacctgaggaataaagtgtaagatcttcagaacttttattcaggggagaaaggcccaggtagctgctgctgttcagcttaaggctaatctgaccttctataacaggagttcaagtcccagaaatccctggtcctccatcagaggcttcactcattacaggagaagagagtctgggttgctccctcatcaatcaagtgcagagtccaggaagggagaggcgggcagtaacgtgcatggagctgtcacctcctatgacaacaacaccttctggaatacctcctgaaggacacgcctgaggatgttttacagttaactttttaaaaaatacataagtagaaagagaacactctaaaataaaaataaaaggtatagtataataaacacaataacaaagtcacttattactatcaagcattgtatgctgtacataattgtatgtgctatgcttttatatgactaacagtgcaatagatttgtttacaccaccatcactaagggcatgcaagtaatgtgttgtgctacaacatactacaactatgatgccactaggtaacagaaaatgttcagctccattataatcttatgggaccaccttcctagatgcagtctgtcattgatggaaacgttgttacacagcacatgactatagactaatagccatagatttataatatgggaggatgtactatatatgcattgaaaagagctctggaaggataccaatacattaccagaggttgcttctgggccttagggtatg

SEQ ID NO: 237321 - DNA, 741 bp, Homo sapiens
aaatcaaatgctctcatgcttccctgaatggacacacacagagtctcttcacctgaggaataaagtgtaagatcttcagaacttttattcaggggagaaaggcccaggtagctgctgctgttcagcttaaggctaatctgaccttctataacaggagttcaagtcccagaaatccctggtcctccatcagagggagaggcgggcagtaacgtgcatggagctgtcacctcctatgacaacaacaccttctggaatacctcctgaaggacacgcctgaggatgttttacagttaactttttaaaaaatacataagtagaaagagaacactctaaaataaaaataaaaggtatagtataataaacacaataacaaagtcacttattactatcaagcattgtatgctgtacataattgtatgtgctatgcttttatatgactaacagtgcaatagatttgtttacaccaccatcactaagggcatgcaagtaatgtgttgtgctacaacatactacaactatgatgccactaggtaacagaaaatgttcagctccattataatcttatgggaccaccttcctagatgcagtctgtcattgatggaaacgttgttacacagcacatgactatagactaatagccatagatttataatatgggaggatgtactatatatgcattgaaaagagctctggaaggataccaatacattaccagaggttgcttctgggccttagggtatg

SEQ ID NO: 237322 - DNA, 430 bp, Homo sapiens
agaaacaaacaaaaactaaattgtattgtcagatggagatgaagtgccaggaagaaaaaaaaagcctcttaagagctgtggtctgaggggtttttagggaggtaaaaccattctgtatgacacagtagtgacagatacatgtcatattgcatttgtcaagacccacagagccatgcaacataaagagtgaacctcgtgtaaactatgagctgtagttattcatgtatcagtattggttcattaagtgtaacaaatgtaccacattaatggaagatgttaataatggaagaaacggttaggagctgcaggggaggtggggagggcatgttgaactctgtactatctgctcaattattctgtaaatctaatactgtactacataaataaagtctagtaacttttttaatgccagagtctgagcccatgcaaa

SEQ ID NO: 237323 - DNA, 451 bp, Homo sapiens
cagattaggtgctcatactacaaggcttgccacgtaaaatgtaatacactagctttgttgagggatctcttgcagaggaagaggaggggaagcagaatgcttcctacagaccaggcttcatacccgctgctgcacctttttagtctcatttaattgcaacggaaatcctaggaggtaggcaggtatcatgataaccccaatttaaagaggagagaatagggatcagaaaggttgagtaacttgcttaaggtcacatagctagaaattgaaaccgagacctttttcactatgtaaattttgtagcaggtctgggataagagtgaagtgaggcaggttgagttgtgtaggcagagtggatgctgtctttacttaaaattttgatattttgatgatcataatattttggcacttttattttaaaatatatttcattaaaatatctatctagatt

SEQ ID NO: 237324 - DNA, 448 bp, Homo sapiens
aaatgcttttttctcattgtaaaacaaaattatgaaaatgaagaccaatcatgttgtattttgatgataagaatgatgagtcacaggtaagcccataatgcatggaaattcttggctttcttattatgacatttaacttcactgcaactggaaaaaaatcagtgaaataaacgattcaaatacatcaagtaacaagggcttctgaagtacagtatttctcgagtcgaatggaaatgttaactaagtccttatttagactgaaaaatctagccctttttgttataaaataattgctctggcagacttcttgcactgttctgaagaggtcaggcactcctgccttttgcacccttttgcccgacacccttttttattttaaaagaatatttattaagcgttttttagtacctatagcactatactaggcactctgaattgtgtcagggta

SEQ ID NO: 237325 - DNA, 772 bp, Homo sapiens
aatagccgggcgtggtggctcacgcctgtagtcccagcactttgggaggccaaggcaggtggatcacttgaggtcaggagttcgagaccagcctggccaatatggccaaaccccatctctactaaaaaaaacaaaaattggctggacgtggtggcgagcgcctgtagtcccacctactcgggaggctgaggcaggagaatcgcttgaacccgggaggcggaggttgcagcgagccaggatcgtgccattgcacttcatcctgggtgagagagtaagactctgtctcaaaataagtaaattaagtaagaatgacattctttgttttttagtacaatgttttaatgtctgctctaacagaatacagctgtgttctcatatgtttttgcattcagtctgttgtgataaccacatgtcctataacctctggaaaactccactctatgctcctgagagaacagagggactggcccctggaccacgccctgaaaactattgatagatgtggtactgtcaaccatgaagagtcagacagacctcagcacttacagatgatagttttgtcaccttgaacaaatgactacatctctctgagtctgtttcctcctctgttgagagagaagtgtgctgtaactcataggacagtgtagggattaatagaatacttgttctccttgatagggacataaaatagtagggtatttgttagtgtctggcacttggtaggtgtgtaataagcattattcctcagggtactttttaaaaaattgcttaa

SEQ ID NO: 237326 - DNA, 431 bp, Homo sapiens
gagttctgatgaatccatgcatctgtgttctgccatggtagattacttttgccttttcatagaaatggaatcatacatatacactcttctgtatgtaggttcctttagtcagcatactgtttttgagattcagtcatgctgttgcattttcagtagttcagtcctttgtgtttctcagtagtacatatttcatttcataaaatgacatgcttaatatgaatttactcctataattgtgtatactcttggtttattttcccctcacaagattaccaactatatatttgcacattaatactgaatattgtgtaatcagctgcagatttttgttatgaatttatcacaataggaattgtttcaaaaacagtattaaattgttagcaaaaagtgttttgtattttcttcagtaaatggttcttctttttaaaaac

SEQ ID NO: 237327 - DNA, 443 bp, Homo sapiens
tggaatcgaagcaacggaaggttaaaactgtttttatcaaggccaggcgggcgcggtggctcacgcctgtaatgctaacactttgggcggccaaggctggtggatcatctgaggttagaaattcgagaccagttgggccaacaaggtgaaacccccgtctctactaaaaatacattttatcaacagaatttcgaaacttttatataatagaataattacaatgaactttcataaagaacttgagcatacctggattttggtatccgtaggggtccaggaattatcccccttggataataacggagggctgtactcatcatccaacttcaacaacagtttgctgcctttctcatttcatgtatccctttctgcatttttttttgaagtgctgtatattaaagcaaatcctggacatcatgtcatttcacctataaatacgtcag

SEQ ID NO: 237328 - DNA, 513 bp, Homo sapiens
ttggctccttgatgtgttctggtaactgttctaattgtgtctttgttacttccatggcaaccctttcaggtaagtttcgctgaatatattccacgtagacatctgctgtgcttccagttagatgttctaactctaaacatctgtaaagtgttctcatttcatactgaacccttggaggttcgtgtactttaatagagataccaagttctttagcatcaagcacagcaaaatattcataactgtccaatacagccttaccgtgacctttcaccaaaaccgagaggcgcttatataatatgtctggttcatcagagattgttaccacaggtttggtcaaatcctttggaacatcaacgtgtaggtttgaaaactgtacccacttcatattggtactgagaagcaagccaccatttttggctgtattgcccttagaagtgtttacagaaaaattccccaatccctgccagaggcgccggcacacagcaccgaacgctgtccgcgccgccatcttgc

SEQ ID NO: 237329 - DNA, 2703 bp, Homo sapiens
  misc_feature (93)..(93): n is a, c, g, or t
  misc_feature (1606)..(1606): n is a, c, g, or t
  misc_feature (2030)..(2030): n is a, c, g, or t
  misc_feature (2465)..(2465): n is a, c, g, or t
  misc_feature (2484)..(2484): n is a, c, g, or t
tatagtgttatttgacaaaactgtggtactttttcttaatttcattttctgagaagaattgaatgtaattttaatggcaccacttggcggggntgcaaactccatgatatccatgccttttttcttacgtgtcttttttcttttccacactaggctcttgttgaagctggtttatagctcagttcagaataaccttgtgcaggcattttgtgagctcctgctttcccaccctcagatcaaacatggtcataatgatatggccttcaaaactgtgatgctcacattaaaagttcccataaacatggcagggatcctataattaaaagaaggcacagagcaactgattagatcccaggtatagatcttgtaggtggtcttttcatgctgttaaattggtcatttgtatttatagctttggcagggagggctggaacctaaactagctctaatcccagcactctcccacacttggccttatctcattctccgttaatttcgcttggcatccatgaatggagccaaattctgaatgattctgcatgaaccattctagccctagtctatgaaactattttctaagttcctttgaccagctgagattagagatactgttttttttgttttgttttgttttgtcttgttttttgagacagagtcttgctctgtcacccaggctgtagtgcagtggcgcgatcttggctcactgcaagctctgcctcccgggttcacgccattctcctgcctcagcctccaagtagctgggactacaggcacctgccaccacgcctggctagattagagatattcttaatatcaaaaattgttttagtttacctatgtaacaaaccttcacatgtacccccaaacctaaaataaaagttaaaaaaaagaactattttctagtaaaaaatagataaatttaccaggtttaaaataaacaaaagcagtaattctgattttcaacattgaatgcaaaaggaattatataaatagatgggtattccatgacagctgggactgtgtctgttttgtcctgttcactcacttgtcccaacatcatataggctcagcctgtcccatgataggtgttaataagtgtttgttgaatttatgaacaaacagcttgaattgtgtaatgtacctagaggctattttttcctcctccttgggttttctgtttaaatcctttcagaattgctgaatcatcccagaatctgaagaggtacatttttggtcgataatacatttctgtggtcagacctcctggatatagaatcatctttctatgttgggcatatgcacgtaatctattcttagtaaatactttggtcagattagattgacaaaggccatacttaaatctctaagttgcaaaataagagcaggttattacataatctcttcacttcaacccccagaaataaagaaacaaaactatctgaatcaccatattcaaccactaaggttacagagatcaggaaaggtcagtaatctgaacaatgtaacctgtgagggaaataattctgacgtcctttacaaagcttgtggaaagaagaagtatggctagagaacatgaactctgcctgagccaaaatgggttcttgtntactccactgctactcaagaaaataccgacaggcgtggttccaaagatcattaaatggccaagaattaagataatctcttgtgacttccggatcacttaagtaacagaacagtaatccttggaagatgaagaaagctatttggctaggcgcagtggcttaagcctgtaatccctgcactttgggaggccaaggcaggcggatcacctgaggtcaggagtttgagaccagcctggccaacatggcgaaaccccatctctactaaaaatacaaaaattagccggacatggtggtgtgcgcctgtaatcccagctgctctggaggctgagacaggagaatcgcttgaacccaggaagcaaaggttgcagtgagctgagatcataccactgcactgcagcctgggccacagtgagactcctccaaaanaaaaataaagaaaagaaagctattttatcacaggtctattaggtaggcttttatctaaaagggctagaggggattttttttcccagaaattcctgcaaagagcgtatgttttcccccgaagtcggtttctaatgactatccagtaatggagttgtgaaattatggtatttccatacattggaatactaagcatcttttttaaaaaaaaagtctgtatgtattgacctggaggatccctaatgtatatgtttaagtggataaaagcaagggtcagaagagtagttatgttattattaggtatattattttatcattcagataaaaatgaagcaaaaaatgaatactacctaacagtgagaacaaataagaattaacctaagactggccgggcgcggtggctcacgcctataatcacagcactttgggaggccgagncgggcagatcacgaggtcnggagacgagaccatcctggctaacacgatgaaaccccgtgtctactaaaaatacaaaaaaaaaaaaaattagctgagcgtggtgacaagcgcctgtagtcccagctactcaacaggctgaggcaggagaatggcatgaacccgggaggcagagcttgcagtgagccgagattgcgccactgcactccagcatgggtgacagagtgagactctgtctctg

SEQ ID NO: 237330 - DNA, 522 bp, Homo sapiens
ttgctttgcaagcaatgtccggcaccatcagcaactcctactggactcccaggagtttgcaagcgttcttaaccccttcggacgctccagccagatgccagtcaaacagatgatgctcttgcctgaggggaaaggaaagacacaacctagtgccacaggttttactcagaaactgtttccccagcttctccagctctttgtacttatttgtgtgtttttatatgcaagttagaactaacagtctattaaagctgttagatggagatacatgttccatcccaccctcagccacaccttggattttaatacttctggaacggtgcctgcaggtaccaggaagagctaaacaacttcacctgttgaagactggctagtgatggggaacggtcctcctgcttcccgcttttgtttccacttcccccattaactgttgtactctgttgagggaactcctttcagaaacagcaaaccagagaaactgcctcgctagcaaattcatgggctcagaaaataaacgtcaag

SEQ ID NO: 237331 - DNA, 224 bp, Homo sapiens
tcgatttctaattttatttaaaattgagaagaaatttaaaaacaaattgaggcaaatgctgttcgaaacatcaatttttttaaatgcccttttttttttttcctcttaagagtcagagtgatctctgctgtgctttttctctgctggaaacctaaccttttcacttagagtattaagggcttaatgaagttcttttgtgatttcaattaaatgctgaaacttta

SEQ ID NO: 237332 - DNA, 791 bp, Homo sapiens
gactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattcagataaattgagctcatatccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttc

SEQ ID NO: 237333 - DNA, 769 bp, Homo sapiens
gactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgactcatatccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttc

SEQ ID NO: 237334 - DNA, 389 bp, Homo sapiens
catagctagggaacagggcactgtttcccactgtaatctctgggtttaagatggagaggaaaggtagtcctcaaaagaaggaagatcagctgggcatggtggctcaccctgtaatcccagcattttgggaggccaaggtgggtggatcacatgagcccaggagttcaagactagcctgggcagcatagcaacctcccccgagtctctacaaatatttaaaaaattagttgggtagggtggtgcatacctgtgttcccaggtattcagggcgttcaggagagaggatttcttgagtccaggaggacaaggttgcagtgagccgagatctgcagtgcacaccactacactccagtctgggtgacagtgggagaacctgtctcaaaaaaaag

SEQ ID NO: 237335 - DNA, 538 bp, Homo sapiens
gggtacacataatgcatgtggaacttaggtccaaggatctccagagagtgaaagcaggagtcatagtccaatgtcctacagagacagcacagcaaccctagctagcaacatttgtattagtctgaacaatatatacttatagaatacagccaaagatacacaaactgaaacagcttcatggggtggactctaacagtaatagcaatgttatagaatgagacttacttctctgctatctagatctgaactccttggcttctttacttagttcacgccccagcctaggaaagccagttacataaaagttggctcaggagtcttagagctttacctaaatatgagacccgaaaaatatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatca

SEQ ID NO: 237336 - DNA, 370 bp, Homo sapiens
aaggaagagttgaccctggagggtatccgccaattctacatcaacgtggaacgagaggagtggaagctggacacactatgtgacttgtatgaaaccctgaccatcacccaggcagtcatcttcatcaatacccggaggaaggtggactggctcaccgagaagatgcatgctcgagatttcactgtctccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatca

SEQ ID NO: 237337 - DNA, 536 bp, Homo sapiens
gtacagctgcaatgcttgagaaaaaaatgcccaggaaaattcttgcctttgagcaggcccaccttatattgaaaccaaaagtctgcaagaaaaatggtagggaatgacctttaagccttggaggaagaatttatgagcacaactatagcttcttcttggcataaagttgtgttctgtattcttcaaaattctcagattttgtgcactgttggttcaaggtcacaacaaaaagcccctatgctctgaggacagaagcatgctgggatttcaagggcatggccagatttgagagaaaggagacctcagagcttacgacttggaaaggcagagtccaacgacaatgggtcattctcctgtttaggataagggcatgcaaatagcatgtgaattgcacattacatttctcagatgtgagtatttggttgaggaatgggggctgttggcaacacttctggaaattgaactatctttatcctgattcacagagttgtagctgagcagggcatagaggagaaaacagggcactgaaataggtt

SEQ ID NO: 237338 - DNA, 490 bp, Homo sapiens
tttgggctaagatttgcattattgcatgaaaacaacaaaacatatcaataaataacaaaaagcttggaattcagacaacagatccaagtctgggcttgatctcaagctagtgttttgatgttgaaaaaatgttatttggtctttctaaccccatttccttatgtaaaattggggatgatgataaattcactgataataagagttaaatgagattcttgaggagtcagaatggttctaacatgtgtaggtattattagcagtcatactgtagcataagaaaataccgtctgctgaaagagggacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaaaaa

SEQ ID NO: 237339 - DNA, 426 bp, Homo sapiens
ctagggcaataaagagaaaaattagtctaatgcatggtcttaacaagagggagagtgtgagcatgaataattaatctcactagtctatggcaatcagataaaatgaagtcccatttgctcaaccttattaaaagagagagagtgcgtgggagggagggagaaatggtaaaggtcgttaagggactcgtaacgtggaaagaactgcctttgagatgggtaatgtgttttctaatctctgtggtctttaactaaacgtcatggtaaaggtactcttcagatagttcggattcgtttgaattattaaacattttagaaaatactggactctggactactaacttagatgtctttatgatgaatttgcagagagtctttttggaaagggattacatctcactatatcactaagaaataatttatccactt

SEQ ID NO: 237340 - DNA, 372 bp, Homo sapiens
ctgtgaagctcaatttcttacctataaaatagggataatgccagtctttctggcttgtcaatacagactaaatgagagaatgtatgtgaaggttcctagtacatgccatgactgctaatctggatgactttatgtggtgctaagttttggtaagtatgattgttgatgaaaagtggatatcagccaggcgcggtggctcacacctgtaatcccaaagtgctgggattacaggtgtaagcccccatgcccggcctctgatttttctatagtgagaacataactatttctgtaataatattaaaaatacttgtcagtatcacatagaattttcaacagcagattcaaataaaatgaatccttgtgaaaaaaaaa

SEQ ID NO: 237341 - DNA, 439 bp, Homo sapiens
ccaggctagagtgcagtggggtgaccacggctcactgcagccttgacctcctgggctaaagttattctcttgcctcagcttcccaagtagctgggcccataggtgtgagccaccatgcccagctaattttatctatgtatctatgcatctatctatctatgggcagggtcatgctatacccaggctggtcttgaaatcctgggctcaagcaatcctcctgtctctgcctcccaaagtgttaggattacaggcatgagccaccatgcctggcctgctattttagttataaagtttcattaaatattatgtaaactgattacataactgtggaaaggaaagcattgttaagacaagtcttttcaaaagacctaatagggataaaatgctaaaaatttactgctgagttagatgtgggcaagataacagaaaaggattagag

SEQ ID NO: 237342 - DNA, 294 bp, Homo sapiens
tgatgttgtggtaacagtggaagaaggaagaggccaaggaaatgcgacacttatgtttgccagcaccttgctcagggcccgctggtggtgggggagtcgggatgttgtggaggggggatcctgggctcagctctgtcccgcagcccagccttggatgcctgcctggagcacgcaggccccagcagtgctggttgtcaggggatctgttttctcaccacgggattgggaagccttggaccagcttcccgtttctctcttgtctcctgccaaaagatctttggttctttgatctta

SEQ ID NO: 237343 - DNA, 675 bp, Homo sapiens
ggtagaggaaatttgcatctatggagaatcttcattaatgcagccatgcttcccctttctatgcctttccaggacctaggagtgattgagagtctgatacctttaaaggtctgaaaagaaacatttaccatctattctctctgagggccacctatgaggcttcatctacttaataagatccttggtctttcccccactcttatctgaactcaggcattcctttctatcgatttcaagactttagacgatagcataactctctcaaccaattgtcaactaaaggatccctaaaagccccttatgacgtacaagctcctaccctgacctacctgcaattacctgcagttggttgtctccttggaatgtataaaaccaaagtgtaacccggttgccttgggcacgctttcagaacctcttgagatagtgtaacccaggccttggtcacttatactggctctgaataaacctctttaaatatattttgacagaatttggtttttgtgtatttttctgtgtatttctacctctgagaagaggagtaatttatactctttaaaaatcatggtcaggtatgactggtgctagaatgaggatgaagggaagagaaagggaagaaataattctccactctttgtttccaattttagttctttaaagtaaaagtacaaaacattt

SEQ ID NO: 237344 - DNA, 482 bp, Homo sapiens
ttttgtagcctagtctgttgccaactcattaactccccatttaaaccctcttattttaaatatttattttttgtctaaaaaaaaatgtaagttcaatggaaacaaagaccttgtcttctttactgactactcaaatccatgccaagtccagtaaagttagtactaaaattctgaatgaattttacagtgaactggtctcactgccccaatccaatccccatcgttcacactgctttaaaaaaatgacgcattctttgggaggctaaggaaggcggatcacaaggtgaggagttcaagacctggctgaccaacatagtgaaaccctgtctttactaaatatacaaaaaattagctgggtatggtggcggatgcctgtaatcccagcactttgggaggcagaggtgagcagatcacttgaggccaggagtttgagaccagcctggccaccatggtgaaaccccatctctactaaaaatacaaaa

SEQ ID NO: 237345 - DNA, 624 bp, Homo sapiens
cattccagtttaacatttggatagcaaaggaactcagagtttataaaatttaaatataagatagacagtcacaattctgtgcaagcagtcagggttaattcagatcgtttcctctgctcttgcattccctgatttcaagcacggcgaggctggggctgtaattacggaatgggtagtactcactgttcaccagttgtgtgtaagctttaaactaataactcagcaattacgagaaaaatgagcggtaattacacccattttactcgcggctagacagatgggacattttctcctcgttattggcaaactgtcaccacatttatttcatttttactgtttactatttgttgtgctttgattaagagtaattataggctaggaaaatatgaaaaacatgaatgttgggtatttttaaaaatagaaggaggcccttctccctgttttatattgatagaattctcattttagatcctattaaaatgatatcaacattctcaagatatttccaggcaggcttcagttctgtgacagcttttcagcaggggattcccatgtttgctcattatttgggtcgtcatagacccataaatatcctgcattttttttttttttacagcagcctct

SEQ ID NO: 237346 - DNA, 2160 bp, Homo sapiens
tctacccttacttgcctgaactttatgccaggtgtgggaaattggggccagtctctctgtattcacctgtcttcaaaactgcttggcttcttccagaggaatagaaccgataatccattcaagcacagaacactcatgaagtggctcaccatgagtccaaacccgactctgtcctggacagctcttacttaaaggacaagttttgggaggacacaccaattttatttataaaagtgtcatcccgaagagacttggccaaagtggacccctcaaaatccttctgccaagggtcttacaatggcatagtttaggggttaagatgaggatgctagagtgagactgctggagttcaggtagctttaccacttattggctttgtggccttgggccgattacttaaactctttgggcctttgttttctcctttgtgaaactgggcaataatagttatacctactgtatggggttttcgtgtaaaggaattgagttaatatttatacaatgcctagaatggtgcctgggtatatagtaagagctactcagtgttagttactattactattgttgttgttatttatcatcaggtccataactgacccacattccttgagcttacaatagatctccaggagatgaccactacgcatgaggacatatttatcaacatgccttgcccaggtataaacctgtataccccttataggaagcaatctggacaaagctaaatgtgacaagtgaaattatctcgttcccacttcaaatgcataattatcaccctgccttcttggcagttttaaaaatgagactaagctcggtaacttgagttctcaaggcttcataatatatatattccctgaatgaaaaaaaaatacacgtttattggaaacccattgtatgtcagttaccagggattcaaagacatttaagccactgtttgttccctgcaaggtcttacaatctagtagagagaggcggataatgtatgattcccatgctgtacactaaatgccgttttcttagggaatttgcattggctccattcatggttttttcaggtctgtccatcagagcaaggtcttggcaaattagtgaagtaggcacagtttgtttttggctcctctctccccttaagacattccctttccctcctccgggaagtcccagttctaggattgaaaacatgattataatctctgctgacatgtttttgctaataatataaggatttgcccctcctgagggtaagtgcatttttgtaaggaggtcttgaacctaaaacatcattctagagctaaaggaatgaatttatacagaaagaatttcaggttacagcttagctgggggaaatgaagccttaagtactggttaatttttattctttaattataattgtttttacactatgcctatctttattttattgcccatgcttttttatgagtgggtttcctcaagtgttcaagtatagacaaagaataagcagtaaagcttttcatttctacttgcatttttactacttatattattgggcaagagtttgaaacactcagccttcaacctattttgccccattctgacagtaggtttcaggcctccttttcaccaaactcaattattatgcttgatattcaccatagaacttctacttcttctgttaaattaaaacatgcaaacctttaatgggaaagggcatattttattcgttaatgaaaaaacatgtttttatcacaatgctttctattcaaaggttgtgttgtagcatttgttgtgcatgtttttgtcctgaataagagcagcaggttctaacaggctagcccattattagaatttatttcttttcatgaataacaagttcattattttagaagtttaatccttttctctaaaaggggcatactatctctttagaaattaatcagtttttgccttcacatttggtcttcaattgctgtatagcattgtttcactctctaaattatgtgtcatagctatagaggtccatgaattgctgcagctgtcgttaagggggcatttttctatggtccatagaataagcactgtttgtatcctcttttcacaaacatttttttaaagttcccatgatggtctaagagaatattcattttcaattggaattaaaatttgcatggtaacaaattg

SEQ ID NO: 237347 - DNA, 215 bp, Homo sapiens
cccctcagtggtattccgggggactgcaagttcacctgggcacaaccatgttcctgctgagtactcctgctgaaaagggccacaaactgtgcagaagtgttgcaagagttgggattcaaatggattctggttaatatgagtgaagaaataagggaaggtaatatcaatataaaatacagggaagaaattgtaagaataaagaactggaagcacta

SEQ ID NO: 237348 - DNA, 343 bp, Homo sapiens
caaaatcatcagttcatcagtgacagaaagaacattctgaggtgcatgttcccaggagttagccaagggtcagtaatagggtcccagtgttcctcagagactccagggctaagcacccagactgctgtattaactctttcttcacagtcccaaatggcttaacgctattagcactttctaatatgtgccttagggtttttttcttattgaaaataaaatactggccaggtgcagtggctatacccatagtcccaacacttcgggaggccaaggcaggaggaacgcttgagcctgggagtttaagaccactcagggcacacagtgagacattgtctctatcaaa

SEQ ID NO: 237349 - DNA, 500 bp, Homo sapiens
cttgacagcttctcaggacttcagcctcaggctgagagttacactgtcagcttcatatttctcaggtctttggatgtgaactgaaccatgctaccggcttcccagagtctccagcttgcagatggcctattgtgggagccaattcccctaataaatcccttcttgtagatacatgcacatatacactgatatggtttggctgtgccccacccaaatctcaacttgaattgtatttcccagaattcccacgcattgtgggaggcacccaggaggaggtaactgaatcatgtgggctggtctttctcgtgctattctcgtgatagtgaataagtctcacgagatctgatgggtttatcaggggtttctgcttttgcttcttccttattttttctcttgctaccgccacataagaagtgccctttgcctcctgccatgattctgagaccttcccagccttgtggaactgtaagtccaattaaacctctttctcttcccagttt

SEQ ID NO: 237350 - DNA, 473 bp, Homo sapiens
actggactgaagatggtgactgtctgtccatgtctgtccttcccatcagcctggggacttacctccgtgtccacagcattacctagcgcagggcctggcaccctggaggcctcagggtgggcaaaaccagggtcacaaagttgacactgatactgcccctgcctgcttagggagtgggctggggaagagggtacaggagccagacttgagcatgaaagtgtcagtgatgatagcagccagcatttagcgggtacttacgtggcaggcatcgttccaagtcctttgcagagattaacccattcagtcctttcagtaccctttgtattatttattatttatttttattttttgagacggagttttgctctttttgcccaggctggagtgcaatggcggaggttgcagtgaaccgagatcgtgccactgcactccagcctgggtgacagagggagactccgtctcacaaaaaaaaa

SEQ ID NO: 237351 - DNA, 246 bp, Homo sapiens
aatttcctagtagcagttagcatggcctacagataccaagtcaataaaggtattttggaaactcagtcattcccacaaaattaaccaagtgacttgggagaatgcctataggttaatgcctgtgatacctgaagaaaagatgagaaaaatagaaagaaaaaaaaggagaaaaaaaagatgaaaggaagggcacagaaaaattatgatctaattgttcacataaagtttatttctttgggagaccaa

SEQ ID NO: 237352 - DNA, 508 bp, Homo sapiens
aaaaatcatagtgtgtacattgcttgaatgatccttttgggtttggctgttactcacagatgaaggagacatttccaaggttgtaaccagagtcattctaagcacagtccttgcagcagtagagacaatcccaatgactacaggaaatcctcaactctcatccagaacctgtaagctcaggacatgcatcataggaaggatgtgaattgctgcagtgcttccatggtagtcttttgctccctgcctacgtgggcaagaagctgtagactctgggataatttggacgatcccagcacgggtatactccactctgcttcatggcacttaccaaggctggagagagaccacacccatcccttctgttttccattgcattcccttccccaaactttccatccagaaattcttctttggttgaccctgccacattgtatattcttgttctcccccccatgatgcattttatttcagtatccttagattcctaataaatcaattatttaaacat

SEQ ID NO: 237353 - DNA, 327 bp, Homo sapiens
cagtttatttatcccaggcacagaaagacaaatactgcatgatctcacccacaggtggaatcttaaaacattgaactcacagaaacagagtagaatggaggttaccaggggctagagtgtggggggttggggtgatgttggtcagagggtacaaaagttcagttagacaggagaaagtttatcttttagtgattttcatgattttgacaaagttgaaacaactgaaacaaagtatctaaatattttaatacttgtaattattttttaattgttgagtgattttaatgagtcaaaaatataaaacaatcatgcataatacatataaat

SEQ ID NO: 237354 - DNA, 367 bp, Homo sapiens
tgacagagtaagactttgtctcaataaataaataagtagcacatatttaaaatgtattaaatttttttttttaattttactttaagttttgggttacatgtgctgaatatgcaggtttgctacataagtatacatgtgccatggtggtttgctgcacctatcaacctgtcatctaggttttaagctccgcacacattaagtatttgtctgaatgctcttcccctttcctcccatgccctaaagtgtatccttgattacttttgacatacgcatacactggtgaaaccatcagcttttaatcaagatcacaaacctatccatcaccccagacatttccactgaccctttttaatgtctcactcttgcc

SEQ ID NO: 237355 - DNA, 744 bp, Homo sapiens
ccgggaggcaaaggttgcagtgagccgagatctcgccactgcactgcagcctgggcaacagagcgagactccgtctcaaaaaaaaaaaaaaggggaagctgtgacttgttcagaaagttgcaagacaaatcagttatggaaagcagtgtgcctcatttcctgcaaatggctgagtgaaaaataactggcaggctaaaaagctgcaattcctcacacctggagtatcatccattccttttcaccatggcccagtctacgctgatcggagtaggggtttttatttccctttaggttccagcatattgggaaagattcctggagaggattcttattccaatctgtcaaggctcgaagaggttgaaatctttggggctagagagctggacgtgaaaatgccaattcctatggcaaacatacatgggctcttccattattagctaggtgacgtgagccaggtcacgtaacccggattgtaatcgagtagctgggattaaggttaagtgtaaaatgaagacatattagtagccaccgcttaaggacattgtgagaattacaggtaattagcactgtgtagaattcacgctaagcactcattgaatggctaccacagtctgatgatgtggtaaatggagggtgttgggaggggagatctctccaaagtccttgcagccagggctagggcctgagaaaacctctgcaattactggtgtgaccgattcatccattaaattaatattcactgag

SEQ ID NO: 237356 - DNA, 486 bp, Homo sapiens
ggatttgttcctgaagtttcactttagacagtctgattataatgttccatgcagaacacctctttacattattatctgcttgggggtacaagtaacatgtaaatttggtcaccttatcttgcctcaaatttcaggaaggctttgctcattcttttttcatctcttttctttatttttgtttgactggattattctgaaagacctgtcttcaagttccaagattcattcttcagactgatgtaggctattgttgaagttttcaaatgtattttgaatttttttcagtgaattctacagtttcagttttttgtttgtttgtttgtttgtttttgagacggagtcttgctctgttgcccaggttggagtgcagtcgtgtgatctcaggtcactgcaacctctgcctcccagattcaagtgattctcgtgcctcagcctccccagtagctgggattactggcgcacgccaccatgcctggctaatttttt

SEQ ID NO: 237357 - DNA, 263 bp, Homo sapiens
atctggaatcgtttggttattcagaaaagtctaatatgttgcattattttctgtgaatttttaccaataagttatttccaaaaaatgaaaaatacaagttttggaataatgcattttaaatttgtagtgtatatgcattcttagactattgcttatttgaattgatgagagttacataattggtctagaaggaggcttgtcatcttgtcaagcagaggaagaaagagatttggaatcatgaataaaagacattttattcttgg

SEQ ID NO: 237358 - DNA, 552 bp, Homo sapiens
tctgagaaatgcatcgttaggttattttttatttgtgtgaacaccattgagtgtacttacacaaacctagatggtaaagcctattacacacctaggctatatggtatagcctcttgctcctaggctacaaacctgtaaaacatgttaccatactgaatgctgtaggcaactgtaacatgatagacatggtaagtattagtgtatctaaacatagaaaaagtaatgcattgctctacaacattatcatagttacaatgtcactagataatagaaatttttcagcttcattataatcttatgggaccactgttgtatatgtggtccttcgttgactagaaacatcattatgtggtgcattacagtatacaatttttaaatttctaagggggctaacatattaccagaggaaaaaaagttcagttttatttcttttcttatgttcccatctgcaggcaaattatccttagattctaacactttctaattaataagaattcttgcaaagtatcatcaacatctatcctcaaataaatgaatacatggaaatttaaa

SEQ ID NO: 237359 - DNA, 2448 bp, Homo sapiens
agtgggtaacgggtgaagaatgtgggggagagtggcagttggccagatgccgaaccaccaccaggggtggttggcaaactgcagccacccaaggggctggagtagttttcaaacagtatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237360 - DNA, 2433 bp, Homo sapiens
acctcaccgctgccatccccctcctccatctttgagccactaggcttctcacagtctcccaccccgccctgctcgcggagcctgcaggcctcggcctcatggcggcctgaggcaggggcctggaggctggtccgcccgccacgaaggttggggggtccctggccagaagcaggacccgggcgaggctgagggggactctggcagaagctgaaggggacccggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237361 - DNA, 2343 bp, Homo sapiens
atcattgtctggtcacagaacagcccggagatgtgccagcttgctttgtgggacagggtcttgctctgtcacctaggctggagtgcagtggcatgatcgaattcctgggctcaagcgatcctcttgcctcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237362 - DNA, 2617 bp, Homo sapiens
agtgggtaacgggtgaagaatgtgggggagagtggcagttggccagatgccgaaccaccaccaggggtggttggcaaactgcagccacccaaggggctggagtagttttcaaacagtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctgtatgggccgggctgcggctcgggagctggggagggctcggggggcgcggggcgcaggtcctggggcgccgggcgtgggtcctggcgccgaggccgcctcctccgggcagccgcccagccccgcgcttgccctgcagatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237363 - DNA, 2253 bp, Homo sapiens
ctgcatgtgttggggacacttacgccaaggcgccgcgttctcattaggagctgggaccagaagtgaataagccaggttcctgtctcagggagctccatagcaggactcagaaccacacacggccctctaggcatttgtgaagctctgtgcttcatttttttgctttgcctctagttttgcctttgcagtaccaatgcagccagcccatgtgtcccctctatgtggaatgttaacgatattcccactgtttctggtgtcctttctgtaatcagagctgccgtgaccattccagttcaggcatcctggtggcctggcttctctgggcatagagctgggagtgggcagttgggtcaggccgggtatgcccagctcctccagcccctgcaagactgtcctctgaaggacacggggacgttctcaccagcacatggtattaccggtctcgtcggtgtggtctgtctgatgggcgcaggggtgcgtcgctgctgatccctgctgcaggtgtttcccgagtgtccaccgtcgggagttgctgttcttagggctgggaaagctgtgccctcctggagcctgcaccccactcaggatgacggggctggggccggctctgcagagggcgccttcggggtggtggggaggccgctggtgccagctcgctgccttcctcccaggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237364 - DNA, 1945 bp, Homo sapiens
agtgggtaacgggtgaagaatgtgggggagagtggcagttggccagatgccgaaccaccaccaggggtggttggcaaactgcagccacccaaggggctggagtagttttcaaacagtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtgga

SEQ ID NO: 237365 - DNA, 2221 bp, Homo sapiens
gcgtgaggcaggaacgtctggccattcccatcacgcaatgttggagcaacagaatccgagcgatgaccgaaggtaggcttactgttttcttgtgcgccatgggatctcgctgatagtctacctattgcggtcctccttcccggtatgagatacaacagttactgctgtcaactccccagcacgtgtatcatgcgaagcaaatttacagagtgacgacttactatgtgttggagctgatcgacattcatggaacacttcccttaatgttcctgtggtctgtaccgtgtgctgttcccatttgctcagttttcgagctcctcttgctcgggcccattggtgaagtaagtctcgggactcccataaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237366 - DNA, 1955 bp, Homo sapiens
gtattaacttgtcttaattttgcaggttcctgaaagggttattctgacttaatctggctataaaaatgctattggctgttattagcggatggccaaagtgcacccagaatgtcttctctctccattcagtgcacgcgttactttggctaaaaggaggtgagcggcactctgcccttccagagcaagcatggagcaacaggatcagagcatgaaggaaggggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237367 - DNA, 2480 bp, Homo sapiens
agtgggtaacgggtgaagaatgtgggggagagtggcagttggccagatgccgaaccaccaccaggggtggttggcaaactgcagccacccaaggggctggagtagttttcaaacagtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237368 - DNA, 2265 bp, Homo sapiens
agcggggtgacgccatggctgtgcttgcgacgccctgtcactggcaggaaccggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237369 - DNA, 2340 bp, Homo sapiens
gtattaacttgtcttaattttgcaggttcctgaaagggttattctgacttaatctggctataaaaatgctattggctgttattagcggatggccaaagtgcacccagaatgtcttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237370 - DNA, 2302 bp, Homo sapiens
agtgggtaacgggtgaagaatgtgggggagagtggcagttggccagatgccgaaccaccaccaggggtggttggcaaactgcagccacccaaggggctggagtagttttcaaacagtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237371 - DNA, 2201 bp, Homo sapiens
accatgagcctgactggtagagactttagcaatggggaaataccgtagactgttccatcaggacaatgctgggcctgcagtccccagggggcacccacttacttagccaaaccccagacgtttcatttaaaagcagaagtgaaaggaagactgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237372 - DNA, 2161 bp, Homo sapiens
gtattaacttgtcttaattttgcaggttcctgaaagggttattctgacttaatctggctataaaaatgctattggctgttattagcggatggccaaagtgcacccagaatgtcttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaaaaaaaaa

SEQ ID NO: 237373 - DNA, 288 bp, Homo sapiens
gagacggagtatcgctctcgcccaggatggagtgcaatggcgcgatcttggctcactgcaacttccgcctttcgggttcaagcgattcccctgcctcagctactcagaaagctgaggtgagaggattgcttgagcctgggaggtcaaggctgcagcaagccatgatcacgtcactgcactccagactgggtgacagaacaagaccctgtctttttaaaaaatgtttaatgttggcataattcagtaagaaaatctcatgtcctactgattaaaataaaatatgtaaaa

SEQ ID NO: 237374 - DNA, 1330 bp, Homo sapiens
actgggtgcaacaatggcaatggctgtcctcatactgtctcgctcaagatcagcttcaaatgctgcttccggccaggatgcaggggggaccagttccgcctctagtgtctggggcttagatttctcaggtcatgctgcctctccctatctgacacccagaatctccccagaaagacaggatagacacttccctgagattagaagctagctattcaatctaggtgaacatgccattttggagattagacgggctgagccctggaggagtcaaacgactccgagtaacccagccagccactggcacaggtgtggtgaggagccaatgccaaaagtgggtgaaagagctgggcaatgttcccaggctggcagccaggaaaccagggcttggggtccctggatcctcaggtgcggtgaagaggcaaggccaaaagtgggtgaaagagctgggcaccattcccaggctagcagtcgggagagaccagggtttggggtcactggatcctggctctgctactgaattgctatgtgactgttctgtgcccctgcttcccttgtctggtggctacaggaaggcagatgtggctcatcaccctgcctgtgccatagtctggctgcattactgagtcatttgacctctccagggctcagtttgtctatctccaaaatggcatactcacctggattaatgagctagcccctgatctcatgggagattctttctcatctttctgctgccttctcctccatttctctgctcagaaggggaactgtgtcagcagatcagggctggctattggaggcttttggaagagtaaatccaagtcatagcttcatgtctctctgcgctgggcaggaccaaggctaggcttttttatttcaataggttttggggtacaggtggtttttggttacacggataagttctttagtggtgagttctgagattttggtacacctgtcaactgagcagtgtacactgtacccagtatgtagcctctaatccctcaacctctcccaccctcccctgtgagtccccaaagtccattatattattcttcttcacctttgcatcctcatagcttagctcccacttaaaagagagaacatcacaaagtcaggagttcaagaccagccgggccagcatggtgaaaccccgtctctactaaaaatacaaaaattagccaggcatggtggtgtgcgcacctgtagtcccagctacttgggaggctaaggcaggagaattgcttgaacctggtaggcagaggttgcagtgagccgagttcgcatgccactgcactccagcctgggcgacagagcgagactccgtctc

SEQ ID NO: 237375 - DNA, 374 bp, Homo sapiens
tacttttggcaaattcaagggtgtgtggcttggaaatgggcagtagcttgggtttgagctcccagttgccccttcagctgagtgcttttattcagggcacttcctatttttcttttcttatggccctacacacttttaatacttaatttttaataaagaagggtcaagtaaatttagtagagaaagtggaaagcattattactgaagttaatttttaaaatttattctacatgagacctttaaatcccactagcaacctcctgtttataagaaaaaaaagattatgaagtaatttttaatttttaacaattgaagtataattcacataacattaagtcgactcttttaagaaactcctaaatctcattagaaaa

SEQ ID NO: 237376 - DNA, 573 bp, Homo sapiens
tccagcccgaggacaggacggggtgggaatgcatgacctgcagagtgacacccgaaggcagctgaggcgcgccgtctctaaagtgctgagagaaaaatacgggaattctatatccagtgaaattatccttgaaatatgaaagccagttaaggatgtcttcagccaagcaaaggatgagagagttgattgttggcagaactgctccatttcagcaagtatccaaggcaagcctgcaaagcctgcagcctagggaaggaagggcagggaggctggaatgcatgactctgtggtgaaatgacaccagcaccagctgcttaaaacaccaatactaacgtcctgtgggttttaaaacctgtttggtagtaacatatctgacagcaggagcaccagcgcgtgcgcacacacagacagcaggagcaccaacacacgtgtgcatgtacacacacacaagcaccagcgcgcacacacacacacagccgaggaggggattaaccgagtgaatgtgtttcaggagctccatcaccaggaagcagagaatgtaccaatccctagggcagattaaagatgcaatca

SEQ ID NO: 237377 - DNA, 486 bp, Homo sapiens
tgtgatgcccttccctcctcaataaaatctcacacttaattcttaaagtatcccgttccttaaacattctctttaaaaactcttaaaagatttattgggtcacatattcagaataactacttgccatttgttattgtacctaacagtaatagtgcagtgtttgaaatgaaatggacctgagctccagagttcatcatttattatctgtgtgactttgaacatattatataatcaccctaaacctttttcctcatcagtaaaatggaacttataatacctatgaggattaaatacgatatggtagcttaaatttttgctcattttgctcttttgatatgagccaaattataggagaaataattagagtggcacactagcatgatggtaaacattctgtcatttccatcattatcctaaattgcatctattctgtgtaagaagtaagagataaaaaagaagtacaagacatggttcctgaagacagga

SEQ ID NO: 237378 - DNA, 806 bp, Homo sapiens
catggtgctggggaggcctcagagactcctactgaacaaaaggaatgagggtgcctgtgtcacctccccagggctccttaacttgcggttacacccgggcactccttggggcaggggcttcgtctggtccataggactatcctccataggacagtcggggttcgcccagcttcctccacgggtgcgctctggacctgatgggtctcgtccgtccttgtgcccgtggcttcattcgctgaacacaggagaccccagaagacacgcgctgagtgaaggaaactcagcttccgcggaacccggagcttcccctcttagatcaccccgactactggttctcgcgtcccagagctccttggtgtctaaaggccttgtctgatctgcacaggcttcgggaggcggacactgagcagaaacaacgccacgcccggctccgagtgtcccatgctgccaccactaaaatgccctgatttttggccatatgtgacctccctgggtggcacgggccctaggcacccgtggctgtgcgcctggctaccaccagctcaggcctctgagcaatagcccctgcacggaaaccacgaccagggtaaccccggccgggccggttcgcgcccagcccggttcaggtgaccaggcgggagcttggcacacctggcgccgtcccctgaccccgccccggaccgggccgcaccccggaacgctctctctgggcgccagcggcggcggtgcagggccatggcggcggcgccagcggtgtgcgcctcgcaggggagctcgccgggtgcaccgtccgcgccggcggccgc

SEQ ID NO: 237379 - DNA, 391 bp, Homo sapiens
ataatagtcatcctaatgagtgtgaagtggtatctcattgctttgatttgcatttccttaacgattagtgatgttgagcaccttttcatatgcttattggcttgtgcatctaggtttaagaaacttgggtcaggcatggttgtttacgcttgtaatcccagcactttgggaagctgaggcaggcattcttgaacccatgagttcaagaccagcctgggcaacatggcaaaaccccatctctacaaaaaatacaggtagtgcatgcctgtagtcccagctacttgggaggctgaggtgggaggatcgcatgagcccaggagttggaggttgtagtaagctatgatcatgccactgcactccagcctgggtgataaagtgagaccctgtctca

SEQ ID NO: 237380 - DNA, 297 bp, Homo sapiens
gctgaagtttaagatgggatagtccattacattaatgtctgtgcttaaagctcctatttggcttaaataaattatttagggtttactgcttaaaccttggtcaattcttgaacgtttgggctagttaagtaattttccagtgactttctgtgccttggtgattcatttacttgattgagctcctgtgtgctcgtatgatttctaaatgtatttctcaagttttgcctggcaatgaatgattttgcttactggagtcttgtgtggtacacctataaaaggcttattaactctttttga

SEQ ID NO: 237381 - DNA, 223 bp, Homo sapiens
agcagaagcaactgaggcccagaggagcaaaggcccccaagcaaggtctccagcaggctgggagcacggtggaaatggagcccgctcccctgtcttccactgcctgtttaagagaagagcagccgcgaggccctgggctggtctcgggggtgagctctgctgtggatacccgccatggcttgtcttccccgcccacagataaatgcaacctttctcttctacg

SEQ ID NO: 237382 - DNA, 670 bp, Homo sapiens
aaataatgtggcagattgcagaggtctacgacatcttcatgcactgtgcattcacattctctgtttctgcaagctttgctggccaatttcaccaacgaacgttgaattgaccaaacatgtactaagtgcattctgcagacataacggagactgaattttggagatctttgcttcccaaagaatcccctgaaaaaaaaaattttttttttacttctactaagtagcccagttttccaatcacatgaattttctggaatatttttggagagaagcagatttattgaagagctgttcttttttaccccagatatagacaaagttaaatttattctctgaatataaatcatcagagtaagaaggtaagatttagtcaagaagatacatttgttggactatgggttcatctgtgtgcaacagagacctaaagtttcaatggcttaagcagtattgaggtttatttatcttccatgacagcgtgagagtttgcagccaaagactagtatggcgggtccatggtgtcaaggactgccaggtatctcccatcttattgcttcattatctctaggggatggccctcatctgcatggtccaggcaggaaagaggaggataggaataaccccaccccagaggctgcacccagcacttccccttacatacacacacacacac

SEQ ID NO: 237383 - DNA, 2515 bp, Homo sapiens
ctggagagagtgtagatggaggagaaaagagtggtctcgaaaccaagctctgggagtggttggaggagaatggaccagtgaagaaggctgggtgagaagaaatcaaggagcctgtgctatcgtggaaatcaagaaaggaaagtgtgtcaaggaggagtattcacttttgttaaatacttccgagacattcaataagaaatgctaacactgttttgttataaacaactgaaattaattttagctgtgaaaaaattaggtcctaaagtaaataaaaagatagtaatggggacataaaataggctgtgaaatgaatttaaaatgccaaaagttacaaatcccaaagacataacccttgctctggatgtgctacagatcttggctgtggacattctaaaagccattagaaagccttcagtcacttccagtattcacaatgaccataaagtaaaaggggtccccaagaccaccccaggctagatgatttgctgggaggactcacaggactcaatatgttagtcatactcacaagtaagatttactagagtgagaggaactagagcaaagtcagcaaaaggaaaagacatgtggggtgaagtctgcaggaaaccaggcacaagcttccaagacctctcctgtgtgtgtctgccacaggacagtccattcctgtggcagtgagttatgacagcatgtgtgaaatgtgttctgccagggaagctcgtaagagactccgtgggcaggtttttactggggctggtcatggaggcaccctctgcccggcatgtaccaaaatcccaggctcacagaaggaaagcggattcagcataaactgcactgtgtgcataaacagtttaaacatggtgagctgctctcattagtctgagaatggtgggaaccttccggaaatctgggttcccagacaccagccacggctagccttgcaagcaggccttttaaagccgtctcgggactgctatgtgaactctgttttttgtaaacaggccaaagcccaaggaaaatacaagcatagttggcactatgactacatcagaatttctctggaatgggcatttgtttaataaactgtttctaacatattctaaatcatttggatagctagtaagctaaaatttttgtctgtatgtattgggaggcagtctagcatataataaaataatcatagactgtgaaatttgacaaatatggcttctctagtcatggctcagctgcatactctctctgtacctccatttctggtaataaaacctaccattttgaagattcagtgatatatgcatatagtacctagaatagtgactgacacgtggtggccattcagaaatactggtggcattgatgttaataattgcaacaagagttgttttattattgtctttcttgtgttagacatgccattacttttcctggattaatcgattgtaatatccactctcctgtattttcactaaatggctttcagtttttcaattaaactttcagttgaacagtatcagaggcattttaataaaaaattttactgagcttgattagttgatgagaagtaaattgctcgtttttgattaccacattaactctttctggccattagggtaccatttagtaaattacttctctttttgtacagtactcaaaatgttacccaagtgaccagaaagagttaataatgcaccaacaggctgaacacttgactacctccttactattagatcagtctcattatattaaatgtttcccttcctataattgtcattttctttaaaaaatgaaatattggatacagttatttatttttaatagaccttataagctcaatgaaaagtatgctgagttcactcatataccttctaaggggatttaaagtatcggtactcactatataatatgcaaaatcaatccgatgtggataataaatgcacctttcacagtgcgcaagaagggcattatttcccaagggtacaagtgattccccgattatgatctgagtactaaggagtcatattattatgcctccctaagtgcttgagcactaaagagagttgtgcctcatggcattgtagcaggtaaactttcatgtgggcaggaatcctgccttttaaatgtatacattatcagtactcctgtggatgtgtttttatggctaattctaatacagcttttaattattcaggagtactctttactttcttatgaataggggtctgcaatctattcttaaaattacatcttttgctgggcacggtggctcatgcctgtagtcccaagcactttgagaggctgaggtgggaggattgctttagcccaggagtttaagactagccagagcaatattgagacccctgtctctacagaaaatttaaaaatcagccaggcatggtggtgcatgcctgtagtcccaactaatgtggaaggatcacttgagcccaggaagtcgaggctgcagtgagccgtgatcacaccactgcactcctgcctgggcaatagaggaagaccctatctc

SEQ ID NO: 237384 - DNA, 505 bp, Homo sapiens
tcttgatttcagccttgtgagaccttgcacagagaacccagttataccattgcctggacttccgacctacagaaactttgagatcatcaaaaggtattgtttcaagctgctgagtttgtggcaatttgttacacagcaatagaaaactaatgcaaaccatatggctggaatccacagcctttgaatacattcagaaataaaatccagaacatctagggcatttcccaaactaaacattcatgggagatgctaatatatgtgtcacattaaaagcaaaacaacttttttcgttgaccctgactgttcgcattagaaaggcctttgctctactggtggggcagagagtcaggtttctgggttgtaagcaacagaaataaactgactcacatttgcagaagagagtttatggaaaggctatagtgaggtcatggaatcaaggagcaggctaaagaaacagtctcagaatggacaggaacctgaaaactccaggggtctcacttccaaa

SEQ ID NO: 237385 - DNA, 1300 bp, Homo sapiens
atgattaccatatgaaagattccatgcagttgactattatttcacagagctctctggttgggctgctctataagaagctaatcacctaacagtgtctattgctgtggctgatgatttccagagtgttctaagatgttatcaggaaaggcatccaacaaatagtaagagaaggaccatttcatttgtacattatttcttcctgtgattctgttttccaacaccttgcctcttgtttcaccatgaaagatgtacacacttcacaccaaaagggtaaaagctgctgctaggcagatgtggacttcaaatctctccaaggtcagacagtctcttaaaaatgtttaccacaaatgtaagattcagcaccaagattcaactggatatcccactgtgacatctgatgattgtaatcaagatgatgatagttatgacggaaaaatgaatcttccagtagtgctccaagatgttaaaactgctcaagttgaacttttcagccaaatgactgacattgtccatatgataccaaaagtccaggaaaagactgacttgtatcaaaaacagatggaggtcctggaaaccagaatgaatgttaatgaagacaaacaatgcacaacgactaaagatatcctctctatgaaagaagacatcaaggcattaaagaagaaggtgacagaactggaaattcagaattcctgctccacgatacattgtctagagattctggagggagaaaggggtaaagaaatcacagaactgctttacaaactcatacaaccagcaactctgaagaacactttggcctctacagacatggaaatctcttcagcagaaccagagaaagtgcccagttatccaaagtccactgaccatcttgagaaaaaaacaatttctccccaaatgaaaactctgaagaaacgtaaccatcaaaatgcatcaaggagctttgaaaaagcaaagccaaatatttacatttacccagacttcagtacatggatcaagctaacttttgttcatggaggaaaatggacatttttcctcagtgctaccaagttagaagaattcatccagtggcttctttctaggccaaccattcttcctgaggaaccccaggtcataacccagagatactgtccattcactgggcccattttgagcttgaccacaatctgtctctccatcttcaacaatatttacggctttatttgttccttaaaagaagaagtaactcgactatagagttatgttctgctttgcttggcacaaaataaatgtaacctggaggctccaagtattcacacattgg

SEQ ID NO: 237386 - DNA, 465 bp, Homo sapiens
ccaggactcagttctgagacccatctccagtttggcagggacacccgtcctccccaaaccagcaatgccctcagttctaggcatgtcctgaggccccagcatcatctataatcctcaccacaaccctttgaggtcgatttaataatctccagtttgcaaatgggaaaaccaaagcacagaggtgcctgtgttcacgctgctagagtgatgccaagtgagtaaggctctcactctactatcctaactccaaagccaaggctcttcccactacactgtggtcattttgttctctgcacctgtgaaatcccttagaacacagacggcctttgatgttagcgagagtataacctgcccaccttgatgatatcaatgtgatgaaaaacagtgtgatgtccatggaaaggtctaacgtggagtttcccatgagacacccaagagctcgcaaagcaaaaagcaagaatggaa

SEQ ID NO: 237387 - DNA, 413 bp, Homo sapiens
tgaggcccggcgatctgtgtttaacacgtcctccaggtgcatatgatgcacttacggtctgagaaacactacctcatatccagctcctccgtgctttggggtcgtcacatactcacttctctctggactagctttcctcagatcattgtgtgcctggcttcttctgtccttcaggcctcagctcaagtgaccctccttcaggaagaccttccttgagcaccagtctaaagatgcctccttgtccagtctatactgtcatctcactcttattttgcatgtcacaccctctatttctctcaacaccttttttcaaattgacaaataattgaatatatttatagggggcaatggggcattttgatatctgtatgcattgcagaatgattaaatcaagctaattgacatatccagca

SEQ ID NO: 237388 - DNA, 970 bp, Homo sapiens
agtagtgtgactttgagggtagcattgcagttatgttggaagttgtcctagtttgtaggacatacataataaagtattcagggtggttgggcattgggtcagcactctccaacagttcagggggaaaacattctttacgctatacttaaaacatttctgtaagtctgagattatttcaaagtgtaaaacttcccagattcacatgttcttgcttattgccatcactttctactctagttctggctacaaaaaaaaaaaaaaaaaaaaaaaaaaaaaactatgaagcataaagtcagagaaatggagattactttggaatcgaaagcaagtagttaaactggtagggtaatagaatatccaaagtccaggaaataaaggcaagccaggaactaagagcagataatcactgcagtgggttgaggaaagatataaaaagcaattgtctaagggtagagcagatagggtggggtacggtaggggcaggagagagtagcaggaagagagacaatgaaagcatgtacaaatacagagtcaaacaaatttcaatgaatctaatgctatttttggcattcatatggaaataaaagttaaacagtaagtctcaaacacacaaagaaaatgccttaacatagggaagtgggaaataagtttacaaacctaaagataacagtagtaaataaacataaaattaagctccaaatacctagaagacaagtttaggggctcacaatgagttgcacccctaaaatctaacaaaagagaaacttattttcttactaagaaatcaggatacttattgtgaagacattaaacagaatggataatattcttgatttgttttaaagaaaaacattctttgtatcaatgtttgacttttaataaatgttaaggaggaaatattacattgtaacttcttgaaaacctctttaaaaatttactttgttgagcatccactctgggccaggcacag

SEQ ID NO: 237389 - DNA, 477 bp, Homo sapiens
aaggattcgtgtgaaagttgaagcatgaaccaatgataaaagagaagaaactgtcataaattaaccatgtggttcagataaaataaaattgtctgactgcaaatgatgtacataaccctcatggacaatccacctcaaaaaatataatggttagctgaggatgagagactacgttgtgtgtgactatgtgacggggtgtatatggagtcatagttaaggggaaggcttgattcagcactaagggaagaagggagtttttgggtttatgagactttgtggaagttttcagaagttaggctgctgcatcataatacctaggtagctctcttaatctgatgagtcatatattttgggtaatgcttacacaattcaagggaatacaagtccggacagaagcagggggtcagaaagtttcataaaggaggtgtcttggaacaaaaaaggatagaatacccgtgatggagcacttgaagacca

SEQ ID NO: 237390 - DNA, 520 bp, Homo sapiens
tgctcaatatgtaagaaaaatatacgtggttttctgacataatgacattgtgttagaataagatatgtgtttcttggggtcttccttgtaactgcaaccacaatttttttttcttaagcaaaagaattaaatgttgatcaaggttctggggaatgaatttggaaattagttgttaataattaccaaggtttatttttactcttaatgacttagtagccacagaaaaagatgtaattgatgcttaaagctgatgccatactatcaaaaatatagtgatgaagcaatgtgaataattgtattgaagaaaaaaattatagtatttttctgtgttctgtgctttaattataattatttaacagtattatgggaaatggacaaggactgatgagaaatgaaaatatgaaaaattagacatggattggtagatctatgtgtttttaaaaaatcatactatcttatgtgttctgtgtaataaaaacgaaaacagattaaaggtatattatctaacttgaagtacatc

SEQ ID NO: 237391 - DNA, 514 bp, Homo sapiens
ccaaacccttctacgcacccacctctgaggcgacagcttcccgtctccgcacaaagtgcctcaggacggcggtggctgcttctggagagaactttctagaaggcctgctgtcaggtaggcggcaagaacgtgacccctctcggagcctgccctctgcccaggccctgccctgagggcaccccatgcctggagcccacacactgtgcccgtgcccggaagacgcagcccgtgggtccaagatggctccacacccgaaacccagccgcatctgcgcaggggcccacctttccctgggggggggaaggacccgctccagcctgtgtctgcagtgaccggagctcccctggacgctggccaggctggcgacagcccatctgtcacctgcgcccctgccccacgtcggccacggcgggggctggcgagggcccccctgcagggagccgcctccccctgcgcctcagcctccccgctgcccgcccttacctgccccgacaggttccactgctgcggccgc

SEQ ID NO: 237392 - DNA, 443 bp, Homo sapiens
ctggataggaaaactgggcaaaaacatgagtagataactcataagaaaagatttaaaatgacccaaacacatatgctttcagcaactgtccgatgttgaggaaaaataggttgtattacaaggcgttacaagttgaattgtctctgaaatcattctagtttatattcagatcaaagggctacactctcaaattgagacatatgctctgggaataagaattataacctatgggtaaggacaaacagaattaaagaccaataaagcccaccccaccgtattcaatggatcaaaatgatttgccagtaaactatttagcatttaaatgatctagcagactgggcaccgtggctcatgcctgtaatcccagcactttaggaggccgatacaggcggatcatgaggtcagcagatcgagaccatcctggctaacatggtgaaaccccg

SEQ ID NO: 237393 - DNA, 399 bp, Homo sapiens
attattattattattattattattatattgtaatgtataatgaaataattctacaactcaccataacgtagaatcagtaggagcctgtattagcccattctcgcactgctatgaagaactacctaatttatgaaggaaagaggtttaattgagggggatggtgcaaaaccattcatgaaggatctgaccccatgatccagtcaccttccaccaggcccccacctccaacactggggatttcagtttgacatgagatttgggcggggacacagagccaaaccatatcaccaccagcacagcaccaagcatcttgccactcagaaagaatgccaaaatttctctctagacatattttatttttattttatttatttatttatcttttgagacagagtctcg

SEQ ID NO: 237394 - DNA, 841 bp, Homo sapiens
ttgtacttaatacagtgtagttttatttatttacgtttttcatcagaaaagtcatcttggagtttattgatttaataagcctgtgcaagcaaaagtactataaagcagtgcatagctctgaggggttattgaaattagtatcgttgggttaacgtttgtagcagggagcccttttgagttgacatttgcatttgtttatttgtttttcttcagaagaaggagccagaagaccatctggaactcactgagcatagctaccatcttagagggggggtaggtgtaggatattctggactcactgaggggatatagttagaatggcagtaaacctgggaattattgaaggtgactgtggcaggaaatatttccccaagatagccacatcaatgtatttcccatctcacaggtttgttttacaataagaaattgacacatcacctttagggtggcgatggaggattgtttctgttcccttcccttgaaatggggcaagtctctgtagctgccttgaccaatagaatgtggtagaagtgatgccacgtggattcccaggttagactgtagaaggcaatacagcttctgtctggctcttagagcccaggtgtcatgtgtaaggaagaccaggcacatgtgcgggggtttgacttgatggtccgtgctaggcccccagccaagagcaagcatcaacagccagacatatgaatgaatgagcctgtaagtgagtgcagccttcagcctttgaattttcttactgagatgcctgaacattgtggatcatggaaacaacttatctggaccctaccctgtctgaatgctgatccccagaaacaatgagaggtaa

SEQ ID NO: 237395 - DNA, 895 bp, Homo sapiens
ttgtacttaatacagtgtagttttatttatttacgtttttcatcagaaaagtcatcttggagtttattgatttaataagcctgtgcaagcaaaagtactataaagcagtgcatagctctgaggggttattgaaattagtatcgttgggttaacgtttgtagcagggagcccttttgagttgacatttgcatttgtttatttgtttttcttcagaagaaggagccagaagaccatctggaactcactgagcatagctaccatcttagagggggggtaggtgtaggatattctggactcactgaggggatatagttagaatggcaggtgcagcatgagttgccatatgatccaaggaggaatgagtccaaggaagtcttttaaacctgggaattattgaaggtgactgtggcaggaaatatttccccaagatagccacatcaatgtatttcccatctcacaggtttgttttacaataagaaattgacacatcacctttagggtggcgatggaggattgtttctgttcccttcccttgaaatggggcaagtctctgtagctgccttgaccaatagaatgtggtagaagtgatgccacgtggattcccaggttagactgtagaaggcaatacagcttctgtctggctcttagagcccaggtgtcatgtgtaaggaagaccaggcacatgtgcgggggtttgacttgatggtccgtgctaggcccccagccaagagcaagcatcaacagccagacatatgaatgaatgagcctgtaagtgagtgcagccttcagcctttgaattttcttactgagatgcctgaacattgtggatcatggaaacaacttatctggaccctaccctgtctgaatgctgatccccagaaacaatgagaggtaa

SEQ ID NO: 237396 - DNA, 461 bp, Homo sapiens
cagcagaaatgtgctcagcaaagccctgggtggaatggatttaaggggttcagatgggaggcacagaagcttcagtgtggtctaagaagaaggccctgaccaaccctgaaaagaaagttaaaagcctggtgctgttattaagatgaaacttcttgaaaataagattattggaaaacagaatgctttttaccaaggacagggtttattaatataagctgtaactggtattcagaaatgtgtttatacctgggctttacacacagttgaaatttttaaatgagtgttactatatgtgaggtgaatgttattttgcaaaggagaaacgttttcaaaaaatgaagtgggccgggcacggtggttcatgcctgtcatcccagcactttgggaggctgaggtggcaggatcacgaggtcaggagatcgagaccatcctgggcaacatggtgaaaccccgtctctact

SEQ ID NO: 237397 - DNA, 202 bp, Homo sapiens
gttccagtagattcacttggtctcaagtgaaaattaaaaaccaaaatgttaaaccctcatggttttttttgtttgttttgtttgtttgtttgttttttgtttttgagatgaggtctcactccattgcccaggctggagtgtggtggcgcactcagctcactgcaaccttcccctcccaggctcaagcaatctcccacctcag

SEQ ID NO: 237398 - DNA, 435 bp, Homo sapiens
  misc_feature (23)..(23): n is a, c, g, or t
agacggagtcttactctgtcgcncaggctggagtgcagtggtgcaatttcggctcactgcaacctccgcctcccgggtctcacttattaataggcagctacagtccttttcaagagacattgtgacacagactgctacgtgttggtcaaaacctgtttcctctttctgggcccacagctgaagtatattttccagtcttagttgcagttaggcaaggcatgtgactatgttataaacaatgaatgaaatgatctgtgctgcttccaggccaagctcctcccacaagtgattctcatattccttctacattcttggaaggcttgggttgaaggtggcaaagcacaagatggagggtgcctggatcccggaactgctgctcaagaggaaaggcatccaaatagaaaaaccgttcttgaaaaaaaattttttttttga

SEQ ID NO: 237399 - DNA, 296 bp, Homo sapiens
cagagccagagaaggagggcttagtcaaattccatggcaaaggatatagattcagagaaggataaggaattgaagccataaatgcaatttaccatatcagctctgcaatcttgtctcctgacatttcctacctggaagattatacgacataggctcctactatattcatttgcttttagccccacaaattacactcttatcatacttttctcatctgcatgcttttgtccagtgtttttgctccaatttgacagctctttacacttctgtgtacaccccacctcagacaattaata

SEQ ID NO: 237400 - DNA, 705 bp, Homo sapiens
gacagggtttccccatgttggccaggctggtctcgaactcctgacctcaagtgatctgcccgcctcggcctcccaaagtgctgagattacaggcatgagccactgtgcctggcccagagcagatattttaaacatcaagaatcagatctgcatgattcagaatattgctaacctatcggttctaacataagaaacaaggagtaaaaagtaaaacaaccaccaaagattttcaataactttaagacataactttaagataccagtaaaagaaatgcctcaaggtagttcataattgctaaaagaagtgccatgacaattaagttgtaaaaacagatttaaaacttctacttccaacctaacagaataattggtataggatttaccctagcaactagaaaatggggcagaatttatgaaactactcttttcagatattagacagcaggcaatgcaggactgtgatccctaaaatatagctttcagctaaatatactttagctttcggctaaatatactttcccctataatgtaaggggaaaacctcagtaaacacaacgaactcaattagttgaagggacaaatttgagttaaggaagggctgagaaagctggaattctcaggtcagaataacagaaaaaaggtaagctaagcagagacacagtaccagaaaattctatatagggactcttgaatcttcaaagaaat

SEQ ID NO: 237401 - DNA, 652 bp, Homo sapiens
gacagggtttccccatgttggccaggctggtctcgaactcctgacctcaagtgatctgcccgcctcggcctcccaaaaacatcaagaatcagatctgcatgattcagaatattgctaacctatcggttctaacataagaaacaaggagtaaaaagtaaaacaaccaccaaagattttcaataactttaagacataactttaagataccagtaaaagaaatgcctcaaggtagttcataattgctaaaagaagtgccatgacaattaagttgtaaaaacagatttaaaacttctacttccaacctaacagaataattggtataggatttaccctagcaactagaaaatggggcagaatttatgaaactactcttttcagatattagacagcaggcaatgcaggactgtgatccctaaaatatagctttcagctaaatatactttagctttcggctaaatatactttcccctataatgtaaggggaaaacctcagtaaacacaacgaactcaattagttgaagggacaaatttgagttaaggaagggctgagaaagctggaattctcaggtcagaataacagaaaaaaggtaagctaagcagagacacagtaccagaaaattctatatagggactcttgaatcttcaaagaaat

SEQ ID NO: 237402 - DNA, 502 bp, Homo sapiens
gcctcccaaagtgctaggaataaagacatgaaccaccgcgcccggcccttaattttagaagtactgtatctatttcacttctactaatggtttctcttaaaatgcttttaacaaaattggcgacaatcaaaaaattttaagtaataacataataaacatatgtggacctgcaacagagctttggaaataaacattgtcagtgtagttgaaaccccctcgatacttctaccttatcattagccttcctgtctctgctaggtaatcattactctaaatttgattaccctttaattattacaaacacttttggatcaaattaaacagggcttaacctttgtgtccgcttccagcaaaaggaagttttaatagaattcttttttttttgagatggagtttccctcttgttgcccaagcggaggttgcagtgagcccagatcgcgccactgcactccagctggggcaacatgagtaaaactgtctcaaaaaaaaaaaaaaaaaaaaa

SEQ ID NO: 237403 - DNA, 678 bp, Homo sapiens
ccaagataaaactcaaacctctctctacaaccaaacaaacaaaaacgtctaagaatttaggtttcagtcacaaattcctagatgatattgcccatctctttattgtaaaactgtaccggttgtttttttcccttcagcttgtcagagctattcccgacagtcaaaggcaccaccatcagacagttctaagaagggaatttggcttaattctccacattgttctttcagctagatacggtgtacaatcaaattttgctaagcttacatggttgccactcagaatgatgaattctctcagctaccagtgtataatgtaagactcttattttccctttctttgttttaggttagaaaaattaggccaggcgcggtagctcacgcttgtaatcccagcactttgggaggccaaggcaggcagattgcctgagctcaggagtttatgaccagcctgggcaacacggtaaaaccccgtgtatactaaaatacaaaaaaagttagccaagcctggcggtgtgcacctgtagtcccagctacttgggaggctgaggcaagagaattccttgaactcgggaggcggagattgcagtgagctgagattgtgccactgcactccagcctgggcgacagagtgagactctgtctcaaaaacaacaacaacaaaaaaaaacgaaaaaaacc

SEQ ID NO: 237404 - DNA, 390 bp, Homo sapiens
taagtggaacattgatggtagaacaaaacaaaacacaaggaaaaaacattgaaataatcctggtactagggataaggtaatctttgctaagggctagattccccagcaccttggacaccctagcccaggtgtgagaaggcggggcagcttgttgggtgtgttccattgctaaactgacctggagcagggaggaggcttcagggtgggaagccgagggaccggaaatgaacctctagaactgacttgccctgagaaggcaagaagtgacagaaacaaaacctaatcaacagatattttctgtctcgatcttactcagcagatacttagattgaagtagttcagagcatgcacacgggcaggctgagttatgtagcagggaggggaaaccat

SEQ ID NO: 237405 - DNA, 519 bp, Homo sapiens
ttgtgttgttcagtagcattccattgtgtggagagacaacatttagtttcaccattttagctgttgagagacatttgggttgttttcaacttttggctattattcataaacctgcatgaacctgttatacacaattgtgtaggagtcttttatgtggaccaatgccttcatatctcttgaggttatatcctggagcagaatggatgagttgtgtagtagaagtgtgtataaggagtgggcaggccaggtgcggtggctcatgcttgtaatcctagcactttgggaggctgaggcgggtggatcacttgaggtcagcagttcaagaccagcctggccaacgtggtgaaaccccgtctctactcaaaatacaaaaattagccgggtgtggtggtgggcacctataatccaagctatggtgggagaattgcttgaatccagcaggtggaggttgcagtgagctgagatcgcaccactgcactccagcctgggtaacaaagcaagactctgtctttaaaaaaa

SEQ ID NO: 237406 - DNA, 376 bp, Homo sapiens
agtgatttatttactcaacaactctcgtttcatctatatcttaatctccttaccctcttctaatactattttgaagtatattccacatattatttatctgttaatattttaaagtatatttctaaatatgattaccgcagtaaagtctttttaccctccatgttgaagtaactgggtcaatttttccttataacgtttcacattctgcattttcttattccttttgatgtcatttaacttattactttcctggaatccatgtaactggaaattggatgtgaagcagtgtttctaacctttttttttttaattgttgcctcattacggagtttttagagcttttttttttttttttgagacggagtctcactctgtc

SEQ ID NO: 237407 - DNA, 492 bp, Homo sapiens
tctctgttacgagagattgggagatggcatttcatctgtaactgcaaatcacaaatatttcacgatggttttaaatgtcataagtgtgagttatgtccctgctcacctccccttctgatttgagcagatgtctaacttttacatgagatcagaataatctgattgtttgaactgaatatatatttagtttgccaaataagctgcatattctgttgatcataagccttttgtgatgggagggagtcaaaaatctgacgaccagaaaaagaaagcatattaattttatttttagaataaaaatttctttgatgtacatttatttttggtctacaaagatttcctaaagttgaggtgggacattccttgaaccctttatagcccccatgtaagtagctgtactcaattgggagcgcaggcctccgtgtgagagaggaaaaggtgacttgtccttagccttttgtttttaagcagtgtatatgaggatgcccctgc

SEQ ID NO: 237408 - DNA, 1201 bp, Homo sapiens
  misc_feature (1170)..(1170): n is a, c, g, or t
gtttaatatgaaggatgataagcatcaggtaaggaaaaaaggagaaataaaaccaagatatggtaatgtgaatacaaatgaaagttagcactggtggaaaggcaacagatctggcctgagtattttagaaagtttaaaaaatagtgaaaggaaacagtgaatagaaattttttattggaaaattatgtgaggcaaaaaaagcactacccaaaaggtctgagggaaaagatagggaattatcatgtagccatctgattaattttttgtttccctagaccccactcctctccctattccccaccaccatttggtgctccacattgcagacagggcaatatttctaaaatacaaaaataggtcatcatattccttgtagccctcagaatcaagtctgatacatgcagccaacaggcatatgaaaaactcagcatcactaatcattagggaaatgcaaatcaaaagcacaatgagataccatgtcacaccagtcagaatgctattattaaaaagtcaaaaaataaatgctggcgaggctgcagagaaaaggaatgcttatactctgttggtagaagtataaattagttcaaccgttgcagaaagcagcgtggctattcctcaaagagctaaaaacagaactaccatttgacccagcatttccattactgggtatatacctgaaggaatataaatcattctaccataaaaacacatgtaggtgaatgttcattgcagcactattcacaatagcaaagacatggaatcaacctaaatgctgatcagtgacagtttggataagaaaatgttgtacatatacaccatggaatactatgcagccataaaaaagaataagattgtgccttttacaggaacgtggatggagctggaggccattgtcgttagcaaactcacacaggaacagaaaaccaaataccacaagttctcacttataagtgggagctaaacattgagtacacttgtacacaagggaacaaagacactggggcctactggagggtgcacagggtgggaggagggagaggatcagaaaaaataatattggatactaggcttagtacctgggtgaagaaataatctgtataacaaacccctgtgacacaagtttacctttataacaaacctgcacatgtaccctgaacctaaaataaaagntgaaaaaataaatctcattgctgttcaaaac

SEQ ID NO: 237409 - DNA, 425 bp, Homo sapiens
cttgaaatctgagagggaccaagcaagttgtcttagctagtctaggtttcctttcacccagctagtcctcctatacccacagcctacatgttcttcttcaaaactttcctcttcagagaaggcaaaaggtttgtttttttttggtttagttatgcatttttggtaaagtatattattttgttcttggaaaacccttgaaaatttattagatagaaaagcattcagctaaattattagttataaagataatattcaaatatacttagcatctgcataaaaatacctgtatcactgttgaatggagagaagacatttaagaaaagaacatggccgataagcccttgaaaagatacttaatatcattaatcatcagggaatacaaattaaaactacaatgagataccattatgcatatcatattggtt

SEQ ID NO: 237410 - DNA, 552 bp, Homo sapiens
tccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttcttattacaaaggtcaaaa

SEQ ID NO: 237411 - DNA, 446 bp, Homo sapiens
gctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttg

SEQ ID NO: 237412 - DNA, 503 bp, Homo sapiens
ttaggccgtgtcctgacttggccagcaagcaccatgatgacactgcccccagcctagccatgatgacactgccacgagcctaatgcctgggattcccaaagtccagcggtgtctcaagaatctgggttatgggtgcattgctggctttgtccattttactcagcacaagtcagaggtgccctggagcacagtcaccctgaggatgccagccctggctgttccctggctttgggtaggtgggttcctctgcggatcgtcacgcttctgcctggggtcacaattcacaggaacctgggcacccaggacccaaggacacctgcgtggagtgatgttggacacatcacatgggtgcctcctgtgtgatggttcctggatatccgaattttccttccgattccaagaaatcagaaagaaggacaagagagagggagggaaggctgggaatgagggttctacacatttttgagatgcatgaagcttaatctgtcatgaaattagagtta

SEQ ID NO: 237413 - DNA, 534 bp, Homo sapiens
aagctccccctcccttggtggaagtcggctcaagcaggtcctgaggacaggagccctgggggtttgggcctgggacaggacgagacacccgcggtcccctctcccatgccaccccaaacaggacccaggacacagccgccttcgcggcggcagcaggagcatcgcggccgccgcgcggcggtcgcgatatttaaaggggacgcagcctatctgtcaggagtggagcgtgagtcggctcagccaatgcgcatgcgcgaggccccagcggttgctccagtcacagtggttcccacggttgtcttagaaaccagtccccgaggctttgcagagcaggagccctccgtggcagtgcttgggtatcgaggctctgaggctccggtctcacctctccacgggctcgaagggaaactctcctgatgccagcagtcgcaaagggccgactatgaagatgaaaccccaggtggagaccggggaagcagcacgggatcccagcctcaggcctgcacggacggtgtttgttggggtgagtctcgc

SEQ ID NO: 237414 - DNA, 445 bp, Homo sapiens
tcccggtgtccctgtgtctgggaaagaagccctggctcaactttctgctttgaagaggccctaattaatccagcgggagtggcgattaagctgcgactttgcgcgctgacacccagtaggccgctgcgcgctgaagaggcactggcgggaaccacgcccgggcgaatcccaagctccccgccagcggcgctaggtaacgtgtccctcacctggactcacccttgagagattctgggcctactttgagcccttcctgaggcagctcgcgtctcccaggctggctcgtttcacctttgttcccacgcccgttcccagacctcacctgagttttcccttcctattcttggaccctgccccgacccatccctttgcagcatgaacaaggaaactgtggttgacttggattttctgccactcattgtacacttcctttggggaaaaaaaa

SEQ ID NO: 237415 - DNA, 496 bp, Homo sapiens
agctttcccataacaccattttgggggtctgtgccataaaattcctactaaaggcaagatcctgctagcttgaggcccttctggcatatctagtatctcccatccccggattccatctgtaactcctatgtgggtcctactcgccttgcaccatctacataataattgccaacattgatgtcctggttactagcacgtgcctagcactgtgctagtgctatacctgcattctcttatttcattctcacaatatcctttgaagtagataaggacagttatcccccatttactgataaggaatctgagggtaacttgaccaaggtcacagctggcaaatggcagagctggcatttgaacccagtttgcactccaaagcccagactcttaatataatacttccatacggaacttcctcaagtcatttagaaagtgtccacttttattttatttttaaatcttcttatttaacaactcaaccactgaaatttcagtaagg

SEQ ID NO: 237416 - DNA, 361 bp, Homo sapiens
caccccagcctgcaagtacctaggattacaggcacacatcaccatgcctggctaatttttttgtagagacggggtttctccatgttgccctggctggtctcaaacttctgagcccgagccatcctcctgcctcagcttcccaaattgctgggattataggcatgagtcactgtgcccggcctatggctaccttttaacaaagtgatcaaatttaacatcatcagtgacagacaaacctacagtatgtacccttgatgggatgtacagagaaggccagcgctttaagaggccaaggcaggaggattgcttgagcccaggagttcaagaccagcctgggcaacacagtgagaccctatctcta

SEQ ID NO: 237417 - DNA, 473 bp, Homo sapiens
ccaaagctgagtctctggaaaatttctaaaaagtctaaacaaaattcttatcatgccaaccaggcacgcttctttcctcgcaccgcgcggcgcagaaagacacacccctgactctgcgctcgtccctcgggctcgggtcctccacgctcagccccggccctcccggtccccgcggaccctcccctcgggcccaatgcgccagctggctccgcagggccggaaaagcgcgttcctcggcagcctggcgccgccgggaaggtgcgcgcagcccgcccggcagccccgggatggcgtgagggccgcctccccggctagccccagcggacccctgccgccagcaggccgccctccctccgcgggcttccgggagcgggtcctggcgccagcgcgacctcccgggccccggcgaaccgagggagcgtcccctttccccgcctgacgggcgccgacccgcccctgcggtgccgcggccg

SEQ ID NO: 237418 - DNA, 1712 bp, Homo sapiens
agctttgatgaagagtgaatactgatggagaaatatgataggacaaaaagggtgtgatctagtgtagataaactggggaatttagcaaggcctgtttgttcaggttcctctctgtgacccttcatcttcagagatgagcatgttcctttcttccagggatcgggaggccctcacatgagtgtcttctgacctgcttcttgggaatgttggaaaagctttcctaagctgtatgccctgcatcggggagaagcatatgtgtgggtgaggaggggaggtcagagagactttcctgcttctgtttttttaatatgccaaggtgccgtattttgagtagtgtgtcctgaatcccatcatccttttcaatgtaacttttcattaaatgcagtgttctaggataagggttagcaaatgacttctaaaaaaacaccagatagtaaccatctttgtctttgcagcccataaagtatctgttgcaactactcaactctgttgctgcagcacaaaagcaatagtagaaaatacatagaccaagaagagtggctatgttccaataaaacattttttgtagatagtaaaatttcaatttcctgtaatttttacattataatattttacttattttttttccaaccattgaaaatgaaagaaccattcttagcttactggttctacaaaaacagatggcaacctggatttggcctgctgctgtagtttgtcaacccctcttctatgacattacattcacacagacaaaactaaacccaaacaaaacaataaaaatgcattcttctgacaatacaaagacatatcttaaaatatttaaagtcaaacaaaaatggacagtttctgacatagcttatagaacattgtttgtcaaactgcagggatttgaaataatgaatagtaaacaatagtgaaaaaaaaacttcaaataaatcacagctaatttttgaaaatccagtgttaaaatgtgatgatcagagtcaagaaaaattgtgaaagatttgaaaattggcaaaagtaaagattatttttctctgtattgcacttctccaagttctgtccagtgttcagtgctttgaactattttcccactctgcaaatggtagaaaattgataatgaaaataactcttgtccatgaaaatgcaaatacattttgtctagtggaatgcacttgatgcttcatccaggaatacaacattttgcatatatttgtaaatccatttcagcaccagcattccttattgaccctattcatccatccatccatccgtccatccatccatccatccatccatccatcttaatctgtctatcatttatctgtctattgtctatttatctatgggatttttcctttgaatcaaatgtaacatatgactatttcttgagttaaataaaatctttggtacatttccatctgatatttgcatgagtcttgtcttcactttataaaatatttctccactttgggagtccaaggcaggtggatcacgaggtcaagagttcaagaccagcctggccaacatggtgaaaccccgtctctactaaaaatacaaaaattagccgggtgtggtggtgcacgcctgtaatcccagctactcaggaggctgaggtaggagaatcacttgaacccaggaggtggaggttacagtgagctgagatcgctccactgcactccagcctgggcaacagattgagactctgtctc

SEQ ID NO: 237419 - DNA, 381 bp, Homo sapiens
gctgcaccctctcactcctgctgtctctccacgctgagatcttgcttcctctccttctgcccttggacatcagactccaggctcttcagcctttgggctctggaacttggaccagaagcctcccaggggctctctggcctttagccgcagatggaaggctgcactgtaggcttccctagttttgaggctttaggacttggactgggctactaccgccttctgcctttcctcagcttgcagatggcctagtatgggacttcactttgtaattgtgtcagcttttaatctgataaactcatacacacacacacacacacacacacacacacacacacacacacacacactattcgttctgtccctctgaagaactgactaata

SEQ ID NO: 237420 - DNA, 466 bp, Homo sapiens
accaatatctaatacccaaatcagggataaaaaaggctgacctagccagtcatctacaaagactcaagaaaacccttatttgtatgttaataccgatgacaaaatataatcttttaaacttaaagataatattgtatgtcttaaatgacaccaatatggagaagaaaaagcctttcatctaagagccacttttactggcactcagattagatcagaagcagctctttcaggtcttcaggaaaagctcaatctccacccaaaacagaaaaagcaaatcctatgcatcctctctcctcatacttcttataacccacacacaaattatgaaatatcataattcagtatgttgttcagggaaaaattttcaaaaaagtgaaaacctaggaaggtaagtcattgcgtgaacacttttacaacagctaagcatttcctacgtgactaatctattttaaattcggctcctctg

SEQ ID NO: 237421 - DNA, 400 bp, Homo sapiens
ccgaagcatgatgagggttggggtaggagagaatgatacaagatgaaactggagggaagcaagagcaactgttttgagaagcatgcctggaaatgggaaggactgcggtctacattttgttgtctgtggattgcattttgaaatagtgttgtattaggctgcttccccttcccatccccttcaggacagtacttgaagggagccagcttgttctcagttggcacagaggctgtggaaaggagtttggattttagtctaagcacagtggaagggacagtgatttttgcccagcacagtgactcacacctgtaatcccagcactctgggagaccaaagctgggagatcgcttgagctcaggagtttgagaccagcttggacaacatggcaaacccctctaca

SEQ ID NO: 237422 - DNA, 392 bp, Homo sapiens
aaaatttaatttttctgagaatgaattctaaacttcaaaaaccctcagattatctttcaaaatgaaaatagaaagcataaggttgtaaatttccttcaaatatacaaaagtgtacttaacatccactattaaatgttatataatccttaaacaccttcccttctcagtaaaagtgtacttatatataatgtacacagaaattcctagactacaagatgtcatccttctagaagaagacctaaagcatacactgggaggaaagttttacaggggaatctagactacttaattttttcttcacagtaacaaatgacaaagcaccaatatctaaaggttcccaacacacaggataaacaataaggaagttctcccagtgtttcccattttaggca

SEQ ID NO: 237423 - DNA, 635 bp, Homo sapiens
tgttagtgtttatttcatggaaaaatattgctgttgccatgtatattcaaatgcagatcagatgatctgttaaggataatggaaccgtcacttaagaaaaacttaattttttttccctgtgtcctattggcacaggtcttttcttttaaatttttattttaatcgttttgaggtacaggtgggttttggttacatggataagttctttggtggtgaagaaaaacttcagatagaacatttggttaaataaaagactatagagcaggtttatttgttttttaagtcaaaatgttaacccattacataagcatgctgacctaggcttgcttgaaactcgtgatcttgtccttagtgacccagtctttcctgttacattgtcctaaatgactggtttcatagttttactctgtcattgcacgtctcatatctcctccctctcactttgctccctattgccctgagaaaatagacgcagtcagaaaagaatctttaaaagttgtcaccgttgcatctgtaaacctagcatctgtgcccatctgtccccatctgccctttattatatactgcggatatattgtttgtcgtagcttgagccaattgcaatgtctcatttcttttataacaaagctccttga

SEQ ID NO: 237424 - DNA, 472 bp, Homo sapiens
agtgttgggctaagaacagacctcggtattcctgcctgcccttcctcagggatgtgggagaggggacactcggggtttggtgaggtccgtctgtgcttctttgaggccagaaggacatacagacagaaaggcccaatgctctaagaccctgtaactctgggtagcggcttagtcttgaaaaccaaggtggggccaggtgtggtggctcacgcctgtaatcccggcattttgggaggtggaggcgggtggatcacctgaggtcaggagtttgagaccagcctgacccacatggtgaaaccccgtctctactaaaaatacaaaattagcaggtcatggtggcacacgcctataatcccagcctcaggaggctgaggcaggagaatctcttgaacctgggaggcggaggttgcagtgcgctgagagcacaccactgcactccagactgggcgacagagcgagactccatctcaaa

SEQ ID NO: 237425 - DNA, 634 bp, Homo sapiens
gtggcatgggcaaggccagctgattacacaggtaaccacaaggtggcatttactagatgaatttaccatgactcagagcctgactttcaggctggatgcctgggaacttggcttaccatattgagagtggctgcatctcacgaaggtagaaccttattaactgagggcatagaggcttctgtataaaatcagcatgcatgtgtactgattatcttgagcaggatgattgctggcattgacctgaccagggtgttctcctcccatttacatgacactcagaaaaccaattctctcattatagatttttcagccaattcgttttattccacaacagctaatcacatgaattgtgtgtggattttactgagctcacctgttagagaacaaacaatcttatttctaaattctcggagagaggtagaagccctctcctgtagcgtttatgtgctgattaatcagcatttactaagcctttaacaaacacctgtgacatgaccaggtagttcctgaatgaataaatgaatgcagatcgtgacgctagatagacggtagtgatgggaagtccagttgtggcaaagtagcatgtagacatgctccacatgacctgattattggaaaatgatttttcccctta

SEQ ID NO: 237426 - DNA, 2547 bp, Homo sapiens
  misc_feature (705)..(705): n is a, c, g, or t
  misc_feature (713)..(713): n is a, c, g, or t
  misc_feature (719)..(719): n is a, c, g, or t
  misc_feature (797)..(797): n is a, c, g, or t
  misc_feature (806)..(806): n is a, c, g, or t
  misc_feature (1011)..(1011): n is a, c, g, or t
  misc_feature (1834)..(1834): n is a, c, g, or t
  misc_feature (2010)..(2010): n is a, c, g, or t
cttcctgatggctcctggatgtcaggaagcaccacgccatttccagcttctcaggctcatggcttaaaaggaccccagccaactgttcttcccaagcaagcagacgggatttatggtggcggtttcttcaaagtgcttcttctctacccaaatccagaagcgaaacaaaacagaacactcctttaccttttcgaagccaggaaaaggaactcctcttattttttaaaaggcccaagagctgcaagcaaatgtcaacttcatcctgtggtttgatttacatgtttctttgggagaaagagacaaaatacagcattgaacttaaaaaaaaaaacttacaatgaactgttataactcagaacatgatgcacaaacccagatttaacaaacggagcaaaaaaaaaaaaagttcttctgagaggctcctcgtgtgaggctgtgcctgtctggcgaatcatcttggaaatggatgaggttaaaccaagggtcattgagtcccagcactgggattgtctgctccctgctctgaaaaaatggaaaagctacgtccataagaggcatggatgtctctagagctggccaaatatacaacgcttttttcgagtgcgattttccctaattgtaatattgtgcatgatcatgaatgaaaatttgggaaatggagaaaagtagaaagaaaacaatcccctgttcagagagaacctctgntaatctgncgtaantttcttgtcagccttttttccgtatattttaaaaccaaggtgctgtcatattgtagattatgctttgtattttttaanaaatttacnatggccacgatttttctttctacctccttcctcaacccgaaggtacctggattgattgacaacaccaccggtccagcttcatgaagccaggtaaccgggaagcatctgaccctgccttctccctctccccaaagcctgtgtcctcccaagccagtgtctttgcctcagtatctgtctaccagcttctctccatcccagtggccancaccccagtctgagctgctgaaatctctcacccaggctgggaaacagcctccacctggtctccttgcctccacgctggacctgtctacccattttccatgctgccatcagaaggagccttggagatgcaaatctcatcccagcacccttgatgaacacttccatgactgtggccgttgctcctaagataaagaccagattcctcctccaggaagcctccctgtctttacacacaaaatcccctgcttcaaagccacatgccactgactaccgctgctatttgtgagactcttgtttactccttccctgactctgggaaccactctgtctccagtactcaatcctgagcattcacttgagaacctcatttgttgatagaatgaatgagaaagctctcattgcacatccgaaaacatgatgttagggcggcattgtgactcccatgatgcatctctgaacacccacacaattctggcatctgccatcctaagtgctgaggacggtaccatcacccgcattttgttatcggagaaatagagctggttcttagtctaaagagagatactggggaaacagctgagcagaaagtaggactagagacagcagtccccgaaaatcccttcaggccttgcttcctgagctgggaggggaactgcggttgccaaaggcagccccggcccccagtgttcttctgctgcgtgactcccggcctgcagtgacgcccacaccctcccactcttatgattgtcgaattgtctattgtcaccactgactggtgagcgagccacccggggcagttttgaaagacagctggcgaggtaagntgaggccacagagccagcccggagacactggcagcatctaaactccctttccttgactacgctttggggctaggtccccaagtccctggaggcagtgcagaaattccacacgaaggggtaactggggtgtcaaacgggagcgcctgctgccactccaagctgggacccatctctgncgacacctcggggtgtccctgctgtattcggtgtccttttgtttcaaaaaaataattttcctcttagtacatggcaggtggtggggtttgttgctcttgaattggcaaagcaactagaggaaaaaccaacccacgccgtctggaagggaaggaactgtcgaaggctgagacttggattatccctccttagcatctgggaggcaggcggggagtgaagtgtctcatccgtgaagtggtcatcactctgatccacatcagtcccgttgtgatgaagtttgctgagcacagagccggtgatctggggactgcattgaattgaattgaattgattatcattttcttgagacaggatcttgctctgtcacccagtctctattaaaaatacaaaaaattagccggcgtgtcggtgggctcctgtaattcaacttgggaggctgaggcaggagaatcgcttgaacccgggaggcggagattgcagtgagttgagatcactgccatcacactccagactgaactataagagtaaaactccatctc

SEQ ID NO: 237427 - DNA, 802 bp, Homo sapiens
aaaggacaaagttcacagacacttaacatttatgaataattcaaatttaatatgtttggatattttactttaatagaaaagattgatgaataccagaaaccagtcagccttaatgcattctacattttggcttcccactgggtccccagtgttttaaattttttttctcgttaaaatttttatttcttattatttatttatttttccagcagtactgacattttggatatagttgaaatttttaaaatcagcatttccaccaatgaattgattataattaaagcttaagactgacaggcaagaggtttttttgttttgttttttcttttttgtgatggagtcttgctctgtcatccaggctggagtgcaatggcacaatctcagctcattgcaacctgcacttcccaggttcaagtgattctcctgccttagcctcctgagtatctgggattacaggcatgcaccaccacgcctggctagtttttgtatttttagtagagaaggtgtttcaccatgttggccaggctggtcttgagctcctgacctcaggtgttccacccacaagaggtgttcatttgcactcatactttcaaacgtgtctcagtgacaatcccttgttttctaagaaaccataacaaacactgaatttaattattaaagcagaaaaatggcattattaaataccgttattcaagcatggccaatattttttaaaatttatagattaacacctcagattagagggaactatttcagagccactaaaatatgtttgtattccttccctcatataaaacatttt

SEQ ID NO: 237428 - DNA, 191 bp, Homo sapiens
caccccacaacagtccccagagtgtgatgttccccttcctgtgtccatgtgttctaattgttcaattcccatctcaatcactcttaataaaagctgtcagcaaactagaaaatagaggagaattttgttaaattgataaaagtggatctaaaaaaaccctacagttaacatcatacatagtggtgacaaac

SEQ ID NO: 237429 - DNA, 431 bp, Homo sapiens
catacacagtgacacaagcttctccagcacatagtccacaaaatcttttttctttttctttttttttacttatttatttattttttgagacagggtctcgcgctgttgcccatgctagagtgcagcgttgcaatcatagctcactgcagacttgaactcatggattcaagcaattttcctgcctcagcctcccaaacagctgggactacaggtgtgtgccaccatgcctggccaatttttaaatgtttggtagagacacgaatcttgctatgttgcccaggctcaggatatctttttaaagttttttccttttatctttttttgcagggggaaggcagagtctcattctgtcacccaggttagagtgcagtgggaggatcacagaagcccaggaagtcagcagggcaatgagccataattgtgccacagca

SEQ ID NO: 237430 - DNA, 275 bp, Homo sapiens
cagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaat

SEQ ID NO: 237431 - DNA, 353 bp, Homo sapiens
attttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatttgtaaggttcctttgtatgtaggtatatatatgttgtatatatactgagaggcacatagacacatgtaaccatgcttttccgagcttaaaagcagtttatgacaaaatatagagtacaaccactagatggcgatgtttccttgtgaaaggatcaaactgcaatgtaatggaatatttggc

SEQ ID NO: 237432 - DNA, 435 bp, Homo sapiens
cctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcataaaatatattttttgaatattcagcatttgaggtatggtttagtgggtttatacaatttaaatggcttatataattatttga

SEQ ID NO: 237433 - DNA, 665 bp, Homo sapiens
ccttttccaggctctcttctgatgttttctcttagctggagtgttgcttgcagggtcactgactggtctgtcttacgtgtcagtcagccatagagaatagactatttatttatgatgaggcttctgccttcacacatagaggaaagaaaaatccagaggtgcactagatgtgagttttcttctccatttttcagttatgtcagttttcttctagctgtgatttgattgtgttatccaaattaatatttattgtttcccttgggaaactttggggaaggtggaaaggattaagaagctgatggaaagggaagtaaatttgggataaaaaatgaaaatcgttccaatgattctttcctcttcagtggtaaaatgattaaatcaaaatcttagcattcctgaggtcagattttcagtcttgcttttcttctcaaatgttccttggctaataccctgagtttattcaaagcagactgaatattatttgactatttttacctgagttgttttttaattcccgtattgtattatacagcttttcttttcctgagaagagaggagaaattttagttacacatttatttactttttggcacttaatgaaagattccagttaaaacataaccaagaaatctactgctataatcctgacccatcaccaaggaatg

SEQ ID NO: 237434 - DNA, 248 bp, Homo sapiens
aacactgtctcctcttcctatagctacctcccttcccaccttaatgctacctggacactctggatagataagccaaaagtctgattcttttaggaccgcacacagccttttctaggctatgcctggagaagcaggtcacaaggccaccccacattaccatgtctaaattttaatttttaagttacaaataaaactagcaaattcttatgttctatatttttaggttggcaaatatatcttcataatga

SEQ ID NO: 237435 - DNA, 417 bp, Homo sapiens
caaaaaaatgtttaaactttcatcttcacgttgggtgattgcagtcataaatttcacacaatgatcctgcttgtatcatagaataacccattttctgatgaacaggttgaatccaaataaattccaaacacgtgtataatgtagagttaaaacattttagactcaaagctcaaagctaattaagaaccggcatgggccacagtttgaaccagcaccaacttgtctttgctctgttattggtttgctgtctttgcctgttattccatatcacttgctggaaggaagcagccatactgaaatacaaattttgtttgtttcttttttaaaaaaggaaacaaatagatggtttattctaagaatgtacaggaacttatattctaaacgtccataaatgcatattctagggactcttatcat

SEQ ID NO: 237436 - DNA, 219 bp, Homo sapiens
cttgccccagaagatacacaatgaaattcatgttattgagtagagtagtaatacagtgtgttcccttgtgaagttcataaccaagaattattttagtagtggataggtaggctgaataattgacttcctatcattttcaggttctgtgtttgattttttttacatattaatttctttgatccacattaagctcagttatgtatttccattttataaatg

SEQ ID NO: 237437 - DNA, 494 bp, Homo sapiens
tattattggtttatcaatgaatttgatagagctaggatggaatataaaactcaaaaatacatatgtgaaggtagtttatgataaatgtggaatttcagatcatggtgaaaagaatttttcaatagtggtaggaccacagttttacagccatttagaaaaataaataaaatgcaattttaaaacgctagatccatgttttatgaaaataagagattcccctcccccccttttattttgagcatttactttagaaaacttgtaattatacatacttgatactatttctgaaaaaaaaaatacatccttttgaaacctaggaaagacttttttcagcttaatcatccaggaatatctttctcaaggacctggaagctgtctctttgaaatgtaaacatcaaaggagttagtaccctgcctgccagtttccgtgagcggataggagtctaacttgggtaggcacttccctccaagtggcaaaactacctcttgtcatt

SEQ ID NO: 237438 - DNA, 435 bp, Homo sapiens
cagtcccgtgagttcagggcaaagatcagtagagcttcctgttaataagtgggggaactcctggttcgtaataaagttgcaagaggtcgtacataacacaagtgcgaactgttaaccccagttgtaactaactttttaaaagtataggtatttggggctgggcaaggtggctgatgcctgtaatcccagcactttgggaggccgaggcaggtcatcacctgaggttaggagttcaagaccactctggccaacatggtgaaaccccatctctactaaaaatacaaaaattagggtgttggtggcacatgcctgtaatcccagccacttgagaggctgaggcaggagaattgcttgaacccgggaggcaaaggttgcagtgagccgagatcacaccagtgcattccagcctgggggacagagaaagtctccgtctca

SEQ ID NO: 237439 - DNA, 407 bp, Homo sapiens
aggaagaggatttgcaaggggtatttacaagtcacttcctttctaaatgttggatctcagaattcagagaaagagacaggaagtccagctcatagctgaggtattctcacaaatatgggaagtgcagaggaactgacgcttcttccaaattaacagacttgaaaaggcatggacgaaaaagtaataacaagagtagagcaggtgatttgcaggcgcccacagatgagggtgagcctgctcactgcttcctcttcccctccacagctgcaccgttaccgggaccatttgcacactttggtaaggcatagaccagttccctggtagcagcctggatcctccattcaaacaggaaaatgcaacataaagggggaaatcattcaggcaagacatgtactttgattttcttt

SEQ ID NO: 237440 - DNA, 482 bp, Homo sapiens
agttgtattgcaaggaacagaaaccaactctagctgacttagccaaagggaagtgaatggaaggatggaggaagtttgcagaatcaaaggaaaagccaaaatgtcagaaatcagaagaatgtcacaaatctggataggaaaaaccaagggatagcaaggctccattgtcacgatggttgatgtgggctgtaaacgtaggccatccctgaacactctcaccactcagatcccgggaaggagtcggctctgctgggcacgtgactctgctcggccagcccctggtcgggaagatggggcctctgaattgagactcacaaaagaaaacatggaaccagaggaaatggtttctcagagaaagccagcaccaaaagaagggaaagtgagatgttgccaggcaaaaaaaaaagatgtcatggataaggaaactacatttttccaactgaaaattggggtagaagcacgtgtaataccattgcttgttc

SEQ ID NO: 237441 - DNA, 538 bp, Homo sapiens
ccagataagggtggaggtgtcagttcttaccagccaacacctacagcagctagggtatgggtgcaccagtcctgtgaaaggggtctgggtaagtcaccaacagcatctactgcaaatgaggatattaaaagtacatagccgtaggattattgagaggattaaattaatgaatttttaaaaggcgcttagtgtgcctgggccaataaatgttagcagagaccaggccttgtaggccatggtgaagagttttgattgagagatcattctggtgattgtatagaggaaacaggagaaaggcaaaaaagcaggaatactagttgggaagcttttacaaatgtcgagtcatgagcaggtggcagcttggacctggtcgatggagtctgaagtggtgatttatagcttgggggaactagagcagggttcatggagggggaaacatttaagctgggcattgaatgaagattccagagggaaccatggaaaaaggaaagcacaggtgacctgccttgaacagtgagttgtcaattaatgtgataat

SEQ ID NO: 237442 - DNA, 669 bp, Homo sapiens
accccccccccacacgcccactccctctctcatgtttaatctcttctctatttccattatcagagcccagtcagatcttagtactttatatctaggtcctgactcatctctagggctccaggcagcctctggtccatttcattctgcatgttgtgctagactagcaatgctctttttgtgccaccctgaacatccctctcctgcttaaaaacattattttccttttccttgctttttcatttttatctttcttcttttcatcactttcttctaaatgctctatctcttatctcctcattatttctcaaactttctccactcacgcccagttagctttcttcttgcgcaagtacgctacacttattcacttctgctcattctcacttctgggcccgagcttctatttcctttgccaggaattccccatccctaaccctctgtgcttatccagagttcatctctttttctgtgtgttgtgctcaagctatgataaacttcaattccacagacagtgtcctgttttccactccctacctcactttgtttgccaagatgtccctataatccctgattggcctgttctttatctaagaaggaataaggagtgctctgtattcccacagcaacttgcacttacctcagttatatgttacattttcttaattattt

SEQ ID NO: 237443 - DNA, 247 bp, Homo sapiens
tgttcattaaaacattataaaagaaaaaaattttaatagcataaatatctcaaaactggcaattgataaaataattgtgattacatgcagtgtaatatgttgtcatgaaacatgcaataaaataatgatgtggaaagacgattatgatgtaatgttaaatgaaaaagacattacggaatagaatggattgtgtatttattaaaagcagaataatgtatatatgtaaggggatgagaaggatatagat

SEQ ID NO: 237444 - DNA, 551 bp, Homo sapiens
gtgctctggaaatgtgaagctccattcctgtctcttgggacctggaatggactgagacattctctcaaaaactctctaatgttgccttaggctttttcacaaccacttcaggtccacttctcgattttccttcttacccctatcggtgagtaaggtacccaagtcacagaaagctgatatttgccaaaaggatgtcagcagaggtggcctttgacccagttctcctgccctgttgaagactcttccagctcacaggagctgggtgtccaaaagtatagactgcctggattcaaatccgagctttgtttcctttttactgtgtgatgctaaacaaattacttcacttctttgtctcaatgatgtcatctgtaaaatggggacagtaagtccacccgataaggtagttatgaggatttttttaataatgttgttagtttttattaagatgattatttgctggggaacagagatgtgactctcagaaactcctgagaatgtttgccctcctcagatattactctctgcagccctggcttgtggctccctgcttc

SEQ ID NO: 237445 - DNA, 2217 bp, Homo sapiens
  misc_feature (841)..(841): n is a, c, g, or t
  misc_feature (859)..(859): n is a, c, g, or t
aatcttatgtcgtgccttatatatttttacaaaaagtggtatgtagatacaaatgaataaatgtaaccacttaattattttgaaaatatccataagatttagctgtttttgtatggttgatatgtaagaaatttggtttgttttaaccatttataggtaggaaattatcctaaaaaataagatgcaagattatgtttcggtttcttcctcccaatacatttttatgtccccatttgatgaatttttctaaattccatttgcacacttaaaagttctaaatcattgcatatgttgtattgaatagaatgtgaatttctcagcaagatattaggtcccctctaaatgtaatccaaattgatatcatttctatcgatttctgcaaattaaggtattctctggaaaaattagattatttggatgcttcatgaacaaaataatctgtatcttcatcatatctaagattcttctatgacttccaactggaatattcagaaaatgatcacattacaaatgatcactctagcttccatgccactttcctgaaatgttcttgccagtgagaaatcatcacttcttccttggaatttctaaatattttattgttcaaaggcgtaattctttactaagttgtaaactcattgagataaagaactatagtctgtatatctgtttgtctcagaaagtgttttacacatagttaggttccaatatacatgtaatcaaataaataaagaaaatatgatttacaaaaatactaaagaatggtatgttgcctaccaggtcaaaaagaaaaagaaatactaaaatactaaatattaatattaaaatactaaagaatagnatgttgcctaccagttcnaaaagaaagaatcagataattttatttgccatagataagcaatattgcttgctttattttgggtaacaagctataactggcttgagtcatgtaaaaacataatatatgcaagttttactacaaattaattgttaattctaaatttgggggcacattttaggtagggtaaaatgacgattttgttgttaacacattttcttccctaaactcttttttaaaaacctccattatgtttgatccagtctgttggttgaagcacaatctgtactgcttcaattacttaggatgaaattagccacatcattattaacaccagctagaaattttggaatgattattaatggtagcacatgaagcagaaagaggaccagctgaccctggtggagtaataaagttaattaatcaagcaggaggcagatttcatatttatgagtctacccagaggaggacaaattccagtatataagactttaatttaaagtaatctccagtcaatagcacactttcaacattggcagccatagccatctaaatgcaaacatcagtgggaaagaggaattttctagcagttaggttgtctgaatataaagtggcctgtcctataaggtagcgaaggcccctcataataagaatttgtgctgaagctaattgggaacctgtttagcatgtggtaaaagaaatccctgctttatttaggaggttgtgatacaagtttaacgtaagttcaaacattgagatttcataacaacatatttgtgagttctaattatgttccaatcacttttttaaaatcttttctggttaccaaaacatgtatagcctttgcagaagatactattatgccaattttacagatcaagaaagtaaagcataatgaagtatagtaacttaacagtacccacaggtagtaagcattggaatggggttattatggcattaggcccttttcatactaatgcttagaaccaaaattgagttccctttctacccattcagtactttcacttttctttttcaccttagtcattatttataattttctacatgactattttttattattacctccaattcgtcaccctcccttaattacttacattttgccttagcataatgtctttgaatataagcggattttcagaagactatttataaatctcagtgcatcaagttcacagagctgtgcagtgttttaatgcatatttctggattaatgtacacatggtagaccaagtataacactccaaagaggcaaaataatgcagttagtgtgatttacttaaatatgcagggtcctgatgaagagtaactatttgcacagaaagtagaagtcgcccttcaagagagactgaattgac

SEQ ID NO: 237446 - DNA, 1514 bp, Homo sapiens
  misc_feature (680)..(680): n is a, c, g, or t
  misc_feature (682)..(682): n is a, c, g, or t
  misc_feature (1079)..(1079): n is a, c, g, or t
  misc_feature (1120)..(1121): n is a, c, g, or t
  misc_feature (1128)..(1129): n is a, c, g, or t
  misc_feature (1152)..(1152): n is a, c, g, or t
  misc_feature (1174)..(1175): n is a, c, g, or t
  misc_feature (1179)..(1179): n is a, c, g, or t
  misc_feature (1181)..(1182): n is a, c, g, or t
  misc_feature (1184)..(1184): n is a, c, g, or t
  misc_feature (1202)..(1202): n is a, c, g, or t
  misc_feature (1208)..(1208): n is a, c, g, or t
  misc_feature (1218)..(1218): n is a, c, g, or t
  misc_feature (1221)..(1221): n is a, c, g, or t
  misc_feature (1226)..(1228): n is a, c, g, or t
  misc_feature (1230)..(1232): n is a, c, g, or t
  misc_feature (1234)..(1234): n is a, c, g, or t
  misc_feature (1237)..(1237): n is a, c, g, or t
  misc_feature (1259)..(1259): n is a, c, g, or t
  misc_feature (1266)..(1266): n is a, c, g, or t
  misc_feature (1271)..(1271): n is a, c, g, or t
  misc_feature (1279)..(1279): n is a, c, g, or t
  misc_feature (1282)..(1283): n is a, c, g, or t
  misc_feature (1286)..(1286): n is a, c, g, or t
  misc_feature (1290)..(1290): n is a, c, g, or t
  misc_feature (1311)..(1311): n is a, c, g, or t
  misc_feature (1343)..(1343): n is a, c, g, or t
  misc_feature (1372)..(1372): n is a, c, g, or t
  misc_feature (1378)..(1378): n is a, c, g, or t
  misc_feature (1383)..(1383): n is a, c, g, or t
  misc_feature (1392)..(1392): n is a, c, g, or t
  misc_feature (1404)..(1404): n is a, c, g, or t
  misc_feature (1407)..(1407): n is a, c, g, or t
  misc_feature (1411)..(1411): n is a, c, g, or t
  misc_feature (1422)..(1422): n is a, c, g, or t
  misc_feature (1430)..(1430): n is a, c, g, or t
  misc_feature (1432)..(1432): n is a, c, g, or t
  misc_feature (1440)..(1440): n is a, c, g, or t
  misc_feature (1451)..(1451): n is a, c, g, or t
  misc_feature (1462)..(1462): n is a, c, g, or t
  misc_feature (1469)..(1470): n is a, c, g, or t
  misc_feature (1487)..(1487): n is a, c, g, or t
  misc_feature (1493)..(1493): n is a, c, g, or t
  misc_feature (1501)..(1501): n is a, c, g, or t
catgctctctgctgatgtttaccttcacatcttctatctccccaggggtttctcacaggctttatgtcagtttcttggatgcatcaccttctccctctcaatttcgcagtatgtgggttgggagaaggttccagttgtccttgtccgttctccattttctcatagctgaaagtttttaatttatcttttatgtaattatatatattcatatcaccatccatcaagctggtttttaaaactgaaaattatttcatatttttaggaagctactcgattgcatgtatgtaaggccagctcattttaatctcatattaagttaatcaagtaaagacctttataaaaaagaagattttgggctgggcacggtggcttatgcctgtaatcccagtactttgggaggccgaggtgggtggatcacgaggtcaggagatcaagaccatcctggctaacatggtgaaaccctgtctctactaaaaatacaaaaaattagccaggtgtggtggcgggcacctgtagtcccagctacttgggaggctgaggcaggagaatggcgtgaacccaggaggcaaagcttgcagtgagccgagatcgcgccactgcactccagcctggggaacagagtgagactccgtctcaaaaaataaaaataaaaaaacaataataaagaagattttgggtcngncgcggtggctcacacctataatcctagcagtttgggaggccgaggtggtggatcacaaggtcaggagattgagaccatcctggctaacatggtgaaaccccgtctccactaaaaatacaaaaaattagccaggcgttgtggcgggtgcctatagtcccagctgctcgggtggctgaggcaagagaatgtcatgaacccgggaggcggagcttgcagtgagtcgagatcacgccactgcactccagactgggtgacagagcgagactccgtctcaaaaaaaaaaaaagaagattttgaattgtaaggcaacccacattgttaaacttcattttattttatttttatttgaagtttttatttgtaaaaatatagaaacagggtttcaatatgtcacccnggctgatcttgacctctgaggcaggagaatggcgtgaaccnnggaggcnnagcttgcagtgagccgagatcgngccactgcactccagcctgggnnacananngngactccgtctcaaaaaanaaaaanaaaaaaacantantaaannngnnntnggntgggcgcggtggctcacacctntaatccnagcantttgggangcnnagntggnggatcacaaggtcaggagatngagaccatcctggctaacatggtgaaaccccntctccactaaaaatacaaaaaattagccnggcgtngtggngggcgcctntagtcccagctnctngggnggctgaggcangagaatgncntgaacccnggaggcggagnttgcagtgagncgagatnncgccactgcactccagnctgggngacagagngagactccgtctc

SEQ ID NO: 237447 - DNA, 468 bp, Homo sapiens
ctttttgtcttttgtaacttgtaagagaacaagattgaaaaaggcaaagaacatcttagtataattttgaaaatagtttttaccttgcagactccctgaaaggttctcagtatcccctagggttcccagatcacaatttgagaatcattggtaatatggtttggttctgtgtccccacccaaatcttattttgaattgtaatccccacatgttggaggaggggcctggtgggagacgattggattacaggggcaggtttcccccttgcttttcttgtggtagggagtgagttctcacaagagccgacagttttaaagtgtggcacttcccccctcattcactgtctctctcctgccaccatgtgaagaaggtctttgtttccccttcaccttccgccatgattgtaagtcttttgaagcctccccagtcatgtggaactgtgagtcaaataaacctttttttttcata

SEQ ID NO: 237448 - DNA, 465 bp, Homo sapiens
aggagtgctactctgtgataggctgcactcatgtgatgattactgtattgtgcatttgctgattcttatgatgtacagactttccaaagctcagctgctttataatgtccaaattaataccaacagcatttctgggaagaggaagggaactactgtgacatatggaccaaatctgatgattcacataaaactcatcatcattattttacctcctttgtccccttctagtcctttaagaaataagaatcaatcattgtcacattgtctagttatttatgctgtacttacccaaaaaggtaagtttacatctcatgaattttgacttattgagaagaaatccaatctcagtcctggattgagactgttcttgttgttaattaatgaaaactgaattatagattgttttgtacaaaaagtgttattgaaagaaatgtcacactaaaaggtatatcaaaagccttgaaa

SEQ ID NO: 237449 - DNA, 524 bp, Homo sapiens
gggacacttctgcccttggggtctctcatctccttgtcttagcaacctctagcagaggtcctgaattttaaagacgttctctccccttcacctctcccctcctctgcaccctcttctaacatacactctaagcagatcctgggtctctgaattacctctccagtctcctccagccattcccaggcagtggttggggacctagagctggtcagccttaagtcaagagagcctcctacccagacccatgtggcatctgtcccttctccctaacaaatgtgaagtgcctggccaagggccagatgtgtaataggtgctcaatgacattataatcttataaaaatcttcctaagccagatctcaagtttagacagcagggttggggggtggagtggaagaggctgggagcctccctgtggctcctctgcatccatggaggattgaggagctatgtgtgcttggcaaagggcagggggaactgtaatgcttttgttcagagctggtcattaaaggtaactctggaaacc

SEQ ID NO: 237450 - DNA, 598 bp, Homo sapiens
gggacacttctgcccttggggtctctcatctccttgtcttagcaacctctagcagaggtcctgaattttaaagacgttctctccccttcacctctcccctcctctgcaccctcttctaacatacactctaagcagatcctgggtctctgaattacctctccagtctcctccagccattcccaggcagtggttggggacctagagctggtcagccttaagtcaagagagcctcctacccagacccatgtggcatctgtcccttctccctaacaaatgtgaagtgcctggccaagggccagatgtgtaataggtgctcaatgacattataatcttataaaaatcttcctaagccagatctcaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaacactgcggaagccagcagggtcctctgcctaggaaaaccagagacctttgttcactgtttatctgctgaccttccctccactagtgt

SEQ ID NO: 237451 - DNA, 652 bp, Homo sapiens
gtgtgttcattactacaactccacactgtgtgccatgtgctcatctctgtcactgcatcataagctcctggaggccgggagttgtatcttatgtatcctaggcttggcacaaagtggggactcagttgtagatatattttaattcactattaagtagcactcttgaggagtgttctctttgacttctaagaagaaattaagtactattgccattgcctggttgtattttcctaatgtgtacttattttatagtcattatttgtaagcaatgccagaccctatataagacaggcagcaagatctaattctttgctggtgtttcttttgcaatagtaaatctgcaagcctctgtagagtcacattgaagatctctgtcacaggctttcatgatcaatgccctgtgaacgtctctagacatctttctaaagtgtataagcatagtcatttttagaaaggatttgggatgattatatcttatattaccattgtctgcactcaagaagtattggactcaattatttattattaataacaatattacttctaaagccataatcattaagatctgtatgtgtctagcacctttattcacatgctcctccaaagaatggagaggtgcttttgccaggagttacttcatatagtatatact

SEQ ID NO: 237452 - DNA, 156 bp, Homo sapiens
cgcatgcaggtggtttatggagaagaatgtgaccaatgagtcgagtattcttgatggccagttggatggatcctctgaaagctgcaatccccattgtgtgtagcagctgcagctgagccaagaacagccaaggttgaggatggggcagggaatcca

SEQ ID NO: 237453 - DNA, 399 bp, Homo sapiens
gtgaggaagcgtgtgcggcggcctgagtccccaggcctcccctagagtgctcacgcgtgtgggagcgagtagacgtgaggaagcgtgtgtggtgacctgagtccctgggcctcccccgcagtgcgccaggatacattcagtatcaaaatgcccacagagaaaactacattcttcaacatttagataaacaaatcttttcttagtaaattttatttatttaaaattacaacagggtgggtgcagtggcttatgcctataatcttagcagtttgggggctgaagcaggacctcttgagcccaggaattccagaccagcctgggcaacatagcaagaccctatcaccacaaaaaaaatttttttaattaaaattgtacaatcacaacagtattattttttcc

SEQ ID NO: 237454 - DNA, 1795 bp, Homo sapiens
  misc_feature (1189)..(1189): n is a, c, g, or t
  misc_feature (1287)..(1287): n is a, c, g, or t
gaatgtgagtatagaagacgagtccaggcaccaggagcataatagcggtcagagaaccaagtccaggaccccaggcagattagctagagttcaggcagggtgtcagcgccagtggggaagaaagaaaccaaggagctggaataccgtctgtaagttgagacagaaggatagccatatggcctggaaaaagatgacaagtttgaggaaatagtttgcatgtcagagggaacactcgagggaccctggccagagggagggatatatccagacaccccatgtctgagtcaggataggctcaaaggttgcccagcactggacatcttcaaagatttttattactgtttattgcgtcaggtgaaatcaacaacagctaagaaaaaggagaaacacattacaatgtaactagtataaacagtggaaaatcactgtggtttgaagaaacaagtttaactaaagaaatctgaggtctgtgtctcctaaagagaggtgactgtggaacagtaacacagaatatcagatttcaatcttcatgtttctccttttgatgggcacacaatccaaattcgagattttaaggtcctgcacaatttcgtttcacccacgtgtccttccttattccccggcccctttcatgagacgtgctcccttcctcctccagtgccttaatgcagcttctccagcttccgcagctctttactccaatcccagccatctgggctcacttcagatcacaccttccctatggagatgacaaaatctgctctactgtaatgatgctggcaaagcttaattgttcttcacttatttcatggctgtttgttttatcttcccagctaaataaattgcagttcttttgaaagaaaggatcggctgggtatggtggctcatgcctgtaatcccagcactttgggaggccagagcaggcaagtaacttgagcccaggagtttgagaccagcctgggttgcatggtgaaaccccatctctacaaaaaatacaaaaattagccagacatggtggcgtgtacaagtagtttcagctacttggaggctgaggtgggaggatcacttgagcctgggaggcagaggctgcagtgagccgagatgtgcaactgcactccagcctgggtgacagagtgagatcctgtctcaaaaaaaaaaaaaaaaaaaaaaaagatcatgtcaaaagttnccttgtttcctttatatctttcacagtgctcagaaaagagctggtcaccaggtggctgctaggtaaacagaaatcgattgattgactcagcctgagtntatgtattcaaattcacatttcctgaattagcagacatggtcttgtttttaaaattgactttataagatctcgtgttttcttatatctgatggtgatgaaaatgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctc

SEQ ID NO: 237455 - DNA, 424 bp, Homo sapiens
ctggaccctccctgccatctggatgcctccactagagaatgtgctactagcaccaggaaagagctagaggctgaagaagctgagtagaagctctgctgacccaagaacatggccctccttttttgcctcttcagggtctaagtctatggatgctgactacccccccgcccatcccacccctaatatctgcaactgggaacttttcccatttgctgggaatgatggtggggctctttctgcctctgcctgccatagaaccagcaagtcttagacatcccttctttttatgcccttggtccatggggtctttgttaccagaaaggggtcccaatccagaccccaagagagagttcttgcatctcacacaagaaagaattcggggcaaatccgcagaataaagtaaaagcaagtttattagagaagt

SEQ ID NO: 237456 - DNA, 1532 bp, Homo sapiens
tattcttcaaaaatggagcaataaagactctcctagatattcagaagctgtgggagttcatcaccactacacctgccatccaagaaaggctaaagggagtccttcaagttgaaatgaaaagacactaaacagtaacacgaacagggaagtataaagcttgctgataaaggtaaatatatagacaaatacagaatactgtaacactgtaatagtagtatataaatcacttttaattctatagaatttaaataaaagtagagtatctataactataaaaatatgcaaatggatacacagtataacaagatctactttgtgacataaataatataaagtgggtgggggtagtgatagaatagtttttgtatgcacttgaagttaagttgttatcagcttaaaatattttgttataattgtaaaatgttttgtgttagccccatggtaaccacaaagaaaatacctttagaagatacaaaagaaaatgataaaggaatcaaagcatgtcactaaaaaaaaaaaaaataaatgaaaacagaaaggaaaactgcaagagaggataagacagaaaacaacaaaatggcaatggtaacttcctctctattcaaaattactttaaatgtaaatggattaaactgcctaagcaaaagacacagagtggctgaatgagttttaaaaataacatccaactatatgctgtctacaagagattcacttagatataaggggacacatcagctgaaagaagagggatggaaaaagatacttcatgcaaatggaaaccaaaatagagtaggagtagccatacttttatcacacaaaatatactttttgtcaaaaactgacacaagagacaaagaaggacattacgtaatgataagagggataattcaccaggaagatatagcaattgtaaattgttatataaatgtacccagcatcagagcacccaaatagatgaagcaaacagtgacagaactgaagggagaaatatgcagcaagacaataatagtaggagatttcataccccactttaaataatagaagagacagaagcttggtaaggaaacagaggacttgaacaacactacagaccaaatgtatctaacagacatacaaaacaccatacccaacagctgcagaatatacattgttctcatgcacacataggacattcttcaaaacagatcacaagttaggtcacaaaataagtcttaacaaatttaagaagattaaaatgggcatggtggcccacacctgtaatctcagcaatttgggaggctgaggcgggtggatcacttgaggccaggagttcaagaccagcctggccaacatggtgaaaccccatctctactaaaaatacaaaagcctagccaggagtggtggcgtacacctgtactcccagctactccagaggctgaggcaggagaattgctgaaacctggaaggtggaggttgcagtgagccaagatcacgccactgcactcctgcctgggtgacagagtgagactccatcacaaaaaaaaaaaaaaaaa

SEQ ID NO: 237457 - DNA, 248 bp, Homo sapiens
gaaatccacccaaatatatcacagttgaattcccttaagctaaaggcaactggtctctaacttaagaataagtgactatagaatcaggtgtctctctgcctagacctgtgcttttcctccttgaacactgcaagtgatgagtaaggattccctttaaatggacagcagtgctatgttcctagtatcttgagctggaacttctgaaccttctgaacccaatctattggttatttatttttttacagtca

SEQ ID NO: 237458 - DNA, 242 bp, Homo sapiens
gggtagcccaagaaaaatccaatattaactagtcatgttataggtcctaggtgcagatttgattttgaaatttctcacggccatatttatttgtgactttatattattactgttaagcattgagcccttaggtgaagcctaatttcttcaatggttaagaggccagggtcaacagggaactggtaaagaggcatcagggtaaggcagaggcagcttgtcttccattggtacatatccaattt

SEQ ID NO: 237459 - DNA, 2532 bp, Homo sapiens
  misc_feature (211)..(211): n is a, c, g, or t
  misc_feature (226)..(226): n is a, c, g, or t
  misc_feature (636)..(636): n is a, c, g, or t
  misc_feature (2280)..(2280): n is a, c, g, or t
tgttttataggctctgttcatttttttaattgtgttaaaatatacatgacataaaatttacaatcttaactatttttaaatgcacagtttagtagtgtcaactacattcacattgtgcaaacaatctccagtactcctgtaattctgcaaaagtgaaaccttatacccattaaacaactgcccattgccacctccccctccgcccagtccntggcaatcaccattntactttctgtctctatgaatttgactactctaggtacctcatataagaagaataattcagtgtttgtattttttgtgattggctttttttcccttggcatcatgtcctcaggatcacccatggtgtaccatgtgtcagaattttcttccttttgaaggttgaataatagtccattatactaaataccataggttgtttatctactcatccattgatagacatgtgtgttgcttcctccttttggctattgtgaataatgctggctattgtgaataatgctgctactaacatgggtgtccagatatttcttcaagatcctgctttcaattcttttgggtatatacccagaagtggaattgctggatcatatggtaattttatttttagttttttgaggaaccactgttttncatagcagttgcaccattttacttttctatcaataatgcacaagagttccagtttctccacatttttgccaacgcttgttattttccagttgtttgctttggttttttgctagtagccatcctaatgcatgtgaggtggtatcttgtggttttgattttcatttccctaattaatggtgtttagcattttttcaggtgtttgttagaccatttgtatatcttccttggagaaatatctactcaagacctttgcccatattttaattggttgtttgttgttgttgcattgcagttctttatgtattctggatattaaaccctgtctgaaatgatttgcaaatattttctcaagttctataggttgccttctcactctgttgattgtatcctttgatgcacaggagttttaaagtttgatgtagtccagtttatctattttggctttgttgcctgtgcttttggtttcatattgaataaatcattgccaaatccaatgtcttgaatattttcccctgttttattctgagagttttatagctttagctattgcatttaggtctttaattcattttaagttaatttttgtatgatgtgtaagggtccaactttattcttttgcatatggatatccaatcttcccagcactatttgttgaaaagactgtttccccactggatggtctcagcatccttgttaaaaagcatttgactatgtgtggggtagtttgtttctgagctctctattctattcctttggtctgtaggtctgtctttacaccagtaccatactgttctgattaccgtatttttggaataagttttgaatttaggaagtatgagacctccaaatttgttctgtttcaagattgttctcattatttgggagtgcttcagattccctcaattatatttcaaaactttttgcttagaagtcatgcctatatgtcaacctacagaatgggagaaaatttttgcaatctactcatctgacaaaggctaatatccagaatctacaaagaactcaaacaaatttacaagaaaaaaacaaaaaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataggaacacttttacactgttggtgggattgtaaactagttcaaccattgtggaagacagtgtggcaattcctcaaggatctagaaatagaaataccatttgacccagccatcccattactgggtatatacccaaaggattataaatcatgctgctataaagacacatgcacacatatgtttattgcagcactattcacaatagcaaagacttggaaccaacccaaatgtccatcaatgatagactggattaagaaaatgtggcacatatggaccatggaatactatgcaaccataaaaaaggatgagttcatgtcctttgtagggacatggatgaagctggaaaccatcattctgagcaaactatcgcaaggacaaaaaaccnaacaccgcatgttgtcactcataggtgggaattgaacaatgagaacacatggacacaggaaggggaacatcacacaccagggcctgtcatggggtggagggatgggggagggatagcattaggagatatacgtaatgtaaatgacgagttaattggtgcaacacaacaacatggcacatgtatacataacaaacctgcacattgtgcacatgtaccctagaacttaaagtataataaaataaataaataaag

SEQ ID NO: 237460 - DNA, 292 bp, Homo sapiens
acagccattttcacccaaaggacttccattctgcctctgaaatcctccctcccttcaatcctccttgaagccctcggagatgacctacaccaccctggctctgggtgccggctgggcgcacacatctgaaggctctatggcatctctcatattctaggcggagacatccaagccagtgtattgaaggcagagagaggcacgctggcacgtggctgaatccataccctggaatattttggcttcaagtgccctagattttctaaatgtaaaatattaatctgattatttaaaa

SEQ ID NO: 237461 - DNA, 2259 bp, Homo sapiens
  misc_feature (363)..(363): n is a, c, g, or t
  misc_feature (1437)..(1437): n is a, c, g, or t
  misc_feature (1613)..(1613): n is a, c, g, or t
  misc_feature (1739)..(1739): n is a, c, g, or t
  misc_feature (1768)..(1768): n is a, c, g, or t
  misc_feature (2089)..(2089): n is a, c, g, or t
  misc_feature (2207)..(2207): n is a, c, g, or t
tgtatatctatgtatcaggcaatgtactaggcactgcgtttgttaccaagataaataaaaatttatattaagatgttcaaaatttcctaggaaacacagacataggatagctataataagagaagtataaacacagccacaggagaatgggggtggggggaccgaagtcatttgcctaaggtacaaaactagcaattggaagatctgggacttgagatctgggtcttctgaatctagagtaagtcctctgtcttggcacagcaatataaccctcttagcttttccagagaaataaaaacaaaactgaaaaatattcactcaaaaacacatgcataaattgccaagtgggccaagtataaaaanactgtggaagcggtgatcaagaccaggatatgaaaagagaagataagacctggcagacaggaagacaaagaggcctcttccaacccaccctcgggctgttcttgggtttggatagttatgttaagatccacgcccccatagcaatctgactttgagttggaggcacaggaaacatgaatctcttgcggttaggctaagtcccttcaaatgcagcccaggtttcacctcccgttgaggccgggtgtgaggaattctccatttaggaagacgggtcttaggcgagtgggaggaactgcctaacaacagttgaagtaaatatgagggaagacacagcaaatggccagcttctctagcattcaaattcctccggtcagcaatttcttgcctcccttcctcccccaaatctgggtggaaatatgaagccacagttcactcccccgtcactcattctgatgacaaaaaagaagttgattccagcctatcatttcacagctgtttgcttccacttcccagcagacatgctctttgccgagggacttggttaaatggctctgagagaggcaccttcaggcagctcgggctcctggtggaggagggaagcctggggactgcagcccagggacgaggccactccctttgtcctttcgggcagggagggagtaatgggacccgtgccagtgatataaagtactcattttccactaaggccagggctttgtcctgggaagaaggagcaagaggtaaacacgaaacctgatttgcctgtgccatgtggaactacagaaccttgatgttgtccgggccactcctcccttcctttccactccttagcaggagaggctgagctaaaaaaaacccctgcttattcccatcctgtcccggtgcccctgtctacagccacagttgattggaccagcgtggacacctgacccaggctgggccaatcacatcctctctcctgcaaacgtggaaatggcgcctccaagaccctgagccgtgccaaactggagattcttcaccttcgctctatgttgaaattgcccaggaattctgaaaacactgtctatgaaaagngtcaaactctaaaatatttagagatttattatgagccaaatatgagtgaccatggcccgtgacacagccctcaggaggtcctgagaacctgtgcccaaggtggtcctggcacagcttggttttatacattttagagaaccatgagacatcaatcaaatacatttaaatacattggntcggtccagaaaggcgggacaactcaaaggtggggagagggatggaggggaaggggggacttccaggctacaggtgaatttaaacattttccggttgacaattggttgagtttgtctaaagaaagncctgggattcatagaaagggaatgttcangttaagatacagattgtggagaccaaaattctttcaaagtcttatagtggctgcccttagagacgatagatgacaaacgtttcctattcagatcttagttaatctctttaggtcaggaagaaaaagacctagctatgttaataaagtttctttacagatgcaaattttcccccacaaagaacagctttgcagggccatttcaaaatatggcaaagaaacacgttttggggtaaaatattttgattttctactttgtctcttaatgttatgccagaatcaggttggaaagtaagccagagtcaggttggaaagtaagtcacnatatatagggttaaataaaactcatcgatgagaatttataatttgtagggcatgactccccagactccttagataggaatttgggcaagataaaaaaaaaaattagaatttagtcctnaacacaccacacacacacacacacgtgcgcacgtgcagtggccaggcatggt

SEQ ID NO: 237462 - DNA, 638 bp, Homo sapiens
  misc_feature (582)..(582): n is a, c, g, or t
cagtggaaatgtactctctcacagttctggaggccagaagccccaaaccaagctgtcagcaggcccttgctccatctgagactcgggatggaatccttccttgtctctttctagcttccagtggtgggcggcaagccttggcattccttggtttgcagacacatcactgtaatcgctgcctctgtcatcacatggtgttctccctgtgtgtctctgtctgtgtctcttcctctcttcttataaggacaccaatcatattggattcagggtccaccctccttcagtatggtctcatcttaactaattatgtctgcaacggccctatttccaaataaggtcacattctgaggtacatgtcttttggggggatataattcaacccataagatggttttgttgccctgttttacagatgaaaaaactaaagttcagggaacaattgcctgaggcccaacaactagtaaagtgactgtacatggtgcttctcattctcattaccactactcaggaggctgaggcaggagaattgcttgaacccaggagacggaggttgcagtgagcccacacggtgccactgtactncagcctgcgtgacagagtcagacttccgtttaaaaaaacctatctttaattaaaaa

SEQ ID NO: 237463 - DNA, 353 bp, Homo sapiens
gaaatgtatcaagtacttccatcttaattcacgtattgttggtagctttaagatatacagagaggcattttagcataataattatacttacggattctggaggcagtgtgctgaaatttaaatcatgatcaacttatttaaactctctgtcctatttttctctaatagaggagtgtcaataaatgagaaaaactaagaataatagataaaaaagacaaagtatagtgcctgggtcatattaataatgcaatatatattaactatttttattataatggtttcccaaagtctttgtttttgtaggcacccctttctcctgtattacaaatcttttgtagaatctcttatctcag

SEQ ID NO: 237464 - DNA, 344 bp, Homo sapiens
ccgaagtctgtcctcccaccagctctgtgatttcgggtcatggtgtctgtgcatcagaagctccaatgtcctgactagtatcttgtgtgtgtgtgtagagagaggggtggcagacaacctgcagctgggtttgcatcctcaggaggtaaaagccctgtcctagcccctctccttgctactgagacagtgggggcttcccgccctagccaggctacccactaatctccctcctcaatttctattaaatgcttccctggctctccctgggtttcagtttctatccatgccctgtgagcaaaaagtcatgtggattccactcctgaggtgcctctcaggcccattta

SEQ ID NO: 237465 - DNA, 401 bp, Homo sapiens
gtgcgatcctgttggctctggactcctctctaaagctatgcttccttccaatctcagctctaccctccctgcgaggtttgtgagtagatagcccaaatcctttgcccccacctccaccccttcctcccctcattctcttccatcctcctggttctgcttcttgtttcctgattaaccttgggcctgtgacttactgatgtctggtttatttattcattcattcactggggaaatatgtttaagatcttggtcacaaccagtctcactgattcttctcctctctttattcatactgttttccccaaacctttttttcttgaatatacttcttagcttacatctcagcactcacccatcttgttcaagccacctccgtcttctacaagatagtttcctttatg

SEQ ID NO: 237466 - DNA, 891 bp, Homo sapiens
agcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctccca

SEQ ID NO: 237467 - DNA, 729 bp, Homo sapiens
agcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggctgcttgccccctgctcacctggcttcttgaccccca

SEQ ID NO: 237468 - DNA, 305 bp, Homo sapiens
ccttcctggacctgtcagagccttggaggaggtggggccccagagacaccccttctctagtacctcccctctccagtaagcatctcgttttgtggttctttctctcaggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagcaaaaacg

SEQ ID NO: 237469 - DNA, 1811 bp, Homo sapiens
agcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagccaggtgcggtggtgggtgcctgtaatcccagctactcaggagactgaggcaggagagtcgcttgaacctggaaggcagaggtggcagtgagctgagatcgcgccatttcacgccagcctgaagaagtaaacgttggagggcatatgctgctggacttcaaaacccatgcctatatgaacatgtgatttgtgatacttatctgtgggttaagatggccttaaaaaggtttttttttttttaatctctttaatgtttggcttaattgaagacagctggattcttacagctacttctgcagtcaactgcttgcaatatgttgctgtaattgacgtgcacaaagaaaatccaacctcaggcccataattggaaaagagggagtattttaatagaccttaaaataatataatttctttaatattacaccaaatttgacaagtggtaatttcttaaaggttgttacaatgtgaaaacaatctatattgaatttttcataatcagattaaaattcattaatctagtttgcattttgaacggatattttaccatgcagtttgtaacatgcatgagttacttgtaaactacaggttaacagacttatgcagatattccaacagttgacacctgtcactatacattttccaaagatcacgttctttactatcaccacccacatcattagaaaggtctttgcgtattggaaaattggtaaattcatggtggcagatacaatgttgtctcatttttagggcaaatgttatacatttattgaaatgctttcagttgtttcccctgaagtgctataattacttcatttttaagaaaatatctgcagctgggctcggtagtgtacgcctgtgatcctagcacgttgggaggcctaggcaggcggatcacttgaggtcaggagttcgagaccaggctggccaacatggtgaaaccccgtctctactaaaactacaaaaaatagccggtcgtggtgacaggcgcctgtaatcccagctacttggaggctgacgca

SEQ ID NO: 237470 - DNA, 955 bp, Homo sapiens
agcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagcaaaaacg

SEQ ID NO: 237471 - DNA, 1279 bp, Homo sapiens
agcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatttcacgccagcctgaagaagtaaacgttggagggcatatgctgctggacttcaaaacccatgcctatatgaacatgtgatttgtgatacttatctgtgggttaagatggccttaaaaaggtttttttttttttaatctctttaatgtttggcttaattgaagacagctggattcttacagctacttctgcagtcaactgcttgcaatatgttgctgtaattgacgtgcacaaagaaaatccaacctcaggcccataattggaaaagagggagtattttaatagaccttaaaataatataatttctttaatattacaccaaatttgacaagtggtaatttcttaaaggttgttacaatgtgaaaacaatctatattgaatttttcataatcagattaaaattcattaatctagtttgcattttgaacggatattttaccatgcagtttgtaacatgcatgagttacttgtaaactacaggttaacagacttatgcagatattccaacagttgacacctgtcactatacattttccaaagatcacgttctttactatcaccacccacatcattagaaaggtctttgcgtattggaaaattggtaaattcatggtggcagatacaatgttgtctcatttttagggcaaatgttatacatttattgaaatgctttcagttgtttcccctgaagtgctataattacttcatttttaagaaaatatctgcagctgggctcggtagtgtacgcctgtgatcctagcacgttgggaggcctaggcaggcggatcacttgaggtcaggagttcgagaccaggctggccaacatggtgaaaccccgtctctactaaaactacaaaaaatagccggtcgtggtgacaggcgcctgtaatcccagctacttggaggctgacgca

SEQ ID NO: 237472 - DNA, 757 bp, Homo sapiens
ccatgaggtcgccactagccactgcagctgtcgagcacgcaagataataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctccca

SEQ ID NO: 237473 - DNA, 237 bp, Homo sapiens
gttcctccaatcttgggggcagtggttttccctgtatcctcacctctcttacagatctgagaagagttgttgaattttcagtctgttaaactttttactcattgttaaaatggattggccatttccaaactctttacatatgaaaccagaaaacagaagtctccctttgaggttttatatctatatatcatttaatcctcataggctcccaagtagaaatatttagattaattttca

SEQ ID NO: 237474 - DNA, 411 bp, Homo sapiens
tcacagactgcacacctctgtgtggtctggctcctacagcctctgtgagctcatgtcctatcactgaacttctgctggtctgcaatccagccatattgacttccttatggtttgtaaaatgtgccagcaggctcatggctcagagcactggcacttgctgttccctctgcctagaacgctcttatttccatgtggctcactaactgctttaagcattgagtatctgtttacagggtcgtgctaacagaaaatgttcattagttcattaggcatgatcatggtgtagtattttacctatgtaaagtaacacctctgtttcctctttccccgctttttcttcttagcactgtaaccatctgatatgttttgacatcttttttttgacccctttagaatgtgaacacaaattta

SEQ ID NO: 237475 - DNA, 247 bp, Homo sapiens
cagtatgggctgtagttggcatattggttttcagtcagatgaatgatgcggaacatgacaaatctacatctgtaagaggagaaatgcatcaaagatagacgtttagggcagaggatggctggcccagtggggccatgtcgagattatgcctgtaatcccaacactttgggagactgaggtgggaggatcgcttgaggccaggagttcaaaaccagcctgggcaacatggtaaaaccccatctctaca

SEQ ID NO: 237476 - DNA, 516 bp, Homo sapiens
cgggtggaggaagggaggattgctgcaccaacctttcctcggcgcctgtttactggcaccgtcgcatccattccacgccgatcctccgcagtccccctatcctgccagccgctcctccttggggcaggggcggcgcgagccacaggggcgtgcccgcgagcgggtcggggctgcggagagaacgggccggggtaaaaacccgacggctgcccgcgggtgggcggggcgcgcagagccggtgggaggccgcggtggcagcagtcgcccccgcgcatcgagggacccagggactcgcgcagatggcacgcggccacctcggtcctgccggggagccccatttccaaccgaggcaactgaggttcccaaagcgccagctacccgccggggtctggagagcgccggggcccggccgccccgcccagccagagtgccccgccccaagcctggcgcacctggccccgccccgccgggaccccgcccccgccctaatcagagctggttccgcgccgcggccgc

SEQ ID NO: 237477 - DNA, 2291 bp, Homo sapiens
  misc_feature (1551)..(1551): n is a, c, g, or t
gaaagtgtccttgcaaactttgttccgagtgtaatttcctagggatcctatggcctcttgagaacagcattttagggacatggatcactgctctctatagaggtagctcaactcaagagcattttacatgtaggctccagacagcaaacatgtcaacacactgacctctctgctccaggtgactgtttgctacactggggattgcacaagtcagagacttcaatgcaactggctttgtgatgggtggcaggtgtgatgtgggtcagaggtgagaggacagacagaatggctgcatggaaaagcgagcatttgctattctacagaattccataatgcactggttaatgacactaaaaggagaaataatttcacaaaatgtatccctggtcctgacaccacgtggggcgtgttttaacaaagtgagttaattggggttgcaaatagatcaagagcataaaacatctctgactcaaatgtatttttagttaataagaaagaagaggggcccagcacgggggttcatgcctgtaatcccagcactttgggaggcccaggctggtggatcatctgatttcaggagttcaagaccagcctggccaacatggtgaaaccccgtctctactaaaaatacaaaaaaaaaaattagccgggcatggtggcgggtgcctgtaatcccagctacttgggaggctgaggcaggagaatcgcttgaacctgggaggccaaggttgcagtgagctgagatcgctccattgtactccagcctgggcgacaagagcgaaactccatctgggaaaaaaaaaaaaaaaaaaaccaagaaagaagaaaacttccttttgattatgcaattttagttcccattacatgttcttggctgctgattagaaatttaaattctagaattaaaaaattctagaagtaggagtttccagagctgattaatttaacagctcaagagtatctggggaagcttctctgtaagtctcttagcctttccctcatgactgcaagatggctgccacagctctgcctatcacatccgcacatgcaacatccaaaggcaggaaggaagcacactcacatatcttcctctcatcagagaaaacaatctttcccagcagccctctgtcaggcttccccttgtgtttcattggcttagaaatgggtctcatactcctcccaaaaatcaacactcagaggagactggtgttagcatgatcgcttgagaatagggtcagcaaagttcttctgaagaggaccagccagtaaatatttcaggctttgcagggcatggggtccatgtcacatctagtcagctctgctcttgtagagccaaagcagctagagacactggaaacaaatacatatgcctgtgttccaatgtcactgtggacactgaaatttgaatttcatatattttttacctcttacaaagcattttttttggttctttttccagcgaattaaaagtgtaaaaagcattttgtatggtatgaggccatacaaacacaggtggtaggccagatttggttagcaggctgtagtttgtcnatccctggtttagagcaatgaggactcatccccttggggctgtgggaagggaccaccttccctgaaacatcaccactcacacctgaaaaaaagaagggtgagggaagtgttgttaggcaactgagaatgtctcctacagcatattaaggttatggaaaaacgctgagggttatgataatttttaaaaagcaaattacatgtcaatatgggcaggatgatcccaaccaattctgcttgttgaaatccctgccattcactgaaatctatgttagacgcagccacccgagagcacctgtttctgattcctggttctcagaagccaaattggagcatcccttcctatccatgacaaacttccctttagcacctatcctgtgctggatgctgtcaacccaaactaactgctggaaatgcagaagtgaaagagccaatggctagcctcaaagaaatcactgtcgccgggcgcggtggctcacgcctctaatccccagcactttgggaggccaaggcaggtggatcacaaggtcaggagatcgagaccatcctggctaacacagtgaaaccccgtctctactaaaagtgcaaaaaaaattagccaggtgtggtggcgggtgcctgtagtcccagctacttgggaggctgaggcaggagaatggcgtgcacccaggaggcagagcttacagtgagctgagatcgcgccactgcactccagcctgggtgacagagtgagactcaatctc

SEQ ID NO: 237478 - DNA, 443 bp, Homo sapiens
tttcagcattggacagatctttcagacagaaagtcaacaaagaaacattggatttaatctgcactgtagaccaaatgggtctaatagatatttacggaacatttcgtccagtggctgcaggatacacattctttttcccagcacatggatccttctcaaggatagaccatatgttaggtcacaagacaagtcttaaaacattcaaaaaattgaaataatatccagcatcttctctgaccacaatggaataaagctagaagttaataacgagggatttttgaatacatggaaattaaacaatatgttcctgaatgacaaatgggttaatgaagaaattaagatggaaattaaaaaattttttgaaacaaatgataatggaaaaccaaaacttatggtatacagcaaaaacagtactgagaggataagtttacaactgtaaatgc

SEQ ID NO: 237479 - DNA, 482 bp, Homo sapiens
gacgcatgggtccaaaccctggtcccagttctcagtgactgtgtggccttgagcaaatgactccaccactcaaaacttcttctcatcatatataaaattgggaataagagtcgcctctaagggttgcaggaaggattccagataacatgggtaactagtgcatagcaactacagtgaattgtggttacatggaggtactttaaacaagtactcatggcactggtgcgtgcatgcacacaaacgcacacacgcacacactgccctaataaagcctcccaggaacagatgatgggcagacacattaagaagatgagatcccaccagatcaaatgattttatgaggcatgaatcccgaggggaacaatcttgggggacctactaatatgggaattggcaaatcctccctggggagcaaactttattttttttaatgtccacgcattatgacatgcacagtcatttcccccctgaagtgagtcaca

SEQ ID NO: 237480 - DNA, 424 bp, Homo sapiens
tggctgcagccttgcagggtgttggcgctccctgtgtcctctgtctgtctctgcggctctgctcccggcctttgctggccttttgccctcccgccgctgcctcactgtgaagacacatccccgaaagcccagagcttgtcctcactgtgaagacgcgtccctggatgcccagagcttggatgggcttctaccactccacggccgcctcagcccatggttattttccactcgccttttcgtttgaaagcacttatgtgcaaattgccacgtgcacaacagtcccttcgtggggagctctcagtgagctccagctgagccctctggcgtccctgggaaccccatctgtcatcctctgcactgtggggagggatgcctcctcccgctgttgcctggagaggctgctcctcttagtgcccaaccccac

SEQ ID NO: 237481 - DNA, 485 bp, Homo sapiens
tgacctttgaaagaaccagactagtaaatggtcccaaattctggatttgtttgttatctcaaggtgttaacttgtttttctagacttgatgtcctgttcaaataaaggacaggtttgattcagatagaatcaatcattgtcctgaccggaagcagatggcatactcaaagggtctaactgaaggatgtgaaatgaagggactatttacagatgtgtgggcaggcatagggaacaagcgatggtgaggcactgtgggactgctggccctaggtctacaacagcctgagctgagtgcagttactgaagcattgcaggagctggagctttgggagaggggtccccaccaggagccatggatgtagcagcaacacaggcaccaccaaaactgcacctgggcagggagtggggtggtggggaacaaataccacaacatctctctcctctaccttcaaaacggctgttggaacccctgcgttggccaaatc

SEQ ID NO: 237482 - DNA, 528 bp, Homo sapiens
gcaaagaagacaaacagtactaattttgatgtctatgttcagatatagtcacacaatttatagttacatatcagggaatagatataggaaaggtgttcatcattattaaaccgctgaaattccttgttttatataggctctgccagtgaattatatagaaaaaacactagtgaatcccctggttccatagaaggaggaaaatgccagtcactttgctcctgttatcagaatatgcagggtaggagaacgccggcaagcaatgtggactggggaatagaaaattaaaccaaagtcataaagctatatgttacaggatcttcacagtatgcttggattgtttatccttacacataaagaatagagtgtgctatggatgtcttttaaaaataagtatgttcagataatcagaatctgatttaaaggaatacacacacatatataagtatatattatacatataaagcattgtactagttattgccttctagcggtaataaacaaagatgctcaaaataatacgcaagctac

SEQ ID NO: 237483 - DNA, 415 bp, Homo sapiens
agtgcaggtagagcgactttaaacatttgtgaactggcccttgtgcacctttccatcctcatctctaagggtctgtccatctttggctctgtaatttcataaattttcatttcccgaataagcccagtttcctgcagcttaggacttctactagtgagcttccctctgtctataatgccctaccacgcccctcatacatccctatggcctggctgattctagacttttttcaactctccgctctgactttcctgacaatgccaccactactccaactaaatcaatgactccatatctttttattgtaccattatttgtattcatagtgcttaatgtatttgtatatgtacaaatacatttgtattgttatatatgtgttatccataatatatttataataaatttaattaatata

SEQ ID NO: 237484 - DNA, 493 bp, Homo sapiens
cggctggaatccagctcaagagtccgcgcggagaaagacaaagactgggaggcaggcctcgccatttaagcgattgccttctgggaacaagcgagctgggtgcccagcggcatattcccggcactgggctcgccttgagcttggccacagcagctcccgctatgacatgccctgtgccgcgcacttcctctccaggggtataaagcaggcgatggcgctgcttgtacctagtaaagcctccactttgctcgccgcgagcttggcgcgaccagcttgtcgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgc

SEQ ID NO: 237485 - DNA, 768 bp, Homo sapiens
aataatcaaaccagccataaactatggagcaaagaactttgtttccaagagatttaaaaaaaaaaaagaaaaagacaaagctacctgtaagccctgagctgattgtattggcttttaaagactttttaaagcctctccttaaagcaaatcacactgtattagtctgttttcacactcatgataaagacatacccaagactgggcaatttacaaaagcaagaggtttatggacttacagttccacgtgaccggggaggcctaacaatcatggcagaaggaaaggaggagcaaggcagatcttacatggatggcagcagacaaagagagcttgtgcagagcaactcctgtttttaaaaccatgagctctcatgacacccactcactatcatgagaacagcatgggaagacccatccccattattcaatcatctcccacctggtccctcccataacacatgggaattatgggaactacaagatgagatttgggtggggacacagagccaaactgtgtcattctgtccctggcccctctcaaatctcatatcttcacatttcaacaccaactatgccttcccaacagccctccaaagtctccactcatttcagtattaattcaaaagtccacattccaaagtctcatccaagacaagcaattcccttctacctatgagcctgtaaaatcaaaagcaagttagttacttcctagataccaagagggtacagacattgggtaaatacaccaattccaaatgggagaaattggcc

SEQ ID NO: 237486 - DNA, 337 bp, Homo sapiens
ctagagtctcttagtggtacaagtttaaactagaggcctgcagaggcttcctcactgtcccctcaccctataccccccacccccaacttttacagtagggacatgagagggacaatttcatattcccatttaagatgtgaatggagggttggagaaaggagcctcagtgggtatatgcttgtgtcatcaatttcagaactagaccacagttctttgttcgctatctaccctccctaaccaagaccagcaagggatgccagcccaaacaaggaggcagaactcttaggcccaccttggctgtaacatccacaatagtttttgttttttccaaacacag

SEQ ID NO: 237487 - DNA, 330 bp, Homo sapiens
ggtatttatttgtttgaacccatttttgaccaagaccatttagataacttgcttcacaaatttctccaaataaactgaaacaagagagctctgactcttaaaatctacaaaattaaatgtaaatttaaagataacagggtgctacaggtagaaaattagagtgatttttttttaatcactttgaaggtgaagggaagatgttttggtagttgatagtacttgatatccattgataatactgagtatgtagtattacattattattgcaatcaaaatgtggtttcaaacgtgttaaatgaaataaattgaatattttgatggaaaataaat

SEQ ID NO: 237488 - DNA, 329 bp, Homo sapiens
gggtctcgctttgtcacctaggctggagtgcagttttatgatcacagcttactgccacctcaaatttctgggctcaacagatcctcccacctcagcctcctgggtagctgggaatacaggcacaccaccatgtccggttaatttttaaatgtttttgtacagacagggtctcaccatcttgcccaggctggtctcaaactcctggactcaagcaatcctctcacctcagcctcccaaagtgctaggattacagactggagatatttttcaaggccacattatttctcgattctctataactgtcctgccctttaaccttttaataccca

SEQ ID NO: 237489 - DNA, 326 bp, Homo sapiens
catccccgagactgccctcgagagctggcgcctggggaatgcagttgccgctcgcaactcacctcttgggtctgcagcctgagcagaccttcccagcttcaccgagggccacctcgcacgtggcagaggggaggggctggcacccaccccacgggggccgatgccatagcaagcaaagctgccgtccaccatgtgcagcgacatgacagcgagggacggcagcccctgggggagccccttccagtcatgtgactgaagtcttgaacctctcagggccctggtctcctcattaataaagcacatccctccccctgtaacactgggga

SEQ ID NO: 237490 - DNA, 286 bp, Homo sapiens
aggaagctgaggctgcagtgagccgtgatcatgcccctgcactctagcctgggtgaaagagtgagaccctgtctcaataaaaaaaaaatgtagaattacaaagggaataaattattttgttggcaaaatattataaacaataaatatgtgatagaatgatacatgtacttccttaatagtgcattaaatagatccaacagcaggtctaataactatcaatatttcaacattgtgctaagcatgaatagtattttgtgatgtctacaataattgtgctgtgatggca

SEQ ID NO: 237491 - DNA, 454 bp, Homo sapiens
tctagaagtgaacatgttccaggtgatgtccctatgtaaaccaagggttggttttcagtgttctggaggctgggatgtccaaggtcaagatgctgacagattgattgtccctggaaagcctgcttcatagatgaccatcttctccgtgtgttctccctgtgttctcaggagtggggttacctttctggtgcctctttttcataaggacactattcccgttcctgagggctccattctcataacacaacatccagaaggtcctacattctaatatcatcatactgcagcttgggtcctcatatgagagatgtatggagaaaatacctaaatctatcttataacctggagcagagccaccacagcttcagatatgtaacaattatggtgtttactctcttgaataattttattttgcttattcagaaacctcagcaaataaaaatctttttggaaa

SEQ ID NO: 237492 - DNA, 2012 bp, Homo sapiens
tcaaattagtgtaattcttggatatttaatatataggtaatattttaaacaagtttctgtaaaatttagtgttcccattaactccgtacagaatcccttgtatttccaatatgtcaggttccatgaatgtacatgctatctggttgtttaaacattacttagttgattataatgactgtgagtataactacttttactgcttatggtagatatcatgtgagttacaatattatattacatactcttaaacaactgttgtagaaaagttgcttgaaattaaaatacacacttgtacaagttattcacatagaacaagtttgcagttactccccttttattcttgataaatatttcagtttagttcaaatcattccaaggaatgtaaaaattgaatcaacttattatattcctaaaatcagtgccctgcaggtagcaagatatacctagagtggaggtttccaaaatctacagtctcaatttaattttgaataaaatgacgaagcccagaaaagtgaatcagaagttgaagtgtcccataataagctgtcatggcttcatgatcatttgtgtatgtaattattataaaaatgcatttgcatttttattgcttgtgtcatgactagcctggcctttcctttccttttctgcacacactgaactaagggagaataccttgtttttcttccatttcagtgaacctttccttcataactgtaatgagtaaaggtcctaatcactcctttgtatatatgaagatgaaaattccttgaaataattatccagaatttctttaaaagcattcctcaatggttttatgagtgctgtatttgaagaagattaaaatagaaactttatttttaaagctgtgactccatctcttagaatgcagcgtctctgagaaaggaacttctaaactgacttctgctttgggctaaaatatttacccatataagccaatgatagtacagagatttaacagtatttaaatttgggccatagatgaaaatgaattctacttttgactagtaactattcttgatccatcctttgcttttgtttgagagaatattatctctatttgagaacaacatggaaggcattgaaactagttttccacaaaggccagaggacaaaaatatttatttccttacttgattccttcttatcagttgacctggtcgcatctttaatttaattgatattattattacgtttgccttgcaagttctcagatatctccaaccttttgtgttgtcattcatcgactacgggaatattctcaatgaaatgtccttgatggtctctctggttcttattctagtcatgaaaaggaaaagacaaaaagatagcaaatcttaaaactagtaaataaaaggaacttgtagtgaactttgtccattaaattataagtagcttacctgatgagctacagtgtactgtatactttctcccctgcaagcactcaaagaaatattatttgatcaaaatctatagtgcataaattaaacaaaaaatactgaaaatattctcattttattttaattatgcaagtttatttttaatgatatgatatttaagctattatatttctcacttttttattttcaatgatttaaatgtaaaaattataaaacaattttaatctcattcattaattcatctttcatgtataagtctgttttctctgttgaccaccctgtccacattatgaataaaaatatgtatatacttggccgggcgcggtggctcatgcctgtattcccagtactttgggaggccaaggcgggaggatcacaaggtcaggagatcgagaccatcctggctaacacagtgaaaccccgtctctactaaaaatacaaaaaattagctgggcgtggtggcgggcgcctgtagtcccagctactcgggaggctgaggcaggagaatggcatgaacccgggaggcggagcttgcagtgagccaagatggcgccactgcactccagcctgggcgacagagctagactccatctc

SEQ ID NO: 237493 - DNA, 436 bp, Homo sapiens
ccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggc

SEQ ID NO: 237494 - DNA, 450 bp, Homo sapiens
ctggagacagagtctcactcttgttgcccaggctggagtgcgatgtcgcgatcttggctcactgcaacctctgtctcccgggttcaagggattctcttgccctcagcctcttgagtagctgggattacaggtgcctgccatcatgcccagctaatttttgtatttaagtagagatggggtttcaccatgttggccaggctggtctcaaactcctgacctctggtgatccacttgcctcggcctcctaaagtgctgggatcacaggcaggagccatcatccctggccaggaagtttcttttttcaaacttgtatttttcctctccagaatctcttaggattttttactttttttgttttcctcatttttctttaatacagttgccatcttacataatgtactattaagtgccttcttaatagcttctaatctacccttctgtcgtcttctc

SEQ ID NO: 237495 - DNA, 839 bp, Homo sapiens
ctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctag

SEQ ID NO: 237496 - DNA, 176 bp, Homo sapiens
gggagttaacactgataatgaggatgatgcaactagcaaatcagttgcatccaagtgttaaagaccataaatccacttgttttagctgtttttgcttgagctaatgctcaaatatattttctgtcaggaagcaagtggcaatagccgcagcaaagatattggttcttggataaccc

SEQ ID NO: 237497 - DNA, 460 bp, Homo sapiens
ctgccttccagtgaccaggatgaaagatgcacccatgaattatatatttcaagtcatctctaaattgcctggcaattacagaacagcaaggtcagctgccgggagcaagaatctcccttttggcagagaaaaacagatggatggaaacacaacgatatacagaaagatgttacctcttggagggggggtgtttttcagatgctggtcaccatagatgctggtcaccaccatgccctttcataagtgtccttacaaaaggaggaaatcaggacagatacatccagagggaagacgctatgaagacacagagaagagggccatctatgccaaggagaggggtaggaagcaaattcttcccacacacacctcggaggaaccaaccctgctgacaccttaattttggacttccagcttccagaactgtgagataataaattttagttgtttaagctactcagca

SEQ ID NO: 237498 - DNA, 388 bp, Homo sapiens
cgtgcagctcgttggccagtcactgctccacacagctttgccttctgggccagaggtctcaatagggccttccagcaccgccatttttgtcgccctgccttgcccgccaccgaaagattccacgtcctaggtggcctggcgagtgtttgctgccgtccagccgatatgagtcgaagagtccagactcggggaggctactggggccatcagggcgtggagcctgcggggtctgttgcttctaggcctggactgggccagtgggtgcagccatccctgggcctcagctgatacaggttcctggggcacaggccttgcccactctggagctctatgcagcaattttgtcattttttcttgcccctaataaacgacagcaaaaataacacaa

SEQ ID NO: 237499 - DNA, 367 bp, Homo sapiens
gacattcgcattgtatttcatgcctctgcacctaggctacgcagactgctttgcagtggcacattgtgtgaagcagatctctgaacggcatgtccagagccaggcctctggaaacactggtgcactgggagcctgtgaagcaaaacttctaggtttgcaccttctctgcgaggaatacacactaactgaaaatgtgcactgtggccacttctctcttgtgacttaaaataattttctctcagaccaaatttgaccttccctgtcagttgcctgccttgagactgagcacatgtcttcagctttttttttgtgcctttctcagaaaagcgtgtgtaaatgcataaaataaaatccactggaatataaa

SEQ ID NO: 237500 - DNA, 1005 bp, Homo sapiens
  misc_feature (136)..(136): n is a, c, g, or t
  misc_feature (811)..(811): n is a, c, g, or t
  misc_feature (823)..(823): n is a, c, g, or t
  misc_feature (961)..(962): n is a, c, g, or t
agggggaaagagaagaaggaaggaagagagataattagagaaacatgcctttgtaatctcaatgtgtttggggaagaggaggactactggccgtgggttaggagcaatgattctctctgcctccaccagtgacatnagtcactataaaaaacaaaactgcctataaacatttataaatacccccaagtggatgatacctcccagctggagaactactgcaagactttgtatctcatgaaggacttgttaaattaaaaataacaccacgaatgcatgggacactacaccagtggctctcagttttggctgcacgttaggataattcagggggctcttaatattcccaacgcccaacacagcacccagctcaattatatcagaatctgtggaggtgagacccacacatcgatatttttcaaagctccccttctccatgcctgtgattttaatgttgtaatcaaaactcttttcctgcttaacacctttaaaatagatgtgttgacttaataaccaaatcaaaaccatagcacctctcttatccaaggatctgggactaggattttaacagatgtaacaaaagatgttaaccacttactggaagcctagtgtttatcaggatcacgttcatttacatatatataatctcaatccttaatgcaactgtacaagcacaaattagtcttctttttttattttaataaagaaacaggccgggcgcggtggctcacgcctgtaatcccagcactttgggaagccgaggcgggcggatcacgaggtcaggagatcgacaccatcctggctaacactgtgnaacccctaaaanaatacaaaaatacaaaaaaatacaaaacaaaaattagcctggcgtagtggcgggctcctgtagtcccagctatttcggaggctgaggcaggagaatgacgtgaacccgggaggcggagcttgcagtgagccgagatcnngccactacactccagcctgggtgacagagcaagactccgtctc

SEQ ID NO: 237501 - DNA, 394 bp, Homo sapiens
tcccaggtatatatacccaagagaaatgaaaatatatgtccacacaaaaactggacagtggactgttaaccgacaataaaaaagagtgaaatactgatgcagactgtgacacggatgagcctcgaaaacatgatgccaaatggaagaagcctcacacaaaagaccacatactatacgatgtcacttacatgaaatgccaggatagccagatgtaccgagacacgatgtagatttgtggctgctgagggccggaagtgggtaatggggggcttgggggcttaggagtgaagctaagaattgggaagttttctttttaggttaatgggaatgttctaaaactgtatgatggcggtacaactctataaataaaaacgctgaatttacactttttttc

SEQ ID NO: 237502 - DNA, 535 bp, Homo sapiens
agatgggagaactaactcgagttagataaacgcagactaatgttgcatagaagtatcaataaactatttgagttttctgaccataaaacttatacaggctatcagtaattaaattgtggtatatttatataaaggaacttcgcagcaataagaataaaccaactactgctgtatacagcaaggccgaatctcacaaccataaccttgggtttaaaaacagccagaaacaaaagagtacagtatatgactcaattgatattaaactcaaaaacaggcaaaactaacctgtggtggaaagagtctttccaaaccagtacttttaggtctactgtagttactgtaacgacttcttagtgttctatcttgtaaatatgccatgatttattaaacacagcccccaattcatagatattcaagttacttctaaagttttgctcttataaagaacactgcagaacagtcttgcacctgtgcaagtagttctatgggataaattcctagaggtagaaacaatggataggtctccacgtttgaa

SEQ ID NO: 237503 - DNA, 481 bp, Homo sapiens
agatgggagaactaactcgagttagataaacgcagactaatgttgcatagaagtatcaataaactatttgagttttctgaccataaaacttatacaggctatcagtaattaaattgtggtatatttatataaaggaacttcgcagcaataagaataaaccaactactgctgtatacagcaaggccgaatctcacaaccataaccttgggtttaaaaacagccagaaacaaaagagtacagtatatgactcaattgatattaaactcaaagtctactgtagttactgtaacgacttcttagtgttctatcttgtaaatatgccatgatttattaaacacagcccccaattcatagatattcaagttacttctaaagttttgctcttataaagaacactgcagaacagtcttgcacctgtgcaagtagttctatgggataaattcctagaggtagaaacaatggataggtctccacgtttgaa

SEQ ID NO: 237504 - DNA, 743 bp, Homo sapiens
gttaattgtacattatatggaaccaccaaaaggctaataccaaagaaaatgaatgataccaactgggagactaagaaaggggtttcagaggcagcatattttgctctgggagtgaaaagaatcaccacattttgtaacatgccaaaacttacccctgtacttggaaatgaatgaatgaaactattaaggaataaatgaatgaaatatggaactgtgtcccgtgtacctttcaaggctcaagatatatttgatattattagtctaaacgctaccaaaagtatctctaatcttgaaattctccatattcttccataatttaagacagcacttgccttagcttcattattttaaaatgatagcttagagtgaaacctacttgatatatagatgaagggagcatatgtaaaggattatatttcttaagtctttcatccgttatacatttagaaaacttgataggcatagatgtgtgttctttgccactgtggcttccttctcagggtaactgccattcattcaccaaactcctgttgtgtgcatctttcttagatgaaaattatggctggcattatgtgatccctgttcttaagatgtttgtggtctaaatggagcaaataaggcattcacatgtgaaaagttaaataatataacaaaaaagagagactcttataaactggtgtcgttacagaaggcatttggaagaggtagaatttgatctgaatcttgaaatgtgaatagggaac

SEQ ID NO: 237505 - DNA, 590 bp, Homo sapiens
gaattttctaatgtatgccagaatggaaacatcagatgtaggaattttatcggtcaatttcttaccctgttgtttcagtattttttgcatctcacttctcctggcactattactagaagagaatagtagaattcaggagggacctgacatctgtgttaccctctttcaaaacccttttatcgacattatttcatttggcctgtgcagcttccctataaggcagatgttaatgttatttccgttttaaagatgacagaaacaaggcccaggcaggttcagtgacttgcccaaagtcacacacctgcttttccattagggctaggatcagggtgagggcctcctgtcttgtagtccaaggcctggttattgccttatgtagaaatcagagccaactgttcatctgatggttatttatggagcatctattatattctcaaggccctgtgttgggtgctcagttagagcaggaaagacagtcactgctgtgatggtgtctacattcaaaaccagcgctatccaaaaaatgtataatgtgggccatatgtgaaattcaaaattttttagcagctgcagtaatttaaaaaaagtaa

SEQ ID NO: 237506 - DNA, 740 bp, Homo sapiens
ggaagctgtgcgattggcttacgttttatttttatttagaccaataggactcgattatgcaggatacctattttgattgggcaaaactggcatctgtcgtcatccacggataattaccaatcagcagagaccttcccactacctcggccgcataaactattatataaaaagaggagaccgacttcttgttttggttttgccactattgtttcattatgcccgagctggccaagtctgctcccgccccgaagaagggctccaagaaggcggtgaccaaggcccagaagaaggatggcaagaagcgcaagcgcagccgcaaggagagctactccgtgtacgtgtacaaggtgctgaagcaggtccaccccgacaccggcatctcttctaaggccatgggaatcatgaactccttcgtcaacgacatcttcgagcgcatcgcaagcgaggcttcccgcctggcgcactacaacaagcgctcgaccatcacctccagggagatccagaccgccgtgcgcctgctgcttccgggggagctggccaagcacgcggtgtcggagggcaccaaggccgtcaccaagtacaccagctccaagtaaattctcaagctcttgtccaacccaaaggctcttttcagagccactcactattatctaaagaagagctggttcgctcttcctatcactggggggcgaggggtcataaatcattttgatctatccactaaattaatctagctcttt

SEQ ID NO: 237507 - DNA, 470 bp, Homo sapiens
tattttcagatatggatggaagggactttcgtagctatagaaacgaggactgattggcacaaagttcctgggctctccagccacagtcgtcatttggaagggaattctaagtcaccagagagctaacacttattcttgggagaatgtaagagcaaatcctccttacgctgccaaactggcacaggatactgcagccactctgcaaatgaacagtgcacaataaacaggccgagagagaaagcttaaagttctaaaagccctcttgagggaagtgagaaggcagttcctgggaacagtgaacaaatgccgtcagaaggtggaatcattgatttcaatcatgaatgactaatgatcgtgatggtgtggtttagaacagaaatgcagcttctacagcctgaagaactaccagccttctctcctgtgatgttccatttatacttgcttaataaaagcatcccaataaattagac

SEQ ID NO: 237508 - DNA, 309 bp, Homo sapiens
actcttaatgagttccctcccatttccagtgccacctgacaccccccaccccctgacacacacacacacactcttgttttctgacttcctgcctctgcaagacaagaagcctgttctttttctggaagatcacaccaactcctgtttagccctcagacatagttgccagggagctaagcaactgagcaggaattatggtcagggacacagcacaaatactccagcccatttttctgacaaccagactaatatcccttacattaccgaaagttctgggttcctcactacagagattagctgtccaaaatt

SEQ ID NO: 237509 - DNA, 517 bp, Homo sapiens
gggtgcgtgtgtgcttgcagacatgggcacacatgatgctgtgatcgtgtgcacaggtgttgtgcaagtccgcgtgcccgggagtgttctgtgctgtcattcattggacgagcactcacttattgagcacctactatgtgctagatgctgaggatgtggtggtgacaagagcccctcctccctaacagtcatactcagtgagagggatgttaatcggaacaaaacacacatcggcagggcatggtggctcacgcctgtaatcccagcactttgggaggccaagacgggtggatcagctgaagtcaggagttcgagaccaacctgaccaacatggtgaaaccctgtctctactaaaaatacaaaaccaggcgtggtggcgcatgcctgtaatcctagctactcgggaggctgaggcaggagaattgcttgaactagggaggcagaggttgcagtgagctgagaccatgccattgcactccagcctgggcaacaagagcgaaactctatgtccaaaaaa

SEQ ID NO: 237510 - DNA, 460 bp, Homo sapiens
ccccctgcggcctggcacagaagttatccacctaactggaaatgcagacttggagaggggcaccaggcccagggcaaggtgggcaggaagccctgggaccagcagagcctgtggaagagaagatcctcactccatcctgccctgggccaagctgactgtgtggaccaaatcctcgggcttccgcctctggcttttggagaagggtctcggcgagggagttctgcccagctgcaggtgaaggggtggcattgcttcccaacagccgcagctcctgccaggcagccctgtccctactgctccctcctccaggctcccatgcctgcccccctcacctatccaggctgaggagggtaagggctcccggctattgctggccccggggtgctctccagcccttgtgggtttcccttaacctcacccgcacctttgtaaatagtccttccgtaaacatccttcattc

SEQ ID NO: 237511 - DNA, 435 bp, Homo sapiens
tggtgattttagtttgtgtaaatattacttgtaatgttttcatggttgtaacataagaattaggctaattttataactttgcatgaagaaaatagcttttttctgtattaataaagtagaattcatttagaaggatttagtcattcattttgtttaacataaatatatcagattatgtggtttatgtttcatcagtaaggttttggtattcattttcaggagcttcagaaaagtttgatgagctattatataagccaagaacacacagcatgttatacggagatttaaagaagccaatgtagaggtagaatgtatgttattttattattattttttgagatggagtttcgttcttgtcgcccaggctggagtgcaatggtgcaatcttggctcactgcaacctctgcctcccaggttcaagggattctcctgcct

SEQ ID NO: 237512 - DNA, 1719 bp, Homo sapiens
aaattcttcaaactgaattgcaataatgacacaacctatcaaaacctctgggatacaccaaagggagtgccaagagaaaagtccacagccctcaacgcctacatcaaaaagattgaaagagcacaaattgacattctaaggtcacacctcaaggaactagagaaataagaacaaaccaaacccaaacccagcagaaaaaaaggaaataaccaagatcagggcagaactaaatgaaattgaaaaaaaaaaagatacaaagataaaaagctggttctttgaaaagataaacaaaattgatagaccattagcaagattaaccaagaaaagagagaaaatccaaataacctcattaagaaaagaaacgggatattacaactggcaccactgaaatacaaaagatcattcaaggctactgtgaatataaactgtaaactaggaaacctagtttatgcgcataaactaggaaacctagaagagatggataaattcctggaaagatgcaacactcctagcttaaatcaggaagaatgagataccatgaacagaccaataacaaacaatgagattaaaatggtaaaaaattactaacaaaaaaagtcccagaccagacggatttacagcagaattctaccggacattcaaagaagaattgataccaatcctttgatgctattccacaacatagagaaaaaaaggaaccctcccttaattcattctatgaagccagcatcaccctaataccaaaaccaggaaaggacttaaccaaaaaagaaaactacagactgatatccttgatgaacatagatgctagaacccttaacaaaatactagctaatcaaattcaacaacatatcaaaaagataatccaccatgatcaagtgggtttcataccagggattcaggcatggtttaacatatgcaagtcaataaatgtgatacaccatataaacagaattaaaaacaaaaatcacatgttcatctcaatagatgcagaaaaagcagttgacaaaatccagcatcactttatgattaaaactttcagcaaaattggcatacaagggacatacttcaatgtaataaaagtcatctatgacaaacccacagccaacataataagcattccctctggaacaagacaaggatgcccactctcacaaatcctcttcaacatagcactggaagtcctagccagagcaatcagacaagagaaagaaataaaacgcatccaaatcagtaaagaggaagtcaaacggtcactgtttgctgacaatacgattgtttactttgaaaaccctaaagactcttccagaaagctcctggaaccgataaaagaattcagcaaagtttctggatacaagactagtgtacacaaatcagtatctctctttacaacgacagcaaccaagcagagaatcaaatcaagaactcaacccctaggtcaggtatagtggctcatgcctgtaatcccagcactttgggaggccaaggcaggcggatcacaaggtcaggagttcgagaccagcctcaccaacatggtgaaaccccgtctctactaaaaatacaaaaactagccgggcatggtggtgcacgcctgtaatcccagctactcaggaggctgaggcaggagaatcacttgaacccgggaggcagaagttgcagtgatctgagatcatggcactgcactccagcctgggtgacagagtaagactctgtctcaag

SEQ ID NO: 237513 - DNA, 476 bp, Homo sapiens
gggggatgtgagtactgggcaccaaatgatgcctcctaatctcccagctcagcaaatgctgcccagggctgaaaacaaaacatcctcagagagttttccttgccctcctcctgttggtatcttgtccttgtcagcaaatgattcaccaccattcagccaaagcatgattattttcacttgtatctacagctatgaaatgcccacagactggtgccaggttctgggaaagagatataaccaaacatgctgaattcccagactcctttgaatttataatgccatgaagcacttgttcccaggtcaggaggctaggggactgagcagcatgattacttatccctgtcctgggaagaaacaagagggaaaaaagatttgtttcccagaagacagccatctctccagcaaataatccagtcccaggttcccttatgataaatcaatcacactttttaataaaagaatgcaaacatagagat

SEQ ID NO: 237514 - DNA, 240 bp, Homo sapiens
catcaaaaagaatgatgatgcaatttaaaccatacaaaaattaaaaaaaaaaatccaagggacggtggtgaaagtcttctttctagaagaatagcagctaatatacacagaacgaatcttagaattagaaaatcactatattttgatccccttccccaaagggtgacaaaaccattggtagacagtggttgagaaacagaatagtctcaggatatcactccgtagatttattcattaatt

SEQ ID NO: 237515 - DNA, 209 bp, Homo sapiens
cttagaaggttttgaggtgttctctttatcctgtgattagcgaatctctgttgtctcagttctctcctggaagtgctgtgaaatgcaggtggggcttcctggactgatactctctttcttcatcttttgattcctgtttttgtgtttttgtgctacattaaggggacatctctccacttcatttctcagctcttttatagaagtgtcca

SEQ ID NO: 237516 - DNA, 498 bp, Homo sapiens
tgaaaagaacctgttctgagaaatacaaatgacatcaatcaggcccttatttgaggtgaaaggcaatgatggagagactgacagtataaccagaaattctaaagaatctacaagaaagttctagaactagtaagatagtttcataatattacaggatccaaagtttgttataaaaaacaattatatggttatatattagcaacaagcaaatggaaaactcaaagatccaataccaaaatgaattgggatgtgattagctctcccgccataaacaatttcccaccatggtagcagtttgcaaaaacaaaagtaggatcctgatattgctagccaagttacagatcggttccatcaccacaaggatccctcatatagccctttcatagccacactcacctctatctgtcccgcagcacctgatccctagtgaccactaatcttcatttctacaattgtgtcatttaaagaatgtactataaatggaatcatatggtatgt

SEQ ID NO: 237517 - DNA, 421 bp, Homo sapiens
ctcacctgtaatcctcctgactcctacagatttcccagaactccagtgcatcaccttacccttttctattttcagcacaaccagcgtgatgtacaaagtgtgctgatatttcttccaatgtctgagtcagatgaggcagattctagtattttcatcagactctaaacatgccagagagtggggacaggggtgtgtaatatcgaagatggaatttaacagggagaccccaaggggagctgagatgtgggaggaaagaggcagaaatatatggagattagggacaatgaaagattgggcagaaagaggaataagaggtgaaacaagttgtaaaaatggatcagaacaggtgggagagaaggaatagagggaagaatgggacaaagagaagaggagggactcaaaatgaacagaatcctagggg

SEQ ID NO: 237518 - DNA, 411 bp, Homo sapiens
tttattgctggaagccattctcttacagcatctagtgctgtgtaacgagctaccttaaaatgtaaaggcttaaaacagccatctttgatgtctttgcaggtctagaagtcaggaagggtaattattcagctccaagtggcattggctctagttactacctgatattccagggtggtagctggagtggtctcaagggtccaagctgacctcacttacaagctgggtgccttggcagggacagttaggaggctgtgtgtagcagagcctcactcggtctttgtattctccaggcctcttcagtggtttctttggcacttcttaaatgatgtcagggttccaggagttaatgttccaagagacaggaagtggatgctgcccatctctttttttttgtttgtttgtttgtttgtt

SEQ ID NO: 237519 - DNA, 489 bp, Homo sapiens
ccaaatactctgaagataaaataattaaaacagtatgatgctgatatagctacagatagatgaatgagtggaacagaataggaaatggagaatcaaaatggaaaattagagggtatatgtgtagaagtttaatatgtgaaaaaggcagcagcattggctgggtgtggtggctcacacctgtaatcctagcactttgggaggccgaggagggtggatcacttgaggtcaggagtttgagaccagcctggccaacacggtgaggccccgtctctactaaaaataaaataactagccaggtgtggtggtgggcacctgtaatcccagctattttgggaggctaaggcaggagaattgcttgaatccaggaggcagaggttgcagtgagcagagattgtgccattgcactccagcctgcgtaacagagtgagagtccgtctcaaaaaaaacccccaaagcaaaacaaaacaaaaaaaggcagcatttccaatt

SEQ ID NO: 237520 - DNA, 913 bp, Homo sapiens
ccaggctcttgatgcacactccttctgccaggtgtgcgcctctcccgttccctgcacatgcctaactctagcctctccttgaagtctcagtgtgggcatcccctcctcctgggctaggccccctcctgagcccccatgacccctgtgcattcctgtggcactgcaccaatttgtctgcagcaccacggtctgtccacgacagtaacagcaccagtactgcctcagcttcctcatttttccatttcatccttcaaaacaccacaagctttgttagcaaggagtcttgtggctttcttgagtcttcccccaagccatgaagagtttaagaacccagatgctgatcgggccagggacaggcttgcccatgtcccgggccccattgcttccatgcctggtgctgtctgagtatccccagagcaagagagacctggagacaccagggtggagggtcctgggagatagtcccagggtccgggacagagtggagtcaagagctggaacctccctcagctcactccgagcctggagaactgcaggggccaaggtggaggcaggcttaagttcagtcctcctgccctggagctggtttgggctgtcaaaaccaggtaacctcctacatgggtcatgactctgggtcctgggtctgtgaccttggggtaagtcgcgcctgacccaagctgctaagaggggcaagggagaaggaagtaccctgggggaggggaagggacagaggaaggtattccctggcttttccactccaaaccagggcaccccttggtctctgccccagagttgagaaaaaaacttcctccccgggttttagggagaaggtttccctggggtaaggcaaaggggaagcgccccagtaaagggaagccatgaattttacgggccgggggggggccgagagaaa

SEQ ID NO: 237521 - DNA, 480 bp, Homo sapiens
ccaggctcttgatgcacactccttctgccaggtgtgcgcctctcccgttccctgcacatgcctaactctagcctctccttgaagtctcagtgtgggcatcccctcctcctgggctaggccccctcctgagcccccatgacccctgtgcattcctgtggcactgcaccaatttgtctgcagcaccacggtctgtccacgacagtaacagcaccagtactgcctcagcttcctcatttttccatttcatccttcaaaacaccacaagctttgttagcaaggagtcttgtggctttcttgagtcttcccccaagccatgaagagtttaagaacccagggtcttattccaaatttgtgccaggctgagtgcagtggctcatgcctataatcccaccactttgggaggccaaggtgagaagatcacttgagcctaggagttcaagactggcctgagccacacaatgagaccccatctctatttta

SEQ ID NO: 237522 - DNA, 1347 bp, Homo sapiens
gagacctaatactgcctgcatgcagaagtggtcctgctgggtttgtttctgtagtgatgacactttgaatgttttttcctgttgggtttacagtcactcagcacttttcactgtaagatggtgtggaaccagacgcagagcacatcggaattcacatcctattctgcctccaattacacaggtgaaacaagactaaggtccattttcccctgggagttgggagtgggctttgtcctttgagaatcacagtcactttttgatgtgtttgtctttgctgtttagaggtggaccagtcgtgctttactgagtctacctgataatctcatgtacacttttttaaaatggcaaaaatggttaggttgggtctgcccaaagggaactgaccatccaggattccagcctttgatgttaatagctaggtgttgacagaaaaaagaaaatgtcaaactttctatgcttatgagtagatactagtctttgcttcatttttaccattctagaaatgaaattagcatgtgtgataattggtgggacacagaagtattttatattctgtgtctctagatagtggaggcactcttcggattgggggttggaggaagggttggtggcagagttggaatgtgaaacattgagttgtgaggggaacacaggtccacacactaaaaaacctgtgctgccaaaaatgtcaacagcaccccctccctatagagaaatactgataacctgtatcacctcccatcctgaagtgataccttgaaattctacatggcagtggaggacagaagtaggaagtttgcaggtctctaggtactcacttagtgccggaattgctatatttggtggctgcttacttcatctttcatatttagagtttgatggtgggatgctgttaaattgtagtagaccatttagtttttaaagaaggctttgttccacaagtgacaggacaagtcaagtcacttcatgctgttttgctgaatggatacggcagacctgtgttaacatttttaccattctgtgaaaacaaaatcctagatagtaggagaaaattacttacagaataaacctgaccagctagcaccctgacatcagatcattaacctactgcattttattggggataattcttgggacaatcttgagagccaagtgttttcattatgctttaaaaagtgttataaaaatggcctttttgaaaatgttgcattatttgttaaagataacatcaaattttctttggtctttctgagcatacctttgtaaaaactttgactcaatctgagtgtatagagggcatttgtcctgactggatcaaaatgtgctttagtaccctcatttttctaa

SEQ ID NO: 237523 - DNA, 698 bp, Homo sapiens
acctagacgtaacacagagaaacgctgtttccacaaataatcaaaaatcaaggtcgggcgcggtgttcacgcctgtaatcccagcactttgggaggccgaggcaggtggatcacctgaggtcaggagtttgagaccagcctgggcaacactgaaactcgtctctactaaaaatacaaaaattagccggacgtggtggctgcttacttcatctttcatatttagagtttgatggtgggatgctgttaaattgtagtagaccatttagtttttaaagaaggctttgttccacaagtgacaggacaagtcaagtcacttcatgctgttttgctgaatggatacggcagacctgtgttaacatttttaccattctgtgaaaacaaaatcctagatagtaggagaaaattacttacagaataaacctgaccagctagcaccctgacatcagatcattaacctactgcattttattggggataattcttgggacaatcttgagagccaagtgttttcattatgctttaaaaagtgttataaaaatggcctttttgaaaatgttgcattatttgttaaagataacatcaaattttctttggtctttctgagcatacctttgtaaaaactttgactcaatctgagtgtatagagggcatttgtcctgactggatcaaaatgtgctttagtaccctcatttttctaa

SEQ ID NO: 237524 - DNA, 542 bp, Homo sapiens
agtttcattcctgtcttgtctttgtttgggtttccctagaagcagattttgaaaaaacatgcaatctggtctgacttcactacttaggagctgtgagacctctctgtgcctcaatttcctcatcagtaagattctactttataggattgtaaggaagattaaattatgcatagaaagttttaaagccctatctgacctataatggtggtcaataaagcttgctgtgataacagtgattactattattattaaaaatatcactaccttcgggttgccatcctcaaccaatctagctagaacagattagagccccctcttatgtgtactaatagcattgtatgcctcctttacattgtaattgccagtttgctacaggaaggatgatgaaatattgttcatcatctagcacctagcccagtgcctggcagagttatacaagatgtactcaagtattttttgaacaaaattaatgaataaaatgacttgtagaaagagccttccaattacacttgctttcttacctttaaatagccacctcttta

SEQ ID NO: 237525 - DNA, 457 bp, Homo sapiens
atcaatagactgtggtatcctagatgttttcgtagtggttgataattcatctataagaacagagaaaccatttatggttgatcagaattttatttgttaaaataagtaattaaatagtctaagatgtattgattaatcatagaattttcatgaagggcattttaaaattgccgtttatgccatgaaaaagaatagaaagatgaagcactgcgattccataaaatagcttcctagaaaagcaattaactgattttttctaaagttcacagaagataaatgatgtaggcttcctatttcctgtcactcttggttacctttgtatgaaaatggatttcttccaaatgaaagtcggcaccagcctgtcgggcaaaaaaggcatctgtaaagcaatgtgtacattacatattcatgccagtcgaatttcttaattacatttgagatgtataatgttttcaaa

SEQ ID NO: 237526 - DNA, 456 bp, Homo sapiens
agggggactaaaaaggcttgggggctcagagaacgttcattccagttccccagggacaggaatccgccccagcccaggttcctgccccagcgaggccttctcatcggcgtgatcggggtctggtttgcagccaggccacacaaagccacacagagcagcctcggaagtttggtgacagaaaacgacgtgaccttggcggggtttggaggctgcagcttttggcggggcaggtcagggccccggggtgttgtggccacagagccacgcaggggaggcgctaggttgtgggttaggggacggggaggccccttcatccctggccaggttgggcagcagtgacgccttctttcctcccccactgcccccctacaaccccgacactcttcacggaacccctgtgtctgctaggcactgggtaggcactatttgtataaataaaactccttttgggcctgt

SEQ ID NO: 237527 - DNA, 322 bp, Homo sapiens
ggagcgtttgttacaagggcagaagaccggcgtgatctccccacgcgcgccagccggtgctgctggtggagggaactgacatctaacgcatgtggcccaggagaacaaaaccttccattgcaccccacgccgcgactctccccagcgaaaggtgcttcttttggaagaccgcacgaagtaaggaagagcctcttttcctcttcctggatatccctccaggaatattagaagctccaggactccttgatacgaccaggaaaagatcgcaaccgggtctttaaaatatcgattccagccagcttctgcgtgcttgacacatctt

SEQ ID NO: 237528 - DNA, 426 bp, Homo sapiens
tgtccccacagctccaaccagaatagctctgcttttatgttcacgatattgggtgtcccgctaagattttatttgaataactttttagatggaacaattttaaaagttaaaaactaccatttttaaacaaattacattttggatcgttttttgagatagcaagggtttcgtctctcatcttgggttggatgaaaagtgtaagacaacacagaactcagaacctagcagcgagggaagtgcctgtttttcaaagggaaaggaatgtgttattttgcagttgtcagtagttccaaatatatcaactattccacaaaataatgagtatgtagtttccgtgagagacttagaactgtctagagcctagtccttattgtctgtgatcatagaaaccatggagaaaaaaagcctacctatacgaaagtagtt

SEQ ID NO: 237529 - DNA, 457 bp, Homo sapiens
caggcatgagccactgcacccagccagaagatattaataacatttccaggaaatttaacagataatgtttcatatgttaatgagcaggagttattgtgggaggctgaggtgggaggattgtttgaggccagaagttgagactagcccaggcaacatagcaagacctcaacgctaccaaaagtaaaaacttagctgggtgtgaggcttgcctgagcccaggaggccaacgctgcagtgagccgtgatcatgccactgtcctccagcctggaaacagagcaagaccccatcttggaaaaacaaaacaacacagggagagcataggtgctcagtgtcatatgaattaatacattttgttactgaaacccagttttactttgcaactttaaatttttttcagaaacattaaagaatatattttgtatgagttaaatatagaaatgctactggctgttcctg

SEQ ID NO: 237530 - DNA, 469 bp, Homo sapiens
tcagcctcccaaagtgctgggattataggtgtgagccatgagtctcatatgacaagttcccttttaaaatgcataaaatcacagatacctttgtctggaaaaataggttttttttgttttttgggaggattgtttgaggccagaagttgagactagcccaggcaacatagcaagacctcaacgctaccaaaagtaaaaacttagctgggtgtgaggcttgcctgagcccaggaggccaacgctgcagtgagccgtgatcatgccactgtcctccagcctggaaacagagcaagaccccatcttggaaaaacaaaacaacacagggagagcataggtgctcagtgtcatatgaattaatacattttgttactgaaacccagttttactttgcaactttaaatttttttcagaaacattaaagaatatattttgtatgagttaaatatagaaatgctactggctgttcctg

SEQ ID NO: 237531 - DNA, 872 bp, Homo sapiens
cccagccatgagctgagctggtgcgcaaccaagacttagcctgagtgggctgagtgtggaggtccccagctggagtcaacaccttgcaaatagtctcattattaaaatcctctcaatttaagtgtgtcaggtgttctctaccaggactcagactgaaattagcctaaaatcagttgtatatgtcttttggaatgcattaaggacatgctcctttatataaagtgacatttgttatggggcagaaagtatccaaattctaccaactacttggaagaagaaaactataaaagagccaaacaattctgttctgttaaccgctttttcaaaattcaagacctacctccaaaaaaaaaaaagtttaatgtatctctccaccataaacaaagacaaagtgaaagaaaatatattaaagggataatccctcatctagaaggaatgatcccattcttcgagaatataggtgatatcttaattgttgtacaattaaaaacagctacaccaaactgctcataaccaattaccaattcaaataaatatatagaaaatctttacaatctatgaaaattctaagtagtacactctgacacattttattcacttatcacgtatagttacctcacttcaaagagtgacattagggggcttacaagaccccaagtacaggcctctgcattaagaaaatggacatcaggcttcaggatataaaaaccttttcctaagcatctctaatggaatcggagacaaatataactattgttaacaggcaggctaaattaactacctccttttgctgctagaccagaggcttctctagtaattaattacccaggtcctggcctccttcaggcagctacacagctcaggaggagcag

SEQ ID NO: 237532 - DNA, 1411 bp, Homo sapiens
gataggacctgttgggattccaaagaaaggagcataaaacaccagggtaatcagttcaaatcattgttcggaggaactttcatacagggttgtgggggctgcagtgtgtccttgtgttggacagcaaacaaaaaaaaaagctctacttgtgtacgtctgcaatgagaagtttgggttatggagagtatatgagggcttaaggaatttggctcagatccagggccagtttctacatgtttagcaacatgtttgatctctcagtgtttcgggcaacaatgtaactgtcagtgcctgggcattccaatccctagcttacgtttaagcctgcaggggaagacatgcacttggtccagggtcacagagctgtcaaggcaccttgcacttctaggccaggacacagaaaggggagttggggaccactacaatgagcaatgttggtcagtagttttatttgtttgttttcactttatctgattttggtgtttgactaatactggcctcccaaaatcaactgggaatttttcctccagtgccaccccctttttatttgcatgacattttgtagaattggtgttgtttctttaagtattcggtagaattttttggtgaaaccatttaagtctggaggtttctcttgtggaagatttgaattatgtagtcattcaacttaataggtactcaaagtatttcatattgggtgggttttaatagattattatttttgaggaattgttccatttcatctaagttttgtaacttaaatttgtggagttatttatttgaagtattcccttattattcccttcatgacagaaggttctatagttgtatcctttgttttattcctaatagtggttatgtgtgtcttctttatctttgttaatcttcttagatgtttataaattttattgactatttcaaagaaccagctttctgtgtcattgattttctatgtgttctgactttgatttctattctgatcattattattttctttttctacttgttttggttgtatattgctgtttgtagattcttgaggtgggagcttagattatcattagagactttattctaacataagcatttagttttataagctaaactcagcactgtttgagctccatcttacattttcctatattgtaattatattttcattcagcttaactatttctcgattccatttaagaaattatctgtgacacatgggttatttagaagtgtgctcttttggccgagcacggtggctcacgcctgtaaccccagcactttgggaggctgaggcgggcagatcatgaggtcaagagatggagaccatcctggccaacatggtgaaaccccatctctactaaaaatacaaaaattagctggcgtggtggcgggctcctgtaatcccaggtactcggaa

SEQ ID NO: 237533 - DNA, 2486 bp, Homo sapiens
  misc_feature (1576)..(1576): n is a, c, g, or t
  misc_feature (2238)..(2238): n is a, c, g, or t
tgacttcctattggtttggtgaaccaagtcacaatctttgttgggtttaggtgataggttgtaatgactgagtcactcagtactgggctgtcttgtgtgtcactgccattctgtgtgctcatggtggttggctggtgaggcccagctgagggcagggttggtcggccaggactggaaacaaagagagaatggtggtgttggggtgtacatggcttgcctcggtagtggtccacttttgaattaggccaggatactttctatttgtttgttcacttggtttgagggaaattaagatttactgtgtttttagatattcttcttagtctagtgccatgaaatcaaacagatctgggttcaaactgtggccctgccatgtactagtttatgtgatcttggacaggttattcacactcgcagattgttttttcgtaatcaaatggccacaggaatggcaaaatatcagagaatatgtcgaaatggaaggaaatcctgggattatctgatctgtagactcttcctattaaattaaacattaaatgcctgaaatgttataagacgttattaaatatctgaaacgaaatctcagtatgaaaagcagatatgttaggtggatgcctcagttgaattcagtcttcttattgggtaagattagtctttgttcacagaactactttaccaccttcactgagtcccatggttcactgcagctcggaatgaaatctcctgatttttcttcatgtataaggaaactgaggtcctgtatgccaagccactttccccaaaggtcaaataggaagatagtggcagtggcagattggagtcagtaccatgttcctcatacaacaccacaaagaagtcaacttggttagcaaccaaaactccgactgcatttttttcttagattccattgtgccaatgcataacctttgtattctttcaatttttaaatggcactctagaagaaaaaaagatatctgggaaagtttgctgttaagaatattttctccttcaagattcctcatttcaagttctaccatagactcagttcatcacctgtcaaaaaaatgacatgaaatctcaacattctccctaaaatacagagacctgtgacatcataatcctgaagcctgagagactaagtaggaagctgaaccatatgacataaactgtaaggaccagagtagaggaggggaagtgaagaggaaaagaggaaaggacatccacatctctttggacctttggaccgatcagtctaaaccttatttttgtcgttgttgttttttggtacatgtcctggttgtttgttccctttgttcagttcattttgccaagtgtttacagaacacccatgctgtgctagtatcggttatcacctctgaacaaatagaataatgtttggagtgtgacttacaccttgaagtccacttccttttagagatactatctcatattctgtaaatttaagctaggaataacctcacaccagttactcggtgtttgaatctggagaaggaatagaaggcattatctgctgggaacgcttcaatattgaaatgttctttcccgaagctacttntttttccctctcaagtcacatattactgacccacagcaaaacccgagattccaacagacaatccaatctgaagcaaagtttcttattcagatgttggacaggtactaattcagcacctacttgtgtgagatactcttccaggttttggcatagagtggtgaccaggaaagatcaagacccaagcactctgtggtgcttccatgctcatggggggaagagaaaataataagtaaatccattagaaagattatgatttcaactagtcataaatatgatgaaggaaatatacatggaaatgtaatattaatcaaggcatgggtattgcatattatgattgatcaggaatcagtttctcctaggaggtgacatttaaactcagacctttaggagatctcaactctcagtatcctcagagtcaagttgagggaccttataagactccaacagaaggaaccacacagtttcatgctgcaagggcaaggctactctatttttaattgatggctagacttcattaagactgaaatgaataacagtgaggaaaggcggggcagctactagagacagaagagtcattgtgatttagttgtttggtgaattgctcatactttcaagggtcatcggtagcataactgcaccttggtgcttggagaaagcagagngcagcagctgggccagcccaggactctctgtgcctggagctcctggtaatggacctgccagcgtgtgaactgacgtgcccagcgctcccacggtgggaagctgtttactctctcccgggaggacacagggttagacatagttgaatctataatcattatcaaccagatcaacacgttctaactgacttgcttgtgtcgtttttttccccaacagtagttcaatggcctgtgaatgttttgcttccagt

SEQ ID NO: 237534 - DNA, 463 bp, Homo sapiens
agcagagttcctaaactttataataggaaaaggggaaattgtgagttataatggttttaccaaaggttactggccaagtttcattatctctgcaagggaaactagactttttttttttttttttaaacaaagtcttgctcttctgcccaggctggaaggaagactttgtttaaaaaaaaaaaaaaattgtctagtttccctcacagacttaatgctgtgacaaaagaacaattcatacagaggggctaacaagccaaaccagcagccttcagtgggagggaacttggaaagttggaatgttcaaggaaaatgacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggcaa

SEQ ID NO: 237535 - DNA, 463 bp, Homo sapiens
gtctctaatggacatctcagatttcacaggcccaaagccaggctcccaattactcctgaccccaggcttgctcctgatagtgacatgaggcagccaaatgcctaggcagagaggggagggtcccaaatgaaaccccacgttcaagcaaagatcagcctgaaggctaaaagaccagattgctggtcctggatgaaacccaccacgcagagtgggaacttctgttcctgtttgcccaccctttcccaattgttctttctgaataacgccttaaccaatcgaatgttgccttttccagtaatacctacagcctgcccctccccccattctgagcccataaaaagacccagactcccccatattaaggggactttcctgcctttgggtagggggaccacccccacgtctcctctctgttgaaaactgtttcatcactcaataaaactcccagctttgctcactcttc

SEQ ID NO: 237536 - DNA, 390 bp, Homo sapiens
agagccagatgacctgggagcatgtcgtcgttctgtcactcactagtcatatgaccttgggcaagttacatagccagcctgagcctcacatcctcatctgtaatgcatcagttgtcacgttcctcatgggctgttgtgagactgaaggaagttcactcacatatagagggcttggggcctgacacaaactgggtcaatgtgtctgctctggtcatgatgctgaagcaatagctcagtgggagaaacgggaattgacggagagtcaggtagacatggttgggtgtgtcgcctgaatggagagaggagaactgggaagaaaatgttagcagaataaagccggggcaacagagcttgccagggcatagaacaagggcgcaggtttacttgtca

SEQ ID NO: 237537 - DNA, 495 bp, Homo sapiens
  misc_feature (7)..(7): n is a, c, g, or t
cccccgngctgcaggaaattcggcacgagacctccattttaaaaaagctttttaaaaaagtaaatgttgccacattatctgctatagacaagtagagcaagtagggaatcatgtactgaaactaagaacatcacaagccctagatttttaggcccaataagccactaattaactgtaggatcttaggcatgcaatttcgtctttaacaagtcagttttatcatctgtaaaatgaggaatgtgttcagattagcatttgtgaaagtatgtttggcaaaatactaatttttcagaatattttttaattttttttttttttttttttttttgagacagagtcttacactgtcacccaggctggagtgcagtggcgtgatctcggctcactgcaagctccgcctcccgggttcatgccattctcctgcctcagcctcctgagtagctgggactacaggtgcccgccaccatgcctggctaatcttttgtacttttagta

SEQ ID NO: 237538 - DNA, 278 bp, Homo sapiens
tcagaccgaacattaccaaagccatggcctgaccgagggatggcggcggcggggcagagaggccgtccccatcccatatggtggtccggttcactcttccctccccgccttggtgttactcatggaacccccctctcacggagggcacagaggggctgttttctcccacggccctcggaggtgacaaaatcaacaattgtttgagagcctcaaatctccttccccctgtccccccggaccaggtggcccctggggagaccctgccgccctacaggtgt

SEQ ID NO: 237539 - DNA, 671 bp, Homo sapiens
gacactgattagcatgggttacacatgtgaatgagatatggtcctctgcctagcaagggtttgcaattacattataatactgtttgttggtctttacaacataatacacatgtaatactgtataatgggggttgttacagaaatactagcaaagtaataaagaagtacagcattgaaggtagaaggtagtcttaaagaatgagttaagatttatcagagaagcatgtgttgggttttaggcatgtgcagtgctacagtgttgtgaaaggtatagacccctgaggaaatagaacttattcagagtgtcgggactacaggatgtgttgctgatgggacaggggatgatctagaaatgtagattgtgatcagatgtaaaatgtttgtatgtctagcaagtgagtgtgaactttatcctgtaaccagtgcggagccaatggaggtttttcagcagggagtgatagcatcctctttcttattttagaaagataaatggtgcaaatgttggagaatagagaggatagagagaaattggaggcaaggagaccagagaggaaattattggaataacccaagggatagatccttactgcctaaaccagaacagtactattttgtatagtgaagaaaggatggctctgataataaaaggtttttagtagtgagaggatgag

SEQ ID NO: 237540 - DNA, 396 bp, Homo sapiens
ggcaaaagcttagaggtgacaattgaagagactctttctggcaatatttgttctttctgaggaaaaatgcccaggctctcggattgctcctaccatctcatctcactttaagatgctatccaagtaggccgagcacggaggctcaagcctgtaatcccagcactttgggaggcagaggtgagtggatcacttgaagtcaggagttcgagactagcctgaccaacatgatgaaaccttgtctctactagaggatacaaaaattagctgggtgtgagtgtgtgcacctgtagtcccagctactcaggaggctgagaggtgagaatcgcttgaaccaacgaaggggaggttgcagtgagccaagatcatgacactgcactccagcctgggtggcaggcc

SEQ ID NO: 237541 - DNA, 603 bp, Homo sapiens
gttaaatcaaatattatatgtgaaaagtgttttataaactgtcatatactccccaaatattagttacctgatatttttgaacttattagaggcatttactttaataattttcatttatacatatacttaaattgtataaggataaacattttaaagttattatcaattggcatgaattcttaagcataagcaatgttttaataattttgttaatgtgttaaagatcttaatgaaggataaaatattgctggactttcaagtagttaaggaatgttctgtaattggcaagggtgggaacaaaaaaatgttgacaaggtaacacatcatttttcagtacagtattggttttgacaaccttttcttgataggaagacagaaactgaagtgtcaggaattgctgtattcaccatgaaccttcctatgctctgatgaaaacatgaatatttgttataagcaaatgaaatggagctgcagctatcactatgtactctgtgggcctttaatacagtagggattcctttatagatatacatagatttaaattgaaaaaaatggtctttgctgtttgagctcagttgtttagttagcctttaaaaaaaaaaa

SEQ ID NO: 237542 - DNA, 412 bp, Homo sapiens
acaggaaggctgaaccctcacatctgtggtcaattgatttttgacaagagtgccaagccattcagtggggaaaggacagacttttcaacagatggtgctgggacaactggatctccaggtttgtgagtgaatgtaactaaaagaatgaagctggatccttacctcacaccatacacaacaattaactcaaaatggatcaaagacctaaatataagagctaaaacgataaatccgtctcaggaaaacatagaggaaagtcttcactggatttgcaatggatttaatgcagatctctgatggagttggtactggtgtcttggatatgacaccaaaagcacagacaacacaagaaaaaaagaaattggatttcatcaaatttaaaaacttttacacatcagtggacactatcaag

SEQ ID NO: 237543 - DNA, 422 bp, Homo sapiens
catttgcacttacaggccacgccatgctccatcctccccatcctgcctgggaacctgaccaatgtggctaaaccagcaggctccctggctgccagcttctggctggttgagccaatgggaagcatgagaggagagccgagggtggggagacagtcagatcagggtttctgtcctcagggctccctccctggcaggtggtggcaggagtggctgcattcccctctgaaggctccttcaagcctctcagcaaacagctcccatctccaagtccagccacctgttccatcctctcctctgtaggcccagcagtgggaatgacccaccactattgccagcctcagcatactgaagcaccccttactggattccctaaattctatgcacatgtttattaaatgctcctcaattacccagtttcaatg

SEQ ID NO: 237544 - DNA, 483 bp, Homo sapiens
tagtcagctcaggctgtggaaacaagtcaccacagatgggggctcaagcagcacaaatgtatccctcacagttctggaggctgggtgtccaaggtcgaggtgccagcaggctcggcagcaggctcggtttcttccgggttttcctgggcctgcaggcgctgccttcctgctgcgtgctcgccgttcggtctgtgtcttggtgtccttgtttcctcttcttaggcggacactggtcatagcagatccgggccccacttgcgtggcctcattttaccttacgcatctctaagggccacatctccagatacaggcactcgggggcactggggttaagacttcagtatgtggatttcagggagacagaattcagcccacgacgtacatggaggccgcattttatttatccatctgtcagttggtagacgtttgggttgtttcccactgtaggctgctgtgaataaagcattcgtgtgtgagtttttg

SEQ ID NO: 237545 - DNA, 2086 bp, Homo sapiens
  misc_feature (1191)..(1191): n is a, c, g, or t
  misc_feature (1207)..(1207): n is a, c, g, or t
  misc_feature (1216)..(1216): n is a, c, g, or t
  misc_feature (1240)..(1240): n is a, c, g, or t
  misc_feature (1291)..(1292): n is a, c, g, or t
  misc_feature (1354)..(1354): n is a, c, g, or t
  misc_feature (1370)..(1370): n is a, c, g, or t
  misc_feature (1389)..(1389): n is a, c, g, or t
  misc_feature (1418)..(1418): n is a, c, g, or t
  misc_feature (1422)..(1422): n is a, c, g, or t
  misc_feature (1427)..(1427): n is a, c, g, or t
  misc_feature (1438)..(1438): n is a, c, g, or t
  misc_feature (1444)..(1444): n is a, c, g, or t
  misc_feature (1473)..(1473): n is a, c, g, or t
  misc_feature (1487)..(1487): n is a, c, g, or t
  misc_feature (1556)..(1556): n is a, c, g, or t
  misc_feature (1580)..(1581): n is a, c, g, or t
  misc_feature (1583)..(1583): n is a, c, g, or t
  misc_feature (1604)..(1604): n is a, c, g, or t
aaaaaagatatttatgagaaaactattgaacagtgactgtgttgtacccgagcaagttagaggaacgccacactttgagacgaatttaaaagtcctttatttagctggcagccaagaggtggctcacacttggaattctctcagctccgaggaaggggcttgattttcctttatactttggtttaggaaggggacgggagctcagttgcaacaattctacagaagtaaaaacatgcaaaaaattaaaaagacaaatggttacagagaaacaaacagttccaggtgcaggggctctaaatctatcataagatgtcaggtgtgggggctctgccagacacaaactcaaggctttatggtgtatctcttgagcgaaatcctgggaacttcgtacattgcttgcttcagtaccttatgagttaattggactctttgatatgttgagagtcagcttacacaagttaactccttgaggaaagggggtgggtaaggagtccttgatgtcctgtaaatgaaggaaccaaatggagttcctccggctttctcagctaagggagagcttattcacatggaaacaaggctaggtgattaagggagaaagggacagtctgaaaacaaggttagtaaaaacaaggttaggtattagaactgcaaagagtattaagtgaaataagtgaaggaaaatatgagctcttattttttaaaagttgtgttggggcaaatgttaaatatctttctttctctggacattattaagaaagatagagtgatgtgaatgataggaagcccacctgtaaccacttagctgacatgtccaactatgggtgaacaggaaataagcgacattcacctaggctgtttattggaatctgactagcattatttgatttggcatactttacatgtccagaacaaggctgttggtgcttggcaccaagaaatttatgactttttttttttttttaaataaagtcctaaaggtagcattaaaatgacttaactggaggcaggaggatcactgaagcccaggagtttgaagctgcagtaagctaagaaggtgccactgcactgcagcctggatgacagagtgaaactttgtctcttaatagacctatggactgaagttgtgatattgagtgttatatttctcaataaaggttttttcttttaatactgtattaggtcaaattcaantcttaattccttgaantccaatttncttgtgaaatttcatgtgattaanttaaaattccagggatcctatctaacatcacagttgatggaaaaatgtatnntgagaaatcagttttggtgaacagtaacagcattactgataataggcaacaaacactactgnattttatttctgatangcattataggtggtaatcnaaatgattaatgattttattgctctttanattntctanaacaggtgatntgacanaattgtacttttttctgagaagttggtantgtacttactactntattttgtagttatacaataaatcttacttagctgacaactaggagtaaaagctctgacaaaaagcctntgctgtaactaaaatactgagatnntnctatcttaacaaacttaacanatggggaaggggtatattttaaagatggagaaatgatgcagtttgcaaatatagtcaataaatattctcaagtgtacgtagctcaatttcatttgcagcaaagataacactgaaatgtctatggatgagattattggataaacttttttaaaaacactgttctcaagataggcaagtgattaagagcactgactgggccgggcgcggtggctcacgtctataatcctagcactttgggaggccgaggcgggcaaatcacaaggtcaggagatcaaaacaatcctggctaacaaggtgaaaccccgtctctactaaaaatacaaaaaaattagctgggcatggtggtggacgcctgtagtcccagctactcgggaggctgaggcaggagaatggtgtaatcccgggaggtggaggttgcagtgagccgagatcgtgccactgcactccagccggggtgacagagcgagactcccacccatctc

SEQ ID NO: 237546 - DNA, 485 bp, Homo sapiens
ttttcaggatagaaaaagtaatattgcaaatatatgtatttaaaatggtagtgttgcatctgataggttgagaaccactagctaagccttcaaaggtgcatgttcccagcacatgtaatggccttcttcagctgtatgattcccagcttcatacagtcatttgagaagtactaaggcagtgctgaattgcaggaccgagatcagaaagaaaatctccaataaatttggaccatagtggaaataagctaaaattaatttttacaaaggtaactgtaaaatacccatatgcttggaagttttaaaactatttgcaaatttcaaaaacccctcacaattaatattttaaaatagttgaaactaattgaatgtaaacattgataatatcaaaacttctgggatatagctaaactatacttagaatatgcatgtaataaaagaaatgcatgtaagactgaaatgcatgtaataaaagacagttgaaatca

SEQ ID NO: 237547 - DNA, 486 bp, Homo sapiens
agcaaacactaagagaattcatcaccactggactaatactatagtagaggctcaaaggagtcccagacatggaaacaaaaggttgatatttgccatcataaaaacacatgaaagtataaaattaataagtctcataaaacaattacacgaagaagagaaaggaatcaaatggcaccatgatagaactccatgaaaccacaaagacagaagaaaaaataaaacaaagaatttacaaaacagctagataacaatatatttcagtaacaagatgtcatatatcaatgttaaccttgaacctaaatggatcaaatgctccgcttaaaagatacagcctgactgaatagatttttttaaatgacacaactgtgtgatacctagacacacagatcgactgaaagtgaaggggtagagaaaaacatgctacacaaacagaaagcaaaagcagtaagaatagctattcttatgccagataaaacagacgttatg

SEQ ID NO: 237548 - DNA, 999 bp, Homo sapiens
  misc_feature (798)..(798): n is a, c, g, or t
agatggtgccgctatactccagcctggttgacagagcaagactctgtcgagtctcagaaaaaaaaaaaaatcacataagtcgtggtccctgccttcaaggagctcacaacatagggaaccagaaacaaacagttgagtgttaaatgctaataaaggaagagtagggggtgcatggtggctcaagcctgtaatcccagcactttgggaggccaaggcaggcggatcccttgagtcccggagtttgagaccagcctgagcaacataataagacctcgtttctacaaaaattagagttagtgtggtggtgtgggcctgtactcccagctacttgggaggctgaggcaggaggatggacctgggaggtcaaggctgcagtgagtggtgattgcaccactgaacctcagcctggacgacagagcaataccctgtctaaaaacgaaactaacaaaaaagttaacacttttaagaagcattcttacgtaaaataaaataaaaaaactggcaataaaaaaaaaaaaaaaaactgaactaaaaaaaaaaaaagaaaaaaaagcacaaaaaaaaaaagaagggagggaatgatgacaatgtctaggatgactggtataatgaacaacgaactgaactagataaacatggttataacatggagactctctagtatccagaacaagagttgatgtgacctaaactagatttgctaaatacgttatatggcaaagaatccagtatgggacgctaatacaatgagtggataagcttaactggtaaaaggcaaatgtcgagctgtaagacagnagtgaaatgagcggatattaaagggaaatgaagctaatttatgtgggaatgggtggaaagttgcaacttccgtgattagtattatcaccggatataggttaaagcttgctcaatgttaaacaagagcgaatttaaagaatggggacttaagggatatggggtataagggggaatgggccatgtaaatcttgcggccttggg

SEQ ID NO: 237549 - DNA, 994 bp, Homo sapiens
agatggtgccgctatactccagcctggttgacagagcaagactctgtcgagtctcagaaaaaaaaaaaaatcacataagtcgtggtccctgccttcaaggagctcacaacatagggaaccagaaacaaacagttgagtgttaaatgctaataaaggaagagtagggggtgcatggtggctcaagcctgtaatcccagcactttgggaggccaaggcaggcggatcccttgagtcccggagtttgagaccagcctgagcaacataataagacctcgtttctacaaaaattagagttagtgtggtggtgtgggcctgtactcccagctacttgggaggctgaggcaggaggatggacctgggaggtcaaggctgcagtgagtggtgattgcaccactgaacctcagcctggacgacagagcaataccctgtctaaaaacgaaactaacaaaaaagttaacacttttaagaagcattcttacgtaaaataaaataaaaaaactggcaataaaacataaagactaagatgataaacagtctatataatatataaaatatgcactaacatctctgtgataatatgcacatattttagaggtaatcatgtcttctagattacttgtgtgcatttgattgggcttgttgtttagggtcccttttaaaattaattcattagattgatgtattctatatttctgatagactggacagaaggatctgtgtccccaagtgagacaggctctgaataacctttgttttctgcactttttattgatgatttgtgactcaactggatacaggtgctcaatagttaggctttgtagtgatgtcaggacgcattacaagctgttagccgatactgactgggcattggcaccatccttgacttaacttcctttttttctctagtgtgcctatggtgtggaatagcattactggcgattttgcagtgctcaggaagtgggacgttactttgaagtgcttgtttgtttcttgc

SEQ ID NO: 237550 - DNA, 3314 bp, Homo sapiens
  misc_feature (1070)..(1070): n is a, c, g, or t
  misc_feature (1555)..(1555): n is a, c, g, or t
  misc_feature (1965)..(1965): n is a, c, g, or t
  misc_feature (2043)..(2043): n is a, c, g, or t
  misc_feature (2053)..(2053): n is a, c, g, or t
  misc_feature (2213)..(2213): n is a, c, g, or t
  misc_feature (2225)..(2225): n is a, c, g, or t
aaaaaaaaatgtatttgaggcctgcatgatctcaactggctgtaaatacctttcagatttcctgggttattgcttagtcttctactgttcctttccgtctttatctgaccaattcagagtcctgcttcacaaatgccaaaccattttagtttctgtataatggaggcatttttttcctctttaggtcacatgtctttcacagagatttttgtcatagatgtcttgaaataggaactgtaaaagacattatttttgaacgtttgaacattgctttttattttctcaaaggagtttgcacatgatcaacagatatattcatcaaacccacctacgagatgagaaacccagactcaaaagttgaggggaggagaagtgctctactttgagaagaaacaacagaaattaagctcaaatgtcttataaaatgaatcctgaataatccttttacattcaaacattttgacagtttttgggcatgagaggaggagtgaggagtttatttggagcctaaattatctccaaattgtttgtttgctattaaagggctgaaagagaagtaagcaaaacaaaaataaaattccactggctctccactatggatgagaagttgcacaaaggcctagctgtttcgttggtggagagctacatggctgcccaagttttgcaatagaacttagagaatggccttatatgggaattaaggatgggaagcaaaatgtgtttttgaggacttaaacagacactccaggtggtgcagacaggtgcagacagcattgacataatgtcacctgcatatgtacatggcttaggccttttaaagcccatttacctgtgctattgtgttgaattttagctctaaaataggttgtgatttgatcttgttaccaattcaaaaaatcagttaggcatacctagtaggtcatcttgtctctgcttgaaagtttccagtgatggagagctttctgttggccaggtaatgtattttgtggctggacagcttttattgtttggaaattattctgtgtatagagttcaaatatattttattgaaacttctatctactggtttnattgtaactgctacataataatttttcttcctcatccacacaataacttcaaccatttgaaagcagttatcagaactcccttaaatcttcacatctccaagctaaacacctctcattttctcaaccaagcctttattaatatggtcttcatctcctcctagctctgttcaccttctcctagaatagatttctggcatctccatgaccctaagcaatcaaatcttctggtagctccatgactttaataacagtatattaaatgtttcctgaccaatatagggtgattgttagcagcctctattgagattttttatttcaattactgccatctaggattatgatgactattttagcaaccattgttagctcaaaaaaagcttgtggtcaaatgacattaacagtcccttttccataacaactgtgactcatttctcctcatttaattccttctcatcttcttaagaacgagcaacctacatgaaaantttcaagggttagaacagatcctgtcacctcaatttaaagtagtactagataacatttactggccactgactaaaggccagtcattagaactgttctgagtaattttcctacaataactcactaaatgctcataataacccttgggggtaggttctatgaatgctccatttgaaagatgtgcaaatggaagcgtggagatgtttggtaacttgcttaaattcacacaatttgtaactgagagaggtgagatgcaaacacaggctcttcagcccatacccttcaccctgctttctagctggtgcacatagttagtagtcaacaggaattgaacctcggtctcctggctgatagatcaatgttctctcctcaccccggtgtggccttcctgaagtggtaacaagtctttcanttttgaactttatataagctgttttgttttgcttttatacaaactgagattcatgacccattatgaattcaatttagngggtcaatanaagcaagagaaaggaaaaaagaaaagagggagggagagagagaaatatcaaaagacatcatacagagtaagtgcaaattttgtttctttaaactcttattttaacatgtgtaaaatgcacacaaaaatacctatttgtgtgtgtgtgtacagaatatgangaaaagtgtatntcttatctctctcatacggtcaaaacagtttgagagttgctgcctatctattgtatataccaaactttgtccatttctttatgctaaggttaaacagggattggaggggacactttagttttaaaactccactcttgatctgcagccagtaagagcacaacttgcaactaagcagaaagttcaagcaaagaaccttagagtgaaaagagatgactgagggctgaaataaaaaacaaaaagctattccaatttcatttgagtttccattcagcagcctcatagattcctaactcatcacctcaagcaggtcacttcccctctctccaagttgttcgccagaaccagccaaagaatgcaggaaatggtactctctttttctgagtgaatcttggcaaaatgacttcaatttagccagcagtgcaggaagcgattgtaaatataaatttgttttatatgctcctcccaaaggagacttgcagtttgcctccctagtaaacagggatgtgtattcctgatcatcttacttggatcattttttttttcacccttctatgtagcaatgtccttaattgaggtagtaatattgggcttgttggattgtcatgaagtttaatttgaatgttaaaggacccccttggtgctcagataaaaatcattatataaggaggaaaagaaaattatgttgactaattataggtatatagaattcccattcattatgtccacaatgatatgtatctgaatatgatatgttgtagactgaaaatagtaactctccctggttatttccacagtcactttaggcacttgggaaaatgcattctcccattttattcaattaaagtatgtgtaggaatgaggcaagtacagtacaaaaatctccaggaatcaacaaaggaccaccaagagaatttaaatggatttcagccattgtaaacagaagacaatttaagtccaattcactgttgaaaacttaattgaggctgggcaccgtggctgctttgggaggctgactcaggaggattgctcaaggccaggagttcaaaagcagcctgagcaacatagcgagaccctatctctgcaaaactt

SEQ ID NO: 237551 - DNA, 404 bp, Homo sapiens
catttcaaagttgaagtaactgagatggtcaccccgggagtaaatggcccacccagctgttgggatgagtacatagctaatgtgtgggcccagaagaaaggccatggcagcagggtggctgggaggtagcaggctttgcacgtccagaaaattctgttctctcaaaatcaggaaatgtctccacactttaagatgcagttatcctctcctggttggaattgattgcaacatacttcaatttgtgggttattggaatagctggggaaagtctgaaggtaattagacctggatagaccaaacatgtgtggcccaaagaactgaacagtctgtgattagcaccttgatctgaggcccacaggtaggtactgggaaatttccgtgcactttggcttttgaggcagcct

SEQ ID NO: 237552 - DNA, 442 bp, Homo sapiens
cactgaagtcacttgacataattattctatgtggtatgccatcagtctaatatacatttaagtttgtttcagtttgttttcaatttgaggaattgcgttttatttatgaagtattattatttaattgtgcaaataattttcattatttctaagtcaaaccctataccaaagtacattcactggagtctcctttccatccttaatcatcgcacactattctctcctccctctaacaggcagccatttaaaaatttttagttttcattatttgaactaagtgtatatatacacctattaatttttatgtctgtatgtatacgtgtgtgtgactgtgtggataagtgtgttatatctactaatagtaccactttttgagatttctgagatgctttaagatattcaagatacaatgcagaataggcagttttgttttgtttttttt

SEQ ID NO: 237553 - DNA, 369 bp, Homo sapiens
atatcatccatctctggaagatacagggcagctcttcaactaatgtgttcccctaaagtctggtgtgctctgttggctccaacttgagagaagcccccaggaaagaatctgggaggggctttgaccatggacaatactgtggagaagagggagatgtacgtgcgaaagggtaagcttgagctggatgcttggtggtgtttacctgcttttcctcctgctgatgctggtatatgtcagtattagatgataaatcaggtggttggatatccaagtctagagtggtctacactaggattctggtaggcagaaagctgcaggaagcaagaagctggaagccagaagcaggatgcagaaagatgcagtactgat

SEQ ID NO: 237554 - DNA, 456 bp, Homo sapiens
aaatgatttatgagctgaaagataaaatagccattttaagaaagaagcaaactaaacttctggaactaaaaattcactgtaagaatttcataatacagttggaaccattaacagcagatagactgagcagaggaaagagacacagagctcgaaggccagttcttcaaattaactctgtcagatgaaaataaagaaaaaataatttttaaaatcaataaaacctccaagaaagtggaattatgtaaaaaaacaaatttgtgactcactgtcatttctgagagaggagagagaataagcaacttaaaaaacattttcgagtagatagtccatgaaaatttttccaatattgcagagactgatatgcatattcaagaaatacagacaaaccctgtgacatattatataaggcaactatcaccaagtcacatactcatcagattctccaaggtcaaagtg

SEQ ID NO: 237555 - DNA, 600 bp, Homo sapiens
cgaggttatagtgagctgtgatcgcgccattgcactccagcctggggacagagcaagaccttgtcttttatgaaaaagaaaaaaggaatcaaagcattcttggatttgaaccagtaaattccaggcatgtttcccatgtgccagaaactcacaggtacaaagaatgtgagattgtagaaaactggcctccttttcaaggagctcctcagctgttagggagagagattttagtgtggattccccacaaactgcaagtttcacagccaagggctaggaagggagtcctcctaaaacacatagactgctaaccttaagcccatcctttaagcttcagagaaacatctaggaaaaatgaaccattaataaattaactgaattttctagcaagttttctgtgctgaccataaatattaaagccctgtcctgtattgtgtaagtatgttttaaaatcacatttgtatcagagtcttttagcatcttggtctgttttgttgtgatttggtgatgctgccatgaagcgtctacttccccacaactcagtggcgcatctcctgagaaacttgactcctgtgttcagatttttggaagaacatccaggtt

SEQ ID NO: 237556 - DNA, 132 bp, Homo sapiens
aagtatcaaacaccataaaattcccatcactgttctggagacacagacgtaaatggaaaatggattcctgttgtaagtaaagatcaccaggctcctggggagatggatcccagatctacccccatccaccac

SEQ ID NO: 237557 - DNA, 419 bp, Homo sapiens
gaaaaagagccctggcaacacatgtttcagatcacagtgaacagctgaggcaatttttttggtaatttaatattaaatattagagacaatgtatatggtgccgtcatttcagttactgattaaaaataagctctgggcaagtaactttctttagctttctattctgtaaaatgggaacaataaggcctaacgctacagtcagcgtccattataataagcatatttgcaatggctttctttttcaaaaaagatttccaagccattggtcatcttttgtatgtgaacttcgatacaacaaaatttcaactggccaaagaaattgggcagtcttctgccattcattgtaaagaggtttgatttctagcaccattatttattatcttggaaaaaataaagacaaaaacttgaaaaaatatata

SEQ ID NO: 237558 - DNA, 438 bp, Homo sapiens
tcaccgtgtcaagtatcagtggctccactgcggacttcttccacacctgtgtcactgagacaattgaccagtgagttccacaagcacccattgccagctttagcctgcagcagctcattagacctctaccgtccagttggtcatgtccacaactcctccaacatgttttggatctcagccctggaggggaggggactattccaaatttatttcttccttgggtactttgcctcagccctagaggtagtggctgctccctatatatgctattcctgtaatatgtaacactttctaccccttctatagtcggtcacttgctcctagttgataattctctttattaaaattttcaaattactgtctggttttctgtctcctgactggacttgacctactgtatcattgggagcaagatgaaataaactagaatattgtgca

SEQ ID NO: 237559 - DNA, 993 bp, Homo sapiens
ctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgaggtaaaacctagcatcagtaatttcatttctcatgctgttggggattactttggttctccttcattccaactgattgagaagtcaccattagggataaacaaattaaaagccaaatttgatttttcaaaaggcagtaaataaaaacaggataagctgttattcaagaatcatgtttatgttattattgaaagcccacctttggcaattctatctaccactctataggaataagacagttcatttcttccaaatctagattcaagaccacaacttagattttcaatacataagagcctttgcaaaagaataaaatataggctcaaacaataaaactactttagttttaacaaat

SEQ ID NO: 237560 - DNA, 394 bp, Homo sapiens
tacctgaggatctctcttctcgaaaggcacatacaaggatcctgtctataagagatctcacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaagg

SEQ ID NO: 237561 - DNA, 996 bp, Homo sapiens
ctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaaatccagaataacaaaacaacagagatgaacatgaacctttagctactagcaccatccattcactatactacactttattgaagacacttcattagaattggaaacttcctgcgttaattcatctggtaagattctcagtcactggacaatcaaagccatgttagttacgtgcttcattaagactgccttgcttttgtaaaacaagttcataacaccattccaagcatcaaataaatctgtttgtttcacacaatgaa

SEQ ID NO: 237562 - DNA, 793 bp, Homo sapiens
ctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgaggtaaaacctagcatcagtaatttcatttctcatgctgttggggattactttggttctccttcattccaactgattgagaagtcaccattagggataaacaaattaaaagccaaatttgatttttcaaaaggcagtaaataaaaacaggataa

SEQ ID NO: 237563 - DNA, 477 bp, Homo sapiens
cagtaaggagtgtgagacacatcagtgtcctcagatacacatctgtctactcatctctgggagggtcaacaaggagctgctggccagggtcacctcctgggagggggctggggaactggggatgggaatgggggatatatcccaggcaagtaagaagacttggtcaaaaggactgcaagatatccagacttcacatgaatttaagaaataaaacagacgcgggtggatcacttgagctcaggagttcgagaccagccttgccaacacagtgaaacctcatctctactaaagatacaaaaattagccgggtgtggtggcacacacctgtaatcccagctacttgggaggctgaggcaggagaatcacttgaacctgggaggcggaggttgcagtgagccaagatcacgccactgtacttcagcctggacaacaaagcaagtttctatatcaaaacaataaaaaaaaagctgggcgtag

SEQ ID NO: 237564 - DNA, 426 bp, Homo sapiens
gcagctgcgagtcttgcaggagtttagctttgggcaggggcttgatgattttaagcccccttcgcaagttcagatccttagacagcaactctgggacctgcttttcctggactggctggctctgggttggtgagctctgtttgctcgccatcgttctgtggacctttaactccccatctttggaatccactgtcccttcagcgacagtgttcctcatggggcaggggcaacacgtgctggctggagaaatgaaaaatcaaaaaactggctttggcagtttccactggtgcctctgtgctctctggtcacctttccgaggcgtctggtaactagtgcgagaaagtagatgatgcagtatttgttagctccggagcaattacctcatgtctgagtcttgctgcaacatgaggtcagcccaagaaacaa

SEQ ID NO: 237565 - DNA, 535 bp, Homo sapiens
aagcgagttcacaaacttggaagaagccactttcacaggatgcacagatctcaacggaaggacacagaaaacatgaaaaagcaaggaaatggggcgcctccaacggaacccagtaattctccagcagcagatccccatccaaaagaaacagaagacattttggagagagaattgaatatacatattatacagttgtgggcataatacaagcatcatttggaaaagaacagagaaaaaagatggaaggagttaccgtactgcaggaaaaaattatcaactccagtgatattattaaatacaacctaacgacacttctgaagctgaagaaatcactggatgaaatacaaagtaaactcaaaagcttcagtgatagactagaacaagaagaagaaagactctcaaaacttgaaatctgaagcatgtttcttaaagatttaaagggttattatactctggccattaatgtgaacgaaatctgctgggttaattcttatactggggtcttggataatcattaaagtgaaatgagaataat

SEQ ID NO: 237566 - DNA, 502 bp, Homo sapiens
  misc_feature (243)..(243): n is a, c, g, or t
caattcattgagtataaatctaacaaaagacaaacaaatatgcattcaggaaactgaatcatggttgagaggaataaaaaatatataaataaatgcagatagtcctcgtttagaaacaataacttactattgttatctttaccacaaagctaaagtaatgaagagtgatattggtgacggaataagcaaaaagataaatggaacacaatagagaacccaaaagacccgaataaatacagttanctgattttgtcatggggcaaacgcaattcaatggggaaagaaaagtctgttccacaagtggtgacagcacaacagaaaccatagtgggggaatgaacaaagacacaaacttcatggctcaaccaaaaaatcactcaagataatctatagacttaaatttccaaatataaaattgtagaagttatagaagaaaacctacatggatttgggttggtgataaatttttagatacaatagcaaaagcaagtccatcaaagaaa

SEQ ID NO: 237567 - DNA, 556 bp, Homo sapiens
agcctcggctggctggcaggctctcgccgagccgggaaggctgcagtagtcaacgtggctgcgcgcccagcaggcgtgcggacggcttttgccgggtcggggccgcgttccgcacctctctgcggtggttcgcagtcagagggctctaaggccctggcaggctgtatgtaagcgtggaggctcgaacccactgccccctcctacccgtcggacccgcgctgttcccacggcctctggcccttggactcgtgcggcctcaccttcatgggtgccgatcaggacttcaccgagctctcaccggaacagagtcctgttttaaaaacaaaacgaactccttttttttttttttgaaagacctagcttttttaaaagacctagctcttctgtgtgaacagatgtcttgaagaatgcgtgatcttgctctagaacaaacccaaatccttgcaaatgttttgttttttaaaacaagcttttgccttttgtttttgcaggagatcaagggcactgggatataaataaacaaaagcctgacttagtagatgacttccctcccatc

SEQ ID NO: 237568 - DNA, 337 bp, Homo sapiens
gggctttgttgcaactattcaactccaccttctatggcaaaagcagcctccaacaacatgcacgggtgtggcggtgttccaataaaactttatttacaagaacaggtaatgggctaggcttggccgctgagctgtttgcagatcctgctccgaggcagaggaaggaagtgcaggagggctgcaatgagagcagaggccttgactgggagctggtgcgtcaagtgcaaagagccctggggcagaattcaaggcacctggcccaggtgtcccagccaacacccttgtgactttgtccccatcctttaaccctacagctgtcaggggtgcagtgggaact

SEQ ID NO: 237569 - DNA, 409 bp, Homo sapiens
caaagaagagttataaaacagagactataaatggacctcaaagcctaaaatatatactatttgaccctttatgagaaatgtttgctgacccctacccaaaatgattgaaggactcatcaacttgcttcatctttcccttgtcagcctctcatggaatcacctcctgtctccaagggcaccctcagagccaagcctggggatatattatgattctgagcctaaagatcatttggggatggacttgttgagaactaagaggggcctctgggactaagcacaaggtcctgagtaattttttttttttttttgccgggggggtgttgttgagggaagtgttggaaggaacacagcacatgttctagactcaagagtagcagcacaaatagagctcaaggagaccttctcaagt

SEQ ID NO: 237570 - DNA, 343 bp, Homo sapiens
ttcatttcaaagcgtgattgcctctagcattttccagctttaattccttcaggctgttttgatgttgtgtctgtacatctaagaatattgtaattcttatctttagaagccttgtcaatgtgaaacaaacagcaactgatgcaagttaatgttgacaactttatattgagtacactgtgtgttattttatttgtaagctagtgaaatatgcaagagtaacatagcatgactgttgttccccagggacccatatcaaaacaaagtggggaatcacatgaggctattccatggagaacaattcaattatttttaagatgaataaaatttaagattcttggttgta

SEQ ID NO: 237571 - DNA, 113 bp, Homo sapiens
cgagacctgccttcttaaggtctattctccatgtggccgctggagcaatcctgatacaagtcagatcatatcagccctctgctcagagctctgggttttctacccaactcaga

SEQ ID NO: 237572 - DNA, 598 bp, Homo sapiens
tctgggaaggcgcgccattgtgtgggtaccgggaaatgcgcccttaatgccgggataggtttcctgggtgcaaagaggaaaataagatggtgaatatgtatcattatctctgtcacacttaacgatgatttcagttgcagttggacaattcttggacctgctgtgcggtgtattacgtctgtccaaattgcatggatgaacacaaagtaattgtggaatgaaagctgggagatcacccatattcactgcaataattcaggtttttggagaacaggtggtgtctcgttacatgaatacgttctttagtggtgatttctgagattatggagcacccatcacccgagcagtatacactctacccaatgtcttgatctgttgctcaggctggactgcagtggcaggatcatggctcattgcagccttgaactcctggactgaaggaatcctcttgcctcagcctcctcagtagctgggactacagcccattttctgtctataaagccaaccacatctgctccattcatgggaacacctattctgttttactgaatgaagtggtgcctgaatctagaattgcaataaagccaaccgagatctt

SEQ ID NO: 237573 - DNA, 470 bp, Homo sapiens
ctcttgaagctgacaatggagggagaggactggtctgccaagagagccaaccctaaggtcagagaagagaagagagcccctgggtgctcagcagggtctgagcctcagtgtctgaatctgcctgtgactctggcgtcttggggggctctctgacaccctctcccttaccctctccctttagatcccttgcctttcactgctcttttctctgctactgtctcctggcctgtttgtctccccacccatctgcccaccatccacgtgacctttttgctgctggagctgctttttggggcctggctttccttctttcaccatctccttgtctctggactcttctcaggttactctttctggctgtatcttgctgagggtgtgtctgtgtctgattcttgcctatttttttttaggaggctaaaacggggaaaagagctcatgaccccaggataaaatccattcttttgtaacgt

SEQ ID NO: 237574 - DNA, 625 bp, Homo sapiens
tttaagtgcaatgctgtttactttcattacccattttacacatggatttttcttttaaaacttacagcaatagttgtaaatgcgtaaaaggcagcttgttctatttgtgatgctactatttattcagttctagcttgacatggtttatatgatttgagttgtatttttaaagaatgcatagatatcctcattattttaaaaacaagcctgctcttatgtttactttgcctaatgtaatctcaaaactaaacaaaataggcaagttaaaggtggaaaatagggacagaatattgttgtttttgagtgcatttaaaatgaacacgagttaaccatgaaaccttagtgactgaatgtactacacattttaatggcttgaaaacatgagctaagtcagttttggctttgttactaatgaacccttgatagataagcattgtttaaaaaacaaagtaggatactcttgttctcttgtatatatattgagttatctatttggtaaggaatgttgacactttcagtcttaatgagagggtagaatgtgcagtggctcatgcctgtaatcccagcactttgggaggctgaggcagtcggatcacaaggtcaggagatcaagaccatcctggcc

SEQ ID NO: 237575 - DNA, 3143 bp, Homo sapiens
  misc_feature (1813)..(1813): n is a, c, g, or t
ttaatggtcagaaacaatatttaaaaaaaaaatagccaacaacttcccaaatttgatttttttaaaaattgtgtatctaagaacctcaatgaactccaagtaggacaaaatttttaaaaacccacacttagacatatcagtcaaaccgttaaaagacacagaatctttaaaggagcaaagaaaattggtacatcacatgtaaggagtctcaataagattagcaactgacttcttatcagaaaccatgaaggccagagggcaatgggatgacatattcaaagtgatgaaagaaagaactgtaaaccaagatttctatatccagcaaaactgttattcaataatgaaaaaatgagataccacttcatttgtactatgatgagtataattttttaaatcaagacagaaaagtgttggtgaggatgaaaagaaactggaaccttcgtacatggctgatgggaatgtaaaacggagaagtcactatggaaaacagtttggtagttcctcaaaatcacagaagtactatatgatccaaggctgggcacagtggctcacacctgtaatcctaacactttaagggccaaggtgggaagatcacttgagctcaggagttcaagaccagcttggacaacatggcaaaaccccatctccacaaaaaatacaaaaattatccaggtatggtggtatgcacctatagtcccagctactttgtgggagctaatgcaggaggattgcttgagcccaggaggtcaaggctgcagtgagccatgttcacaccacagtgctccagcctaggtgatgacaaagtgagaccctgtctcaaaaaaaaagcctgggcacagtggcttatgcctgtaatcccagcactttgggaggccaaggcagcaaatcacttgaggccaggagttccagaccagcctggccaacatggtaaaaccccatttctactaaaaatacaaaaattagccagtcatgttggcacatgcctgtaatccaagctacacaggaggctaaggcataagaattgcttgaacccagaggcagaggttgcagtgagccgagatcataccactgcactctagcctgggtgatacagtgagactccatctcaaaaaacaaaacaaaagaagtattatgtgatccagcaattccactccatggtatagatccaaaagaattgaaatctggggcttaaacagatacttgtacaccattggtttgtaacattattccaacagccaaaaggaggcaaaaccacaaacgtcaccaacagatgaatagataacgtgttacataggtaccatggaatgttattcagtcataagaaggagtaagatctcatacatgctattgtatgtatgaaggaaagttgaaaacattaagctaagtgaaatgaggcagacacaaaaggacaaatattgttatgattccacttatatgaggtacctagaataggcaaatttatagaggctgaaaatagaatggaggatatcaggggttagtggtggaagtgaggaattattgtttagtgggtacagattttctgtttgggatgataaaagttctagaaactgataatggtgatggttgtacaacattttgaatgtatttaatgcattgaattacacacttttgaatgtttaaaattgttttatgtatattttgcaataattttaaaacaaaaaattcctcagaaggccaggcacagtagctcacgcctgtaatcccagcactttgggaggctgaggcaggcagatcatgaggtcaggagaccgaggccatcttggctaacacggtgaaaccccgtctctactanaaatacaagaagttagccaggcatggtggcaggcacctgtagtcccagctatttgggaggctgatacaggagaatggcatgaacccgggaggcggagcttgcaatgagctgagatcacaccactgcactccagcctgggcaacagagcaagactctgcctcaaattaaaaaaaaaaaaattcttcaggaattcacaataaactattagaaacgaaaaacaagttcagcaatgttttaggatacaagatcaatatacacaaatctattgtatttctatacactaataatgaagaatccaataatgaaattaagcaaacacttcagtttacaataatatcaaaagaacaaaatacttaggaataaactgaacaaaaagtctaagacttgtacaatgaaaaatacaaaacatcatcaaaagaaattaaagacctaaataagatacatctgtcttcatggattagaagacaagatggcatgattgccaaaaatgataaacagattcaatgcaatccctatcaaaatcccagttggctattctaaaatttatatggaaatcctaaaattcacatggaaatataaggtacccagaacagctaaaacaatcttgaaaaataacaaagttggaggacccatacttctctatgtcaaaacttactaagctacactaatcaactcagggtgttcaggcatagagacagacatatagatgaacagaactgagagtctggaaatctaatcaactgattttcttttttttgttttgttttacatttagagacggggtctcactctgtcacccaggctggagttcaccctggagtgtaatcatggctcaaggcaaacttgaactcctgggctcaactcccacctcagcctcccaaagtgctgggatttcagatgtgagccaccacgcccagcctacaatcagttgatttttcaacaaagattccatgataatccaatgaagcaaagaatagtctttttagcatgtggtgctggaataaatagaccaggcaatggtttctaatataacactaaaagtacaagtaacaacaacaacaaaacaactggacttcataaaaattaaaaacttctgtgcttttcaagggacactatcaagaaagtgacatgaaagcccacagaatgggagaaaatacttgcaaatcacctatccagtatatatcaggaattcttacaactaaacaataaaaagacaaccaaatttaattataggcaaagaatctgaacagacattactccaaataagacatgcagatgtccaataagcacatgaaaataccctcaacaaaattagccatcagggaaatgc

SEQ ID NO: 237576 - DNA, 736 bp, Homo sapiens
tacaattcttcttcctcagcttccaaaaagttggataataggcataagccccgtgcctgggtgttatatactatcttctgtaagaaactcatcaattaatttttggcctaacatatgaagtgagcagagatgatacctataaataagaagccaacatgaataagccattttgtttgttaaacagaagcgtgctatcatgaacaaatgccaaactagaagccacaaaaatgtaggttctatcttcactctgttattttattttacaatcctgggaaagtcatttattttcttccttttaaaaatggagttatagtaaggctaaaatgaaatcatgttccatagaaaccacttataatgtgtaaaatatcatgtaaatgtttatgaatgaacaaattaaatgtcacacactggaaaagggaacttgcacagagctagccttcgaggtactggctcatataaatactatgactaggactagatttaagggggatttccaaacgttttggccttctgccatcttattgttgatttttaagtttcatacatatttcttatttcaaagagtttttttggtgtaatgtacagtacaccaaattttacaccaatcagtatatgtataatatatgtataatagttgaaaccctgggtttgatgaatcaggagactagaatgctgaaagtcagataccctggccatttaagtacccaacaatttgtgttcatagtaaaggctcaac

SEQ ID NO: 237577 - DNA, 1025 bp, Homo sapiens
ttgagacagggttttgctttgtcactgaggctggagtgcaatggtgcaatgacataatcataggtcactgcaaccttgacctcctgggcccaagcaagcctcccacctcagcctcccaagtagctgagaccacaggaatgcactaccacacacagctaattttttttacttttgtagacacaggctctccctatgttgcccatgctggtttcaaacacctgggttcaagcaatcctcctccctcagcctcccaaaatgctgggattataggcatgagccaccgtgcctggcccagtttcacctttaaaaaataggttagataagactttaaatccatctaaggaatttgtgtttatatactatcttctgtaagaaactcatcaattaatttttggcctaacatatgaagtgagcagagatgatacctataaataagaagccaacatgaataagccattttgtttgttaaacagaagcgtgctatcatgaacaaatgccaaactagaagccacaaaaatgtaggttctatcttcactctgttattttattttacaatcctgggaaagtcatttattttcttccttttaaaaatggagttatagtaaggctaaaatgaaatcatgttccatagaaaccacttataatgtgtaaaatatcatgtaaatgtttatgaatgaacaaattaaatgtcacacactggaaaagggaacttgcacagagctagccttcgaggtactggctcatataaatactatgactaggactagatttaagggggatttccaaacgttttggccttctgccatcttattgttgatttttaagtttcatacatatttcttatttcaaagagtttttttggtgtaatgtacagtacaccaaattttacaccaatcagtatatgtataatatatgtataatagttgaaaccctgggtttgatgaatcaggagactagaatgctgaaagtcagataccctggccatttaagtacccaacaatttgtgttcatagtaaaggctcaac

SEQ ID NO: 237578 - DNA, 468 bp, Homo sapiens
gcattaaggtgaaggtttttgttgtaggcagaacaatggccccctaaagatgtccaaatccaggtccctggaatttatgagtaggttactatatatggcaaaagggactttgagttgtgattaaggggtgttatgggctgaactgcattgcccccaaattcttatattaaaatttgaatccccagcacctcagaattggactgtatttggagacagagtgtttaaagcggtcattaggttaatgttgtcatgagggtgggccctaatcaaatctgcctggtgtccctgtaagaagatgagattaaggaacagacacatactgagaaaggaccacatggacacacagggagaagacggccatctgcaagccaaacagagagccctcagaagaaaccaaacctgctgacaccttgctctccgacttctggcccacagaactgtgagaaaacaaatttctggtgtttaagc

SEQ ID NO: 237579 - DNA, 2492 bp, Homo sapiens
  misc_feature (881)..(881): n is a, c, g, or t
  misc_feature (993)..(993): n is a, c, g, or t
  misc_feature (1763)..(1763): n is a, c, g, or t
tattagatggggataagtaaagattatgataacttcatgtcatttcaggtcagattttgcttccaaatgatttgcacacacttaggaaaaaaatttctgttttcagaacgttttggatttcagaattgcagataaaggattgtggacccataattttctcctgttttgcactggcggtagtttaacttgtggaccatcaaaaaaatatgtttgagagaggacccttatcacctcttttgtttaaaaagcaaaataaactttgtttccaccaaaatgcctgcctccccgacatttaggggctgctgtggcaccattcctgtgtgtgtccccttggtagcttagttccaagcttgacagttctcaggggtggggagttctctctgctctcccttaccctcacccccaccagtctcttcagctgcatcccgtttctcctcttctaagggatctggagagttgctggcttccatcatcttccgtgtgaggaccgtcacagcttgcactgctcagcaggcagcttttctggacaccacactctccccaagcctttgtttcttgattttgggagcattcgccatggaaaccattttggctcatcttatcccattcccaggtggtctccaaggctttgcccacacagtgccacaatgaaaaatgcagcctggctcaccggtttgcttttcacgttttcatcgcttatttggctcatggcacaatcccacggaatcctctgcagagggtggtgttgcgccattccctctgacccaagtgttggctctcactctgctcagtgtgagacacacctttcacacccacagtgatgcctcactgcatccaaagccattctgagattagcacagtctcaggccagatggtttgancaattccaattcctgctcccacgttggctcctttaggcctcgtatgttccatttagctgttgtttctccggtatatgaagtacatcaagcagtgagtatcttcagcaactgnctataccagtaagtatctggctgtcggtggtggtggctgtagtttggcagtactaccagcttctcccagcacctggcttatcagaatacaggattcatgccatgtggctcttacttgggccaagagtcttcagtcagcccagtgacttaagttgccaaggaaactgtgtctagtgagacctcaagatttacaactcattcctaggctacaaggttttctccagaatttttgctgacacagtttattcccataacctcccagccctgtggggtgtataaatctttgagcttctctggagaattcactttactgcatgcaaggcctagaatagggatcaaaagaagtttggcttcaggggcctcatgaacttggaaattgtatgcactattttgtgtggatgtatgtatgggcattttttttatgggaagaggcttgcactgggtgctcagcagcatattctgaaacagtgtagacttgggaaatctatttagtcttctgagcctctggaaagtgaggataatactagattctgtcccattcatttgtaatgaggataaaatgagaagtgcatataaactgtctagtacagtgtccataaatattcataaatgttagctatcatttgactgtgagcctcaaagggttaagatgatgtgactgcctttcgttccttaggattaggtggcagatatagaatttgaaatcattttctttatgctgcacagaaaatcttcacagtactgcctggtgtgatctccttagcatccttnttggtgggtgggaaagagtgcatgactatcctcttttacaggtgaggaaactgaggctcaccatgatcacctagctaataaggctccaaaaaaataggtcctgctcacaatctggtgggacaaacagatcctaagacaagcaattacagaccacgatgagcaccatcacccttgaagtacaggatgttaaagcatctacgaaggtcagggcaggcttcctggggtgacaatccgatccctgaaatgtgggtaggaataggttaggcaaacgaatggactttgagagagtgttgcatgtagaaggaacagcatgtgctgatgcctcgagggagggagcgctcatggttcgggtgcctcgcagcaagagggagtgggagatgaggccagggggaagtttcttttaacccctaaaaaaaaggagatgaatgtgcaaagaaaaaggaaaggaaggccgggtgcggtggctcatgcctgtaatcccagcactttgggaggctgaggtggatggatcacatgaggtcaggagttcgagaccagcctggtcaacctggtgaaactccgtctctactaaaaatacaaaaattagccaggcttggtggcaggtacctgtagtcccagctgctagggaggctgaggcaggagaatcgcttgagcctgggaggtggaggttgtggtgagccaagatcgtgccactgcactccagcctgggcgacagagcaagactgtctt

SEQ ID NO: 237580 - DNA, 546 bp, Homo sapiens
aggatgtaggggaaaggtggaaatcttagagactgagggtcttaacgtaataaacttgaactttaaggaactgcttaaaatactgaatgaacccaggtttctgggttagaataaaaacacattatttcccctcccgtttgtcagtgactgagatttcatgaagatgatcgaatcagtttagacaaaatgaaaattctacctttttgtacctaaattgcagtgtagttgcaatccccatacactcaacatcacttaatcattagcttgagatgtctgctattacaatcaaaatcctaccaatcatccgagccccaactcgtatgctacattcttttgaaatgattccctctgtcaaaaacctttatgttgtatttctgtggggctttatagttctgttacagacatcatgttatgatttataagttattaatgtacatgaagaatcagaatcaaattttagggacttaaatatatctaattcaataccttatccaatgtcaaagcccttgacaagaagttatttatctcctaataaatattaaatta

SEQ ID NO: 237581 - DNA, 431 bp, Homo sapiens
cttccaggttgtcagcagacttaggagcgggaggtacagggtgagatgctcttagctggattggatgctgggcccaccttggcctcctgcttccagcaaggccccctctgaataccatcccagccaccagcagcctccctctccttaccaggcttgccttccctggttggaacctcagatctactgctctctgtagctcatcctttcctcccctcctcaagtgcttattatgcacctgccatgtgctacacgccttgccctgtactcctcctccctcctgtgggaagggtcagctgatacagacccaccttatggtgaggaaacaaacctgaaaatgatcaaatgggaagttcccgggagcaataagagctttgagcagaatttttttttaaattttattttattttatttatttttgagacagagtctcg

SEQ ID NO: 237582 - DNA, 496 bp, Homo sapiens
tggggaggctaaggcaggagaattgcttgaacctgggaagcggaggttgcagtgagccgagatagcgccactgcactccagcctgggtaacagagcgatactccgtctcaaaaaaaaaaaaaaaatagatttcctcactggcaatgactccctctgatatttctttggggccaatatactcttgaaattatttgatttcccctgactctcgaagtccccctttccttataattagatgaacctaacctgaggcctctattgatgggaaagggctttcaaaggcaacattcagagagtttgcttgaccagaaaggtcagcagcaagcacccagctctggtacaaggccatatgttctttaaggaataggactccattaacagactttgttactggagagttttttattctttccttttcagacctagaaggatatctgaagtgtttattattagtctaaactgagagcaagtgagtgtccttatcattcaaaaacaa

SEQ ID NO: 237583 - DNA, 394 bp, Homo sapiens
aacccacacacacgtatatatcaattagaggcgttagcatagtggccctaggtgtttaagtacaacctgtgactgatcgttggctgaccactaaactgtgttaacacaggggaaagtcccagctcaaaaacgaaaatggaaattacacaaactgagcagaaacatcagcagcggcacagcatggggaagagaggctgcacagagttatgttaggcaagtcctaaataaacaaacacagcaataacagcaacaaccctcaacagggaaaagtcagaagccagagttgctgtaatatgctatataaaatgtcaattttcaagaaaaaaatgagacatgtaataaacaggagtgtgactcatacccaatttaagaagtggttaaaagaaagtgtctg

SEQ ID NO: 237584 - DNA, 167 bp, Homo sapiens
agcaatcctcctgccctggcctcccgaagtgctgggattacaggcatgagcactgcacccggccagcatcaatctcttgaatgaatgagtgaatgatgttttctaggctcctacaatgtgccgaagcctgtgctgtgtgcttgggactcagcattgaccaagacaga

SEQ ID NO: 237585 - DNA, 921 bp, Homo sapiens
  misc_feature (414)..(414): n is a, c, g, or t
ctttctgctctcctcactgtgatcagcctcttcgttgtgtgtatcagtcaggatagggagggttaggctgcagtaacaaacaatctcaaaatgtcaatggctttaaacaacaaagatgtatttcttacttacctcatatgtccactgcaggtcagctggggctctgctctgcatcttcctccctctggaaccctagctgagtgagtggtcactatctggaacattgctggccattgtgacagagggggcactgagctctggagggtttcacacaggtaattaaatggctttggttgggaagtgacacccttctactcataacttattggccacctaatcccatggtaccacccaaacacagaagagccctgatatggtttggctgtgtccccacccaaatctcatttttttttntgaactctgaactttttattggcctcctgctccccaaagggtaccctgcttctgctggcttaatgcctcagaactttggtgtcattggtctcagacaccactttgccatccactatccggcgggtggtggtcttttggatggtttgcatggagttgctgctgtccaaggcatcaccaagattaaagtcctcgccatcttccagcaggcggcggtaggtggcgatctcagcctccagcttgaccttgatgttcagcagggcctcatactcctgggcctggcgctgtccctctgcccgggtctgtgccagctctgactcaaggtgcagcaggatcccgttgagctgctccatctgtagggcgtagcgggcctccacctccctcaggctgttctccaagctggccttcagatttctcatggagtccaggtcgatctccaaggactggactgtacgtctcagctctgtgagcgtcgtctcagcagctccaacctcactcgtgccgaatcct

SEQ ID NO: 237586 - DNA, 371 bp, Homo sapiens
atggcaaggactgagaagtggatgaaaccacactaagaggatacccctcaggtcatcctttcacgagtttaactcaaaaataggcagggagccggaaacatgtctgcaaggcattacagaacccatgcatcattacaggggattactgagacgtaggggtggaggagcagggatagagacctctcctcagcccatctaaaccctctcccaccactacagccatcctcttcagcacagatgagcgctcacacctcctacgcctccttccccagagccttacagaaatttccagacccgttgtctattttggagagtgaaacttgcgataggatgaccaaggagtcttcttttggtgtgacttcctccacttc

SEQ ID NO: 237587 - DNA, 542 bp, Homo sapiens
aataggaccgcacaccttcaaccatttaatctttgacaaacctgacaaaaacaaggaacgtgtaaaagactctctatttaataagtggtgctgggataactggctagccatgtatggaagattgaaactgaaccccttccttccaccatatacaaaaatcaactcaagatggattaaagacttaaatgtaaaacccaaaactataaaagctctggaagataacctaggcaataccatcctggacataggtacaggcagagatttcatgatgaagatgccaaaagcaattgcaacaaaagcaaaaattgacaaatgggatctaattaaagagcttctgcacagcaaaagaaacaccaacagagtaaacagacagcctataggatgggagaaaatttcagcaaactgtgcatctaacaaaggtgtaatatccagcatctataaggaacacaaacaaatttacaagaaaaattatgagctaatattgtatatgtgcttacacgtatgtgaaatagtataatgttgattaaagtttacctctgata

SEQ ID NO: 237588 - DNA, 576 bp, Homo sapiens
aataggaccgcacaccttcaaccatttaatctttgacaaacctgacaaaaacaaggaacgtgtaaaagactctctatttaataagtggtgctgggataactggctagccatgtatggaagattgaaactgaaccccttccttccaccatatacaaaaatcaactcaagatggattaaagacttaaatgtaaaacccaaaactataaaagctctggaagataacctaggcaataccatcctggacataggtacaggcagagatttcatgatgaagatgccaaaagcaattgcaacaaaagcaaaaattgacaaatgggatctaattaaagagcttctgcacagcaaaagaaacaccaacagagtaaacagacagcctataggatgggagaaaatttcagcaaactgtgcatctaacaaaggtgtaatatccagcatctataaggaacacaaacaaatttacaagaaaaattatgagctaatattgtatatgtgcttacacgtatgtgaaatagtataatgttgattaaagtttacctctgataatttatgcatactattataattggaagactatcc

SEQ ID NO: 237589 - DNA, 214 bp, Homo sapiens
gaaatggagtctttctatgttgcccaggctggagtgcagtggcacaatcagctcacacagcctctgcctcccgggttcaagcagttctcctgcctcagcctcctcagtagccgggattgcaggtgtgagccaccgcacccagccctatcttataattattgatagcaagaaaagcatattcaccatttgtttcagttctcattgttttcgcttc

SEQ ID NO: 237590 - DNA, 495 bp, Homo sapiens
atttagatcccagatgaacccagatgaacctcaatcccagatgaacctaagagctaaggtgaatctaacactcaagtccctgaagacagggctggttgctgaaagcatcatcagtaggcaacttgcatttcaaggcttcctaagaagagcgtccaaccctctccacactgcattcatctcttcctggggaagaagctacgtctttgcttcctgagtcaagtggcaggactgtgaccacatgtccctgccctgctggggacttcacccaccctccaaggagagcctgcttcttctcctagcacttccagcctctaccagtcccgacttctccagcctttttgttgtgttttattatgcaaatgatatcttggttgaggtcgagccatttcttgtgtctgacgttaaaaaaaatgataatttcctcagcaagtcatcgtcgttaatgaagttttacaaaaacagatacaaccaaaggaaaataaaatttcacaggtg

SEQ ID NO: 237591 - DNA, 717 bp, Homo sapiens
gtagtggtggtggagatgggtgtcggggttggggtctgtgtgccggtgggtgttggggttggggtcaccgtaatggtggtggtgatgggtgtcgatgttggggtctgtgtgccagtgggggcgcggttgagtatggggtggggcgcagtgctgaacagggcacaggaggaggaagcgaacagggaccctttggctcccagaacatgaccagctggggcttttccctgtagacaggaggatggatgtgtctttggggaatctgagtagcccaagagaaaagacctaaaattaatgacatcaggaggtccccagtcagcagacccagctggatcccttgctaacgaagcccgtcattaataaccccctcccagtgttcaaggcatcaagctttaaaaatccccatcccttaaatatgagcagataaccaagggcatctgaagaaaacctctgctacaggagattgagaccagaatacacactgggaaaccagagagcgtgcaggaaggagccttagaaagcaggctgtcattaatgtccacgcggaggtgagcgaaaatatcgcgaacatgaggcaagaacaggaagctctaaaaaaaagccaccaaaaggagtattcgaatatccaaaaaagagaactctcggatgttaaaaaaaaaattaaaggcgaaattagaaaatcagttagtgggtgaaagataaagttgaggaactccctca

SEQ ID NO: 237592 - DNA, 1022 bp, Homo sapiens
aaagtggctctcatataaacattgcagcatttcccccagaaaactgttcccaagccttccgtcactggccgacccatcttggaggccttctgcctctgggctggcgggtccctgccatggggcccagggagggtctgggtgggccagtggtggcaggtagcccaggcccaaagctacccagaaggagccagaaacagagccctcagaacacatgtggggagtgagacgccagcacgttgtttggagatgcatcctgtctcccagatgtcttgtattatcatcgactcactcggccaaagatggtagggtccccagacagccaggaaggagggatcctgcgtgcctgttctcgattgagccaacgtatgaccgaattctccattgtcggtttgcattcagaggatggatgaagtggacgcagaggagcgggagggagatgatttatcaaagccatggctttcgtccctggattccagaaaagcttgcatctgaataacttatgtgtgtagaaactctagggggatttttttaaggcagaaaaagatagggaactgagaggagcacgaaaatagacttcagctccatacccgagcctcgctgggcaggatggagctggctggctgggtgtatacttccccctccagaaagcagatcattttcaaacaagaaatgcagttacagtcttctacaagctggaagataaagtcaggctggcggatgatatccaggcacccaccatcccatggtctttctgctttgctggcgggagtttggggaactgggatctgagtctggtctgcactggagaacagtcttgtttttacattcctagatgatttcattgttcggggtattcttgtgggcttcctggttgttgttgttgttgttgttttttaaacgatagttcagtttctgctttttcttttgtgtcagcacagtccggtaggactttctgccccggctgctgttgcaggtcaccttctgatttggcgcctcctaggaatccgtgtcccccatactcc

SEQ ID NO: 237593 - DNA, 329 bp, Homo sapiens
ttcgattttgatttgcagtcaaatgagtcaacctcatactaactgctgttagctcaggtcttccctcatctgttagtttcctggagtctgttctcatactatactagacttgtgcaaagcacaaaaactaatgatttttatagtattttttattctaaggtgtgatatatctttcagaataaagtcatctggtaaaatgaaaagtccttaaatatccttaaaatattaattttgacactttattccatagaaggaatgcacatagaagttaaattatttatatattccattccttggaagacctcagcaaataaagagattccaaatga

SEQ ID NO: 237594 - DNA, 369 bp, Homo sapiens
ggactataggtgtgcgccaccacgcccagctaattttttgtattttagtggagatggagtttcaccatgttgcccagggtggtctcaaactcctgagctcaggcgatctacctgcctcggcctcccaaagtgctggaattacaggcgtgagccacatgcccggccgagaaagcattttcttaatacctcccaaggtagtattaattatcctagagatagtgacttttgtcaaccatgaaagtataggtaacataagcgctagaagttcattaaagtaacttttaaacccaccttaaattatggagcttttactagtatattaagttggtgaaatctaaattcttttctacgtcattctggaaactgcta

SEQ ID NO: 237595 - DNA, 1046 bp, Homo sapiens
ggggctcagatactagtagtggagtggtggggcttggttatcctcttgttttgtgactggaccactgcccaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcggttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgagtatgcacctctctgcttaatcttttctaaaatcgcctgtatgaaaaatacctcgctggatggaaaagtagatatgaacttacatttctgtgcaagttgttttttcacaaaatatcttcctaagaggcagcatggtgtggtagaaagaacacaggacaagggagagagagccaaacaggctgtttatggctctagctgcgtactgactataaaatagatgctggactctggttggtaaggtcccttccagcagaaccattgagttatactgggatgacatggaaagcttaatatgtagaattatgtaataaatggctgtcatttatg

SEQ ID NO: 237596 - DNA, 732 bp, Homo sapiens
tagatcagtactgcacctagagcataatcagctgtgtggctctagctgcgtactgactatacatagatcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgagtatgcacctctctgcttaatcttttctaaaatcgcctgtatgaaaaatacctcgctggatggaaaagtagatatgaacttacatttctgtgcaagttgttttttcacaaaatatcttcctaagaggcagcatggtgtggtagaaagaacacaggacaagggagagagagccaaacaggctgtttatggctctagctgcgtactgactataaaatagatgctggactctggttggtaaggtcccttccagcagaaccattgagttatactgggatgacatggaaagcttaatatgtagaattatgtaataaatggctgtcatttatg

SEQ ID NO: 237597 - DNA, 599 bp, Homo sapiens
ggggctcagatactagtagtggagtggtggggcttggttatcctcttgttttgtgactggaccactgcccaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcgggtaaatctctccggtcccctgggggaggggaggaatagagctctggcaatggagcaaggtgtactgccccagcactaagcacctgctgtgtgcctggaagaagccaggagatggattcatgtttttcatcaattttgaaatactgaatgggagcaagtcaatattcaaagagatacaggctcttcaaatattgcctctcctccattcttcttaaattcctctctctagaattttctataatgtaccttctcatctatcctccatgtctcttgacctcaactaaatatttcccttctctgtattcatggtggtacattctaattctctcaagagctatcttccaggccactaattctttggctatgcctagtttgctg

SEQ ID NO: 237598 - DNA, 1834 bp, Homo sapiens
  misc_feature (74)..(74): n is a, c, g, or t
  misc_feature (749)..(749): n is a, c, g, or t
  misc_feature (1050)..(1050): n is a, c, g, or t
  misc_feature (1523)..(1523): n is a, c, g, or t
  misc_feature (1570)..(1570): n is a, c, g, or t
  misc_feature (1691)..(1691): n is a, c, g, or t
  misc_feature (1714)..(1714): n is a, c, g, or t
  misc_feature (1779)..(1779): n is a, c, g, or t
  misc_feature (1783)..(1783): n is a, c, g, or t
  misc_feature (1789)..(1789): n is a, c, g, or t
  misc_feature (1791)..(1791): n is a, c, g, or t
agaggagacgctcgccgtcccctgacccccagctcagcgccggctccaagcccagccagtgatccctctagccntctccagtcgcctccgccatgtccgaggagctggcccagggccccaaggagagccccccggcgccgcgtgcgggccccagggaggtgtggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgggctggtgctgtttggaatctgcaccctcatcatggatgtcttcaagaccggctactactccagtttctttgagtgccagtcagccatcaagatcctgcaccccctcatccaggctgtgtttgtcatcatccagacctactttctctgggtctctgctaaagactgcgttcacgtccacctggatctgacctggtgagaactgcagctcgatgcctgtacccagcgtgctggtgttcaccttgcaggagagattcaggctttccaccctggggcagggcctctctttatgtcccctgggtggggttgcagccaagccctccttgctttgtcaggctgactnccactaccttgtggggccctttctcccaggggagggagtggtggtggcccccgggaaaacctcctagccctctctttggtggcataccagccaggctgtgttcctaccaaaatcagcttccctgttcacacagggcctggctgctttatcatttctcaacaccagctctcagtattgctccccaacctgccaaagggtcacaggcctctttgtccccacccctgaccccaaacaggtgtggtctcatgttcacactcaccaccaacctggccatctggatggcggccgtggtggatgaatntgtgcaccaatcccactcctacagcagttctcacagcaacgccagccacgcccgtctcatctctgaccgtgagtttcctcttaatgctggccctgtggctaccaggccttgggccgggtgctttgtgaatttataacgtcagtctcctgtgccctcatgagggcatagaggcaaaggacagagccagggtcctcctcctgttgcaggatctacctctgcagtataggtgtaggtgaccccagaagggaagtatcaggggtacccttttatccttgaggctgcagcccaggcccccctgtccagtctccatcccactgcacctggcctggactgttcttactgagcactgatgtgtcccagtctctggcacacagtaggtgctcaagaaatatttgtgaagtgaaggagtgtgccacgccctgtaaaggcatgagggataccgtggtgaatatagcagtcatgacagacagggngcctgcccttaacaaaggtcacaagctaggctgggcgtggtggctcncgcctgtaatcccagcattttgggaggccgaggcaagcagatcacctgaggtcaggagttcaagaccagcctggccaacatggcgaaaccctgtctctactaaaaatataaaaattagccnggtgtgatgacaggtgcctgtantcccagctacttgggaggctgaggcaggagaatggcttgaatccgggaggtgaagcttgcagtgngccnagatcncnccattgcactccagcctgagcatcaagagtgaaactccgtctc

SEQ ID NO: 237599 - DNA, 204 bp, Homo sapiens
ccttgaccgacttgattcctatgatcaggcaagtttaagaaacactgttttaaaccatataccatctaccattactctagttcctttcatttgacctgtagatagcatctttttagaatttcagagcatcataaactaagagataatcttatctgacctctacaaagtgcaaattttaaaaaatcatgttttgattggccatca

SEQ ID NO: 237600 - DNA, 2174 bp, Homo sapiens
  misc_feature (1049)..(1049): n is a, c, g, or t
  misc_feature (1904)..(1904): n is a, c, g, or t
  misc_feature (2115)..(2115): n is a, c, g, or t
agagcgtggagcgctgcgcggcgcggcggccgggccctcgagacggggacggacacaccagcccctcagataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacatctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacgggttcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacatgctgggcgtcctcttctttgccatagcctgcttcttatacaagcccctgtcggagtcccagttcagcctgagtgcctcagaagctgccaccttgtttgggtacctggtggtgccagcgggtggtggcggcaccttcctgggcggcttctttgtgaacaagctcangctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgnggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagccngaggaaggcttgtgtgtcctcagttaaaactgtgcatatcgaaatatattttgttattt

SEQ ID NO: 237601 - DNA, 2215 bp, Homo sapiens
  misc_feature (2123)..(2123): n is a, c, g, or t
tcaaatgaattcacacttaagctacttaatagaaaaaaatgtgaacctttatcatttagagctactaaacacttcattaaacaatatcacttaatctttgctaaacacgaactagaaaaactaggcacaaatagaaactgtatagaccagatatacattagaatgggtctgctttagcagttaatggtttaatcattaaccaggtcagggtatttttctctaaggcactttatgtgttgctgactcttctacaatctaagtggctcaatgtaaaccattccccttgtgctaaacatgcgtgtttatacttaaagtcgatttcactgaggaaattagggtagggtcagtttgtaaggttttgccctaaaccttaaaaagaacacaaaatccttcaggtcttaagcaagattgatgcccaggccctatgaaggacacattgaatcttctgtatattttttaacaagctccacaggtaatttggatgtggctggcattgcctcgtgcacacctaaagtaaccatgcttagaaaacgctgtgttatccaaaagaaacacagcacagagaattctatgaacaaactattgcagtactctaagattttaaaataagtaactttctcaaacactgatatggggtttagagttaacactgcgggtaagcaaacccaccaggctctctcagttgacacagctcttctggctccttcgaggaagtgaggaccagtatgtggaagagcctttggggctggtgtttctcaagctacagcttcaggcaatctcagggacagaacctggactgtgcatctgacagccgcctttctacctcccacctccaccccattcttatgtccaagtagtttgaaactattgagctagatcagtatatcccgaacaccaaattgttaagagtggatggagccccagtgatctttcccactccccagaccagtgaatcaggaaatctctactggaggttctgcagtaccccaggttctttatctaaacaggaaagttaggaaacaccaatttaggtcaaactcattttaagataaggaaatcaaggcccaagaagtttaagtgatttcaccaaggacttatagctgattaatgatagctgggagctgtgaaacctggtgagctaattcttccctcttagaccaatactgcttgttatattatgtgtaatcatgagagccccagtatctgtgcagtttctgattcaccaggaagaggccccaagtgattaataaagcctgaacccaggggcatgtcagaacgcaccactggtttaaaggatgactgacatggtaaagtgtccaacgtcaacctgccctcggaattctttcactttcagtatcagtaggagaaatatacaattgtacatttcatagaaaagtaaacccagccccacacagttaacaaccaggtgaagcgggaacacaggacaattcaaagttttcggatcacaccatttcttggtcaaatattagtaccttcagcaaaagacctctaattaccacacacttttggttatggcaacagcctgctccttacttttgggagagaggagtactccacacccatggcctgaaaccaggatctccaaacccatcaaagagaaacatggatgggaaaccaaaccccccaagcttggaaagcatccagcaagctttaattcagggagagttcaatcgagatataattgcctctaattggccctcccacacgatctcacaacatacagctataatcagttccacaaagaatatgttatatttcttttctcccttgaaaagccagaatcctctcttgttaggtacttaccatcactgttttgatttttgtaaatataccgagacattaaaaaaggaagaatgaatgggtaaaagcaaagaagtagatggatttcttttttaaaataagcactgatccctatgaccttaatgataacccagtgcgattcaaatctgtaatggagactgatgtcgactcaggaaacctttctagtccagggcacatgtgatccaaaaaacacattcatctggtcggacattttccatactctgatttttatctttcttggcatgctcaactctcctttaataaagtcacaaccctttgtngccatggaacccaatcagacacggagcctgttactatgacttccctgcagatataaaaaaagacccagtgaccaaaagaccagctctttctt

SEQ ID NO: 237602 - DNA, 238 bp, Homo sapiens
cagtgctgcccattatgaaggcgggaagacaaggcaaggtcttactctgcttggtgtggtcatgaggaagcaggttggaaaaagcaaaaactgtttttttgactggtggcttcttggaagtgataatcatttcttaggatgccgggttttgtgagagggtggagggcatttgcaggccaaagcagccattacagcctttctacccatccccttcattaaacacagcgccaggtctctc

SEQ ID NO: 237603 - DNA, 629 bp, Homo sapiens
agtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcaagaagaccttctcatgcgcctgctggagtgtgatgttattatttataacatcactgagagctcacagcaaatggaggaagccatctgggcagtctctggtcagtgaggtgtactcttttatctccagggatgctattgtagtgctgcctacttcacctaatagtcatctaggaacactagacaaagtagggctatagaaaaactggtctgagacttacctaaagtatgaaatttatgataataatatggatagatacttctgaagaatagaatatttttaattat

SEQ ID NO: 237604 - DNA, 1633 bp, Homo sapiens
agtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgtaagtcccggaggctctggccaggagtagacagagggaagagtcaccttccgctccaacgccttgacaacttgttttactgtttgcctcccctcccctctcttccacagacatggccaggttgagggaatggctttctcctgtaatggagatttacctcacagaccccacttttaattttcggccaaagcaaagagtttaaattagatagtgttggaaaggatggatctaagttggactttcagactcatacagttctcctcttcagcatattctgccttgcattatccaagacgagtctgtgccatgatgggtgccatctgtgaaggagaaataggccaggcgcggtggcttacgcctgtaatcccagcactttgggaggctgaggagggaggatcgcttaaggccaggggttcgagaccagcctgggcaacatagcaagatcctgtctcttatatttatgaaaataattttttaagagaaacatcctttggtaatgcaccactcaggaataatataccactgctgtctccagaaacaatgctgtctccacgtgacaaattcaacacagtcctagtcctgagacatttaaatgtctgagaagaagtggccctcttcttctcctgggccaactcctcccttaccctgcctgctactctctggagcctaccatacagctttccacatgctgtaccctggagtggccttctctctttttttttttattcatccttcaagagttgtgtctcttcctccaggaagccgttcatgattcctacttctccctcactcccagtttggattctgagctcttttctgagctcccatatcatcctttgcctgcctagatcatagtgcttttcacactcgttgttatcacctgtctatcgtgggggtccatggacactgactgtcagctccttgagggtggagaccgtgacttgtttatccctgtgtttatccatgtatctgtggcacctaacacagccactgccacaaagtggcctcaataaacacttgtggaatggacgaatgcatcccctccagacatctttgggaccttcccattcacctccttcccctgtcttccgggtattctttcccattcacctcccttctctctcttcttgccactggcttcttcctctatacctacacatatgctcaaatcattcctgctgtaaaaaacacttaacttggcctccctgctggccaccagcctctttctctgccccggcccctgccaccactgaacttcaggagaccagccgcatttgcaggtctcaccccttcacccccg

SEQ ID NO: 237605 - DNA, 818 bp, Homo sapiens
agtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcaagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggccagaaaatttgcagcatacgtagttgctgctggactccagtatggagcggaaggaggcatgttacacacattttttaagatggcttggttgggcgagattcctgcattaccagtttttggcgatggaacaaatgtaattccaacaatccatgttcttgatctagcagg

SEQ ID NO: 237606 - DNA, 798 bp, Homo sapiens
agtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcaagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggctgttatctacgcacattgatgtcctcagcgcatttcctggcgtggagctgagattcagtctgagagccatcagccaccaaagcctgctgggttcgctttttttctttggaatccaaaaccccatcattcaatagaatttatcttgaca

SEQ ID NO: 237607 - DNA, 598 bp, Homo sapiens
gttgaaatgtaaatagaaggcgaggcaggatggaggaagaagtttattttagagtgcgtgtgatgagcactaggagaaagactcggtgaagagagaaagggtgaggacagtagagaaagatgataatattggagcacttattaactgtgtgatattgagcccattttcttacctaaaaaataggaataaccatgatacctaccccacaaagttgtagatggtacatagaaagtgattaacaaaggtatgctgttgttttaacttttatcttcactgtcggtggctagcagagtgctgaccacatgattgatgttaatataaaatattcaccaattctcccaggcgggtgatacctcagaagcggaaggacatctctgtatctatcacttgtcttacttcccatctctgaagcaccagtctctttttttttctaagcacttggaagcctttccatgactcagtgctgaaggatttgtatgtggtgctaagccagggtagattctgttaggggatttaatcatacaggcagggcactaagccagggatatacagaagactttggaactcattcctccaatcctttcataatgtctacaga

SEQ ID NO: 237608 - DNA, 297 bp, Homo sapiens
tgtagagacagagtctccttatgttgcccaggctgatctcaaactcctgggctcaaatcgattctcctgactcagcccctcaaagtgctgggataacaggcgtgagctactgtgcccagcctatatttttttctttctctttctctcgctctctttctttctttctctctgtctctctctttttttttttttttttgagacagactcttgctctgtcaaccaggctagagtgcagtggcatgatcttggctcactgcaacctctgcctcttaggttcaaggtttctcatgcctcagc

SEQ ID NO: 237609 - DNA, 406 bp, Homo sapiens
gtgagctgtgactccttgtgtgttagcctgtgtttctcatttttaaggtggcagttttccctatgacctcaattctctgatccaccctagaagggttgactttcagtttgttcagcctttttctagctgtgaggacaagtgatgactgcctagctctttccatgttgaaatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaacatttggaaagcagatttcattata

SEQ ID NO: 237610 - DNA, 1510 bp, Homo sapiens
  misc_feature (708)..(708): n is a, c, g, or t
  misc_feature (723)..(723): n is a, c, g, or t
ggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgatnaaggcatacctgagnctgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatgtgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttgggaggcagaggtgggaggatcacctgagcccaggaggtcgagggtgcactgagctgtgattgcaccactgcactctagtctaggcaactgggcgagtctctgtctc

SEQ ID NO: 237611 - DNA, 355 bp, Homo sapiens
aggtttgtctaagatcagatggttgtagatgtggtacccataccatgctgtttttgttactgtaggcttgtagtatagttcgaagtcaggtagcgtgatgcctccagctttgttctttttgcttaggattaataccgtttctttaaaaaaaaatttttaaagagcaagaatttgagagcacaaataggaccacgtgacaacagtcctttggactgttgtgtaatgatccttactaagggaaattctaaagccattcttatccacaagcatgtatggacccatttattactctgggttggcatagtgtgaatacagacacccctaaacacatattagcaattcttctgccagtgta

SEQ ID NO: 237612 - DNA, 331 bp, Homo sapiens
agggccaggacagcagggccaacaatgtgaggcggcagtgtgggaaggtgggaatagtagagatggagaatcaacttcggctaactcagaaggttattatgatgaaacctgcatgtaagtcattctgcaaccatcatagtaaactttggttcaagaaagaatcatcaatgaatgtaaaacttaaggaagaaattttgatgaggaccaggatatttgtgtggacttagagtatctccccatgttgtagccagcctccaagatagcccctaatgattcccacctttcagcattctcacccttggatagttccctctgtcattgtctgtgtgac

SEQ ID NO: 237613 - DNA, 799 bp, Homo sapiens
atctccaactcattcaataaagctagtattaccctgacaccaaatccagacataactagtgcagaaaatatatacgccaccccacttgtgcaaatgatacaaaaaaattccaactaaaacatgagcaaatacaagaatgcgatgtactagaagatcacatttttcctaggaatgaaaagatggttcgaggttagggaacctatcagtgtaatttcctgcaataacagttaaaagagaccgacgatatgaccgtctcagtaaacatagcagatagtgtgttgctgctccatcctctacctgaccttctgaggtcttcttgcagggattagaagtctggaagctccatttcccaggctctctggcaatggttccagtttagtttctaccactgagaggtactcattagtttggcaaaaggtgaagaaggctggactggagatgtgattgctgttgcacaggtcacagactgcctgagcctggttccacaccattcacagaagactatcatgggaatcctcttggagctgtgcaacgtgcacgccctgccttggggcagggaggggttctgcaatataatttttgcagaaaagaatgggcatcatcttttcaaagtattcggtactaagggttccccctgaaagatgtaagtttccttctgttggctgaaataatataagaaatggaaaaagtacactttcaagaatttcaatttagatactgtttgtatttgtgtgtgtatgcaaaacagttcttgtatttttatgtacaagatttggcacaataaatgctgattttcttg

SEQ ID NO: 237614 - DNA, 1735 bp, Homo sapiens
tttatatacggtatggctggaaaagttttggattttaaaacagggtccctctccttgaatctgggtggacttgtcaatgccctgaccaatagagatgacgaaagtacgtgtcaccggactgacttctagggccagtcacagaaagccatgcagttcctgtcttgttggaaggaacactgctcttcaagccctgagctccgcttcgtaagtccaactcccctaaggccatcatggcaggagaggccatatctgggcgcttcagtggatgttcttatctggacccagccttccagctatccccactgacatgcaaaccaagcctctagaccagcccgtccaccggccgaatgctgcctgtgaccgacctctgccattgccacatggaacagaagcacctcccagctgctccttgcccaaattcttgacccacaaaatgtgagacaccattaaaacttgtttcagatgacccctaaaaaataaaatcaacctcttcatctggtgctcttataaaaacttactacggaagcttcttgagagacagttcgttggtcttcctgaataatttttttttttcttttttgagacaatgtcttgctctgacacccaggctggagtgcagtggtgcgatcttggctcactgcaacctctgcctcccgggttcaattgattctccttcagcctcccaagtagctggaattacaggcgcctgccaccaagcctggctaatttttgtattttttagtagagatggggtctcaccatgttggccaggctggtctcaaacttccgaactcaaatgatccacctgtcttggcctcccaaagtgctgggattacaggtgtgagccaccgcgcccagcccctgaatttttttaagggtcatgatgcctgggaataagttttgccccactctgcagactttaatgcctctttggcatagtctatcaaactattaacaaatattttaattttaataaatattgcttatgacaactattttttaaaaagtggagttgttctgtttaatctggagagtagggtcagagtcctgccttcatccggcgccctctcctaaattattgctctcatactctaaggcaactctgtggatcctccctgaagttcacagcttgaaagagctttgcagttattctttcaagatgagatcggcttgtcctaaatccagccctggggttggaagcaccttttagggaagcaccctaaaaagtgtgtctcctggaggtgaacagtgttaaagtataggttgaaaaattgcacccatgggtgcacagatggatgtctgtgtgcctacaagcaggtagaacaaactatccattaggctgagctggtgagagtggaaaaataaataattattcaaacttacctctttcttagagaaaacgaatagctttcacataagtgtggagttcctgttccttttaaggaactctaggctgggcatggtggctcatgcctgtaatccctgcactttgggagtccgaggtgggtggatcacctaaggtcaggagtttgagaccagcctggccaacatgatgaaaccccgtctctactaaaaatacaaaaaattatctgggcgtggtgacacgcacctgtaatcccagctactcaggaggctgaggcaggagaatcgcctgaacctgggaggcggaggttgtagtgagcggagattgagccactgcactccagcctgggcaacaagagtaaaactccatctc

SEQ ID NO: 237615 - DNA, 443 bp, Homo sapiens
aatttcagctactagtagctactagaagtataactaactagtgtcttctactagctactagtagtactaccagcactactagtactactagcactaccagcactactagtactactagcaagtactagctagtacttctagctactactagaagctagtagaaagtactaatggatacaatattaatttggggtccctatcatagaaatagaagattgtcatggtaaaggcacccctcctccccaagtagaaagaacgatgatctaacttagcagtgacataaagataccaaacacagaataactggaaagcatgaatttgaaaaccaatatatttgtgtttacaccaatgtatttgtaaggcaattccatctatacccattttacagattggacagctgagacttagaatgcctaggaaaatgtctcttagatctaagaaaa

SEQ ID NO: 237616 - DNA, 474 bp, Homo sapiens
cggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttatagggggga

SEQ ID NO: 237617 - DNA, 381 bp, Homo sapiens
aacctgctatgttggcccaaaggatcatctctcagagctctgctgtcagatctgggaagcaggtattggggcagactgcctagacaggaccctgacatttggtatacatctactctgggaacaccgagtaatgtggttggtgcctttgtgcatagcaaagacattagaagactatgcagcatggcatcattccaaggagcagatcaggtatcacaactgaaagattccacaggcccagaggaacatgcatgcttgtccactgactgcaaaaatggaactacttgaaaatgtgccagcatgtgtgtcctgggccagctgagggtaaaggctggtggcacagtctggttatggaaacaatacgtgccattattctaattgtat

SEQ ID NO: 237618 - DNA, 385 bp, Homo sapiens
tcttttaatctctatcactctgtagtgctaaatgtaatcctatctttgtgttcaatttttgtggctcttaaaatgagctttaatctaaacaaatctatgtctactttaaaagactaaaaaaaaatatatatatatgtatatacttttgccaaagcaaaaacaaagcaatggttctgtggttctcaattaagacgattctgagtaaaaaacaaaacaaaacaaaaaaccacaagattgatctagctgtaaatatgatttacaaatattggccaggtgcagtggctcacgcctgtaatcccagcactttgggaggccagggctggtggatcacaaggtcaggagttcaagaccaacctggccaagatggtgaaaccccgtctctact

SEQ ID NO: 237619 - DNA, 494 bp, Homo sapiens
acaactcaccctgcctcctgcttgtgcgaaatgtgcaaacgtgaacttgcccagtattgaagagctcaggaccttgagttccgagagccagggaggaatactttgttgttctttagacccaacaagccagatctgttaacgccaaaccttcattcccaagacaaccctcccttttgatggccctaaggtgctgccccctaatttcatgacttctgccactgcaaaagcttcccaaattcgtactgaggccacgcctttcagagtggatgcacgaaggagggcggttcatcggaagtgaatctgagattaaacccatgtatcttagctccccagtgctccccttcatcatttctagaacatacgtaatagcatgtcctggtcttcttggtggtctccttagggatataggggaagggcagttttcatatcaactttctttatgttaccatgaattagctgcttgctgaataaacttctcagacaaaaatcccaca

SEQ ID NO: 237620 - DNA, 420 bp, Homo sapiens
gactggaaaaacatggagaaatgggtagaaaagtgagtataaaaagtaaaatcagctaactcccccattcgttctgtgttgtttccattttttattttttgtatgagttttgacatcttaaaaacctttctggctggggagactgtccctcctggggctgaccaattctcagagttagcaagggccaagtcaggagcagccctttgatatggaaacaagccagtccagagccagacttcctctatcaggcctgtccaccccaggatgcattattcctctgccttaatcatcccatggccaggtaccaggcaactatagaacatttgtatagcttagagcctgctgacaccatgcaaactagccagtcctaaagtgctctgtctgccctgctttgcctttctgcagaaaccccaataaaca

SEQ ID NO: 237621 - DNA, 471 bp, Homo sapiens
ccgggctctggctggtggaaaagcattggcttcccctgctttctctgaatgaagcatgccgggcctcatctcggacctgcacactgcccctcattatgttcatgatcggcaggaaatggataaagagtggccagaaggtgaaaaagaagagatggccccctgaaagggacatccacatttatttgagcacctaccaggatacctgctttgggagccttctgctgctgcgtgagatccctggctaccctggagagacatcagacaacaagtgagatgcccaagagccctagctgtctttgtctttgcagcccaagctccagacatgtactgaagaagctttaaggataaattcagtcccaactactccctggctacaactatgagacagaccctcccaagtcagaactgcctagccaagctcaggcaactccaagatttaagagcaaaataaaagatagttattgctttaag

SEQ ID NO: 237622 - DNA, 2210 bp, Homo sapiens
taatctgctttgtagctcctcacatcttcgaaacctgccaaactctttcaaaagtattgcagttatttagctgcatccacttgtattttatgggttatgaacatgccttgtcatcagttcttttgaacatgatgtctatgggtttttctttagcctatttgctccattttttatgaaactatctggggacacttcagaaagcatgtcataattatttttcccaagccccaagtccattgttttatgaaattttgttattagtgcattgtcatcttgccttgcatgctgcaaatatcttctcccactaacctgccatctttccaccatctttggggaatcttaatggacagaatatttaatgtggttaaatttgtcaaaaatttccaccatgtttaatttgtgtgtgtgtgtgtgtgtgtgtttgtgaacacaacatacctgtatggtaggggtaacattggtttagattcactttgtacttcatacctgtgttcaaaagactcagctgagccctttgtgaggatattttgactttgaaaatctggaattgatgactcacttaaaatagttttatcttgggactgaaacagggacataggcatatttttgtatgattcacatcagagctgataatcttaatggtttgtaaagggcctaaatgattctacagttttatataaagcatgttaaactatcaaggctcattattacataactataaatggacagagttttataataagaaaaatgtacatttgtttagccattgtctcctaggaacttctctctattattacactattgcatttgcaaaggcaccaaaggtgcagtttggtttatatactgcagtagtaattcctaaaagatttaattgtatcaggttttttaacttaaaaatggaatcctatttaaagtatatccaaatattcgtacaataagaagttatcacagtctacctattttgtaaatgaggtgcagtgtttagttttcattggggtttttgattttctgttttgagcatttaaaacaaaatcctttgaaaatagtagttggtgatcacaatggtttatgacaattttaacaaattgtattagaagactctaaggagctgtattttcaaccgtgctttttctcttccttccttcctttctcttccctcactttttttcttcctcttccttccttccttccttcctttttgcattggggtaagaacataaataatattacatctttccactatgtctaaaaaagttggaggtggagaacagtatattttccatgaaaatgtcagcctgccacatagctctgcttagtaggcaaaccgttattcatttggattctctcttggctttacatttggaaacagttttagtgttaggtacttatgattgaaaaggagatctcatgttgagcttttattgcgttggatgcgcttaaaggaggttttgtaaaagaccattgcttcattaagaaaggaagaaagaaaaacaaacaattacatccagggaaatgctaggatttttgatagtttaacatgaccatgtcttgagcattttcagttcataatgaggcttgccctaactaaaatggcatttcatttcggttgatgtactcttgacattattggtgacatctgctaaattctaaaccatatttttttttaaattgatttcattcctacatcatcagctatgaccaccagttgagctggagagattggaatctggtgttttatttattaaaaaagacattttcagactgcttagctcacaaagatattttgtattctttttcaaaatatattttatttatcatggatgcttgtgttttaaggctgcatatttatttaaaatttatgaagaaccctggaaaacattcccaacacaatacaaagtccacacatttgcacaataattaagaatatttggccgagcacgatggctcatgcttgtaattccagcactttaggaagccgaggtgggcggatcacttgaggtctggagttagagaccagactggccaacatggtgaaacccgtctctactaaaaatacaaaaattagccgggcatggtggtgggtgcctgtaatcccagctactcggaaggctgaggcaggacaactgcctgaacttgagaggtagaggttgcagtgagccgagatcacaccattgcactccagcctgggtgacgcagcaagactccatctc

SEQ ID NO: 237623 - DNA, 502 bp, Homo sapiens
ctttttgaggtatgaattattgaaatattttgtatgctgacaggaataacccagtagagaaggaaatattgtttaagcaggaaacaaaggaggtcagtggcaggagtgtgtcctggagaaagggatccagtgggcagagagatggatggtttaattaagagtaagggtagggaagtcagactatgtcggtacagatggaaggctgtggacattctaatcgaatagcttctcttttctctgtgagataagaactaaggtcacccccttgataaaatagcacatgataaaagcaagttttgttcagtgctctcttcccagtacttagaacagtaattggaatatttaatggaacatagtaaatgcttaataaatatttgttaaataaattaatggaagcaagagtaatcttggattggaaaggagaaggtgctgtagaagtctgttgggttaagctagagtagtattagtgggtatgataaagaggaacagttggaataatatg

SEQ ID NO: 237624 - DNA, 161 bp, Homo sapiens
aagggacaaggactgaaaaactgcctattgggtactatgcccactacctagttgatgggatccttcataccccaaacctcagcattacacaatataaccatggaacagacacccctgaatgcacatgcaccccctgaatctaagacaagttcaagttatta

SEQ ID NO: 237625 - DNA, 453 bp, Homo sapiens
ggaaaaggaatcctttcatgaagatctgtattttgttattttttgctgactgttagaacttgtttagaacaacttgttctgtgtaaaagtgagctgcctgctatttttgctctacttttggtaatctcactagtgtccattttccttcaaaattgcagttttggttaagtttcttgtcagttagcttttctgacttaggaattttgttaatgcagatggatttctatccctcggggccctttccttacctggcagggactctgtctcacctcttctcaggaaacatttcttatcagtaaatgtctgtaatcttatacacacgagtggtccctttaggatgtacaaaagcagtactcattcagtagaaaccatacttcttcaagtacccatacaaccattctgtttttcactttctgtattcaataaattacatgagatactaaaaaaaaaaaa

SEQ ID NO: 237626 - DNA, 464 bp, Homo sapiens
gatctgccacgtatggttgcacaggtcattcactgcgcaagagtatccaaccgatggagcaagcgggtgctaaaatacagccggcacactgcttgctagcctgtgtgtcacggtacaagccagtgtccaaccagaagatgacttctttcaagtgttcccaagggttactatgagctagcagtggcccttcaaaggccatgctgccagggcataaatcctccctctccctgctccccttccctgaagtataatagggataagagcttgctcatttccaggctgtggtgtggtggacagaagggcacgaagaacttcaactaacagaagtcagagccacgggttttcacttttaggaaatgtgaatatcagtgctcttgtgtgtgtgtgtgtgtgtgtcaaggactaaactgtagaataacagggagatgtgttaatagtatggtttataaataataataagtaat

SEQ ID NO: 237627 - DNA, 409 bp, Homo sapiens
tgaacaatatattttttaaaaagattctgtcttctacttttttcattacttttcattacttttatttttgtttttgcagtctcttagcagatgacgtgatatatgtcacattgtggttcaattttataaaaaaaagcaacagttttctctctgttctaccattgtggagagtttttctggagttgaaaataattttgtttttagttgctttttaaacactgtccagaattaccaaacatgatataaacatatgttacccacaaggtttcactgtaaaggggcctttcttttttggggcgtccagtcacatctcacaattgtacagcaaaatattgcacaatttttagatagaaaggtctctctatttggaatctacagttctttgagaggaattagaccatatttctac

SEQ ID NO: 237628 - DNA, 654 bp, Homo sapiens
cgcccaggctggagtgcagtggcacaatcttggctcactgcaacctccgcctcccaggctcaagcaattctcctgcctcagcctcccaagcagctgggattacaggcgtccaccaccacatctggctaatttttgtatttttagtagagatggggtttcaccatgttggccaggctggtctcaaactcctgacctcaagtgatctgtccactttggcctcccaaagtgctgggattacaggtgtgagccaccatgtgtggccctgaacatgtattttctaaatgatgtttgcctcgaaaggaagcaattgtttggcaaccttgttaatgtgacctattactactagacttctaaaaagtgaaatttgtcaaaaggacattttttagtgcaactgaaggcaatatcaagcagtttaaatagttgttgatgcttatgctatgtactgtaattatttacatatatttactatcacagaatttataaatgatacaaagttttttgaagacaagatttttgattccttaccaatttaaaaaataacaaatacaattttaaaggtggcaggaaggtctccaaacagaaaagaaaacaagaactaattgtaggttccttagagagattttaagattattcttgctgaaatttttacttaaa

SEQ ID NO: 237629 - DNA, 417 bp, Homo sapiens
tgaatatccactgcagtctttggaatttgatactgttttaatcatttttctaggggaggtaactgaggctttaggatgttggggtagcttttctccaacacattagaaagcaagtaggagaacctcacaatctgtgcaccagaagaactggcatcacccgaaagcttgttagaaacaaagaacctcagtcccacccagatttagggatcagaatctgcattttaaaggatcccagatgattcaagtacacatgaagtttgagaaatactgctttattttacagagaccgtgttcataatctctacacagtcctgccttctagggaagcctgagatgataactttattaagagaattattaagagacgtgacattaaagcagattcaagataattcttttttctgattataagttcta

SEQ ID NO: 237630 - DNA, 193 bp, Homo sapiens
cccggcctctacacaaaattcaaaaaaacttaaccagacatggtggtgcccacctgtagtcccggctactggagaggctgacgtgggagaatcacctgagcccaggaagttgatgttgtagtgagccatgattacaccactgcactccagcctgggtgacagtgaatgtgaccctgtctcaaaaaaaaaaaca

SEQ ID NO: 237631 - DNA, 350 bp, Homo sapiens
caaggcaggtggattgcttgaggccaggagtttgggaccagtgtggccaatgtggtgaaacctcatctctactaaaaatacaaaattagctaggcaaggtagtgcacatctgtaatctcagctacttgggaggctgaggcacgagaatcgcttgaacccaggaagtagaggtttcagtgagcccagattgcgacactgcaccccagcctgggcgagagtgagactgtcttaaaaaataacaataataaaagaaaaagaaaagaaaaccatgcaatgaccaatggtgagagtgtatcatgaagcaaggaatgtgattaatccagttctgtaaacccaagttccagtggaaa

SEQ ID NO: 237632 - DNA, 323 bp, Homo sapiens
aaagattatgttttgaacagttttatgtaaatttgaaaatttagatgaagtggataatttctagacaaacagaactttaaaatgtcaatacagtaagaaataggaaactcgaattcacctatgtgattaaagaaattgagtcattgaaaaccttcccacaaagaaagcttcaggccaagaaagctttaccagtgtattctaccaaatatttagggaagccataaaccaataccacacagattctttctgagaatagaagcagtactccccaacttattttataaggctagcataaacatgacataaaacctgaaggacattac

SEQ ID NO: 237633 - DNA, 757 bp, Homo sapiens
ctcgctcagcaggtcccacttccatgggcccagcaagctaagaaccactagcttgaaatccccgctgccagcacagcagtctggagttggcctgggaccactgagttcccggtgggaggagtgaccatcattactgtggctttagttttcccctgacagtgctaaggagactgggagatttggactgagcagaattcaccacagtgcagcaaaggagctgtggcagatcatggctagatggcttctttagatccctcctcactggagagggcctccctgtaggaaatctagcagctatagtcaaagacttacagaaagagctctcacctccctgagacccagcatctgcggggaggggaagccgtcatctcaggttcagcagacttaatctttcctgcctgccggctctgaaaaaatcagctgatccaaatgaggaggattccccccagcacagcacaccagctcccctaaggggcagactgtcttctcaagcggatccctgaccctgtgcctcctgactgggtgagacctcccaacaggggtcaccagaaaccacagacaggaaaatcccagcggacatcaggtcagtgtccctctaggatgaagcttccagaggaaggagcaggcagcaacctttgctgttctgcagcttgtactggtgatatccaggagaaaagggtctggagtggacccccagcaaaccacagcagacctgcagaagaaaggcctgttagaagaaaaacaaacagaaagcaac

SEQ ID NO: 237634 - DNA, 470 bp, Homo sapiens
aggtgacaaccctgtctggctctgctaatcaggatccagtaagaagctcaagacaggtggccactctgctggtaggcagaggagggagctgtgctccctggggtgggtagaagtaaggtttgtgtgggtgctgggtgttggacacgggcaggctgcagacatagcagcaatgaggggagactctctcaacctgcccatgtcctcctctgagcaatctccccgccccagaattatttcagtttcctcatctgtcagttctaggggtggacttcattcattcaatactgtgtccctgacctctgctccctgccaggctctgaactagtcatgtgtcaggctggatacttagatggacaagacaagccatcccctgcccacagctgccccacctgaagtctaggccagtgacctccgaagtttttttgatcatgtgcccttagcaataaaaaagattgttgagtacgcacccg

SEQ ID NO: 237635 - DNA, 509 bp, Homo sapiens
agttgcatgagttccttatgcattttggatattaagcccctatcagatatatggtttgctgtgcaggaattttttagtttgatgtagtgctacttatttgtgtttgactttgttgcctgtgcttttggtgtcatacccccaaaaattattggcaagcccagtgtcaaaaacttttcttctctcttttcttccaggatttttatagtatcaggacttgtatttaagtcttcaatccactttgagttgatttttgtatatggtgtgaaataagagtccattttcatcctatggcaagtaaatatccagttttcacaacaccgtttactgaagagaccatcctttccccaatgtgtgttcttggcacctttgttgaaaatgaatggactaaattcataacttggcctctgggctctctattctgtcccactggtctctgtgtctgtttttatggcagtaccatactgttttgactactatagctttgtaataaaattacagatgccttacca

SEQ ID NO: 237636 - DNA, 436 bp, Homo sapiens
gccgccttctggcgcagcaaggcttccgtaccccccagcgcggttagtgctggaaagaagagtgtacagtggggtgcccaaacctagtggcatccccttctttcctgcctccaaatcagtggcgtgattctctccagttttgggagaggccagacacactggaggccaaagaacttgcagaggggcgggagcaagcactcgtctgtgtctgtagctgaccgaggcactaacctccctgacaagtctctcgggattcaaagctggaaggtataaggctcagagaagttgggaactgcgggtttatcaatctcttaatgagctcagtctggcctgaggccctacccaatattgcactggtggatttcacaatgtttggagttctccagatcttcacacaaatggagcataaacatctctgaaattttcagcctttttt

SEQ ID NO: 237637 - DNA, 422 bp, Homo sapiens
ctcggtttacggatgatataactgaggcacagagagaggttacagaacttgaacaaagttatacaaccagtaagtggtggagataagagtagagcatagatcactgggctccacagtccacacccttgaccgcaataccataatctctcaataattaccctcctatagtttccagattccctgtgcactgttcctttaaagaaaaagaaagagaagttgtcataccattatatctcttcctacatgcacatttgagcagagttctcttttctaaacttgaaggacagttggatgattttgtttttcttttgaaaaatgttgtgtttatgtgggtgatgacagttgtaaaaagttcacttatggatgctcatcattgttcacgcccaggaataaatttaatacatcacttgtgcattctaaaa

SEQ ID NO: 237638 - DNA, 456 bp, Homo sapiens
atagcctttacagataatagtggacattcttctttcttactgcacccagacttgacaagaagtagttacttaaagtgccatctcaatggcctttttgtactttgttacatgaaaatccaccagtctcatcatatactttgaatggagcttttatccatgcattatgctttggtcattttgaaaatattgtttcacggagtcgtgaagatcttctcaacgttgacatatttcattctactattcaaaaagatcacatttgttaataacatgaatcattaagaattagaaacctgtgaagctcatgtagttgatacaagttttcccaaattccaagtttcccatgaaagcttgaattttatcactgggaacaaacactgtaagttgtttctgttttagaagctcacttcattcatttgagaaaaaataaaatctgccaaatatacaagtatgaataac

SEQ ID NO: 237639 - DNA, 508 bp, Homo sapiens
agtaacagctcttggtggtttctaagtagtctacccatttaaaaactaaaaagtaattgtccagaaaacacagaccaaacacagctaacaaagatctcaagtagcttcaccaggtagctgagcccgaatggacagaaagtgaaaagttcaactcggaaatacccccatgggatcgtgctgaagatccaatgggcgctatgagttcccaagaatcttaagaggcatagagttggcctctttatttgaagctcaactttccatctgagtgaagaggcaaggtataacatgcatcccagatgctcactccaacagctccgaggcacggaggcaggcactcctgccagctcccacgtttagcatccactgcactccgctgcagtcatgtggggacttaggcaccgtccctgcctgctcacacactggggcgagttcctcacttgtgtgtgtctggaacagccacggccaataaatagttgttaaatgaagaaataaatgaaccatcctgaac

SEQ ID NO: 237640 - DNA, 774 bp, Homo sapiens
  misc_feature (5)..(5): n is a, c, g, or t
  misc_feature (17)..(17): n is a, c, g, or t
  misc_feature (19)..(19): n is a, c, g, or t
  misc_feature (23)..(23): n is a, c, g, or t
  misc_feature (42)..(42): n is a, c, g, or t
cgacnatatcttagctncncggngggttcggcatagacctgnggacccccgggcggtagaatcggcacttagccttgactccagaggcggaggttgcaatgagctgagattgcaccactgcactccagcctgagtgacagaatgagatttcgtctcaaaaaataaaaaaaattaaaattaaaattatatgtttttggccagtgatcattctcctatttaaaagtttttgttttatgaaattttgatttgaggtttcagttaaaactgtgaacaaatatttgtctgtgaacattataattattttaaggatctagtaatatagcatcaaaaagcttttcagaaatacacacatacatacatacataatacatacatggttgcagtgctttggtcttgcccttattttaactaccatccataataatttataatagtgaaatattcgcagcaccataaatacgtactagtgccttgtaagacatagagggaaaatcttgaggagaaaggtagggagttgggaggtgtagggaagggctttctatcaatggtgaggacccttagaatcatagaatcaaacacaccatttggcattgagtgtctctggaaggctaaaaggaaaaaaaaatcttggatgcctcagagagaactgggtgactgataaatccaggtagaatggttagttaactttttactgcctctcctgttgtagcttttgaattatggaccacatgtttgtacttcccacaattgtttaatttaggggaaagtgtcatt

SEQ ID NO: 237641 - DNA, 828 bp, Homo sapiens
  misc_feature (5)..(5): n is a, c, g, or t
  misc_feature (17)..(17): n is a, c, g, or t
  misc_feature (19)..(19): n is a, c, g, or t
  misc_feature (23)..(23): n is a, c, g, or t
  misc_feature (42)..(42): n is a, c, g, or t
cgacnatatcttagctncncggngggttcggcatagacctgnggacccccgggcggtagaatcggcacttagccttgactccagaggcggaggttgcaatgagctgagattgcaccactgcactccagcctgagtgacagaatgagatttcgtctcaaaaaataaaaaaaattaaaattaaaattatatgtttttggccagtgatcattctcctatttaaaagtttttgttttatgaaattttgatttgaggtttcagttaaaactgtgaacaaatatttgtctgtgaacattataattattttaaggatctagtaatatagcatcaaaactcactttaaagttccactggttattaaagtaattataacatcacatacaatacagcttttcagaaatacacacatacatacatacataatacatacatggttgcagtgctttggtcttgcccttattttaactaccatccataataatttataatagtgaaatattcgcagcaccataaatacgtactagtgccttgtaagacatagagggaaaatcttgaggagaaaggtagggagttgggaggtgtagggaagggctttctatcaatggtgaggacccttagaatcatagaatcaaacacaccatttggcattgagtgtctctggaaggctaaaaggaaaaaaaaatcttggatgcctcagagagaactgggtgactgataaatccaggtagaatggttagttaactttttactgcctctcctgttgtagcttttgaattatggaccacatgtttgtacttcccacaattgtttaatttaggggaaagtgtcatt

SEQ ID NO: 237642 - DNA, 382 bp, Homo sapiens
aaaatctgaataaattccagagcatataattttttctaactaaataataaactgtaccacaagatttcccccaaacaactcatacttaatagcatgtatcagtgatgaacaaatttttgcctaaagcaataaactgaaatgaacagatcatcaaaatatcttctgatccaaagtctaaaatgaagtgacatttctctggctgggcatgcccaaagccagccctggatccagcctctattcccaggagtcacctgcaggcgaggacagactctggcctgaaagatgtgcatggggttggcagcagcactgggtgggacccttgaggacaaacgtatccatttctccctacatgccctaggacatgccataccaaaaaaaaaaa

SEQ ID NO: 237643 - DNA, 727 bp, Homo sapiens
gttccaggtaatcattcagcattaataactgagtaagaaaaacaggaataccataaatttaaaaataatacttgctggtggataaaaacattgactaatatataagaatctgatatatgatacgggcaatctctcagaacagagggctgatgggcatttccataaatcaccacctagtcaacaaattatttgaatgcctactatgtctcaggttctacatgaggttcctttttcaacagtctttgtaatagtatgatagggattaagaccagataatctgtacctcgaatttgagcaagttcctaaatcctactaatttaagctacttgcaaagaagtatgaataatacaaaaccaaaagaaagaaatagcaaatatcctttggtgttacaatgtgaaaaaaaaaaaacaaaatgaaacaggacagtattaactccttccttctgaagctgtactctcccaagtctgacgtctgtgtgctgccatcttccattaacatttaaaacttctttcaccttaaaaattttgttactaaagactaattttacaaatgtgagactgtataaatcaaagagaacatgtaattaatttagtgtggtctgatttctaaatgtatgaaacctagaagagaagcagcttaatatggtagcattctgtatccatgttggatgttcaccatctctgcatgccagacatcagattattactgtggtgactcttgactttac

SEQ ID NO: 237644 - DNA, 673 bp, Homo sapiens
gttccaggtaatcattcagcattaataactgagtaagaaaaacaggaataccataaatttaaaaataatacttgctggtggataaaaacattgactaatatataagaatctgatatatgatacgggcaatctctcagaacagagggctgatgggcatttccataaatcaccacctatttcaacagtctttgtaatagtatgatagggattaagaccagataatctgtacctcgaatttgagcaagttcctaaatcctactaatttaagctacttgcaaagaagtatgaataatacaaaaccaaaagaaagaaatagcaaatatcctttggtgttacaatgtgaaaaaaaaaaaacaaaatgaaacaggacagtattaactccttccttctgaagctgtactctcccaagtctgacgtctgtgtgctgccatcttccattaacatttaaaacttctttcaccttaaaaattttgttactaaagactaattttacaaatgtgagactgtataaatcaaagagaacatgtaattaatttagtgtggtctgatttctaaatgtatgaaacctagaagagaagcagcttaatatggtagcattctgtatccatgttggatgttcaccatctctgcatgccagacatcagattattactgtggtgactcttgactttac

SEQ ID NO: 237645 - DNA, 487 bp, Homo sapiens
cagagttaataagaaaaacaattgttgctcaggccctactcataccaattgcgtcagaatctcatgggtcagccttggaaacactctctagatgttttttaatatgcagccagaattgagaaccactgatctaagtagaaggtgataatgtgttctcttcttgttctcagttactttctaagggattctaaagccagtgacccttgaaaccagaactctcaggattttccccaactctgtgaaggtttgagacacaacagattttgagagaaatactcattctgctctcacctagagctttgcttcagtctaagttgtgtctgggtccacatcaagcacatgggtaagggtacaaagtatttggggaaggcaattctcttcccactatgctttataaggccccagacactcataattttgacttcgatttcattgcttgggcagagtatctagtcctttctcacagattacagaatttcaggtctta

SEQ ID NO: 237646 - DNA, 462 bp, Homo sapiens
tgcatgggagcaaattttaagagaagtaccatgcatggataacaatgttcaagccacagtaaccgcacactggtaaactgtggttaaacttggtgcaaaagtaattgtggtttttgtcattattttcaaatgggtcttaaaaaggagtgttgggggccaggtgcggtagctcatgcctgtaatcccagctctttgggatgctgaggtgggcagatcacttgaggtcaggagttcgagaccagcctggccaacatggtaaaaccccatctctactaaaaaatacaaaagttagctgggtgtagtggtgggtgcctataatcccagctactccggaggctgaggcaggagaattgtttgaacccaggaggtggaggttgcagtgtgctggaggttgcggtgtgctgagatggcaccactgcactccagccggggtgacagagtgagactctgtctcaaaaaaaa

SEQ ID NO: 237647 - DNA, 333 bp, Homo sapiens
tatatttttatttctcttatcttctgatttaaaagacaaccaactgcataaagcaataattataaaactgtgtcaatgggcttataacacaaaaaggtgccatattcatgatagaataatggaaggaagaaatgaagcatagtttttgtatgctatgaaattaagttaatatgaactagattatcttaagtcaagttattaattgagggccaggagtggtggctcatgcctgaatcccagcactttgggaggccgaggtgagaggatggcttgagcccaggagtttgagactagcctggacagcatgtgagaccccacttctttctaaaaaaa

SEQ ID NO: 237648 - DNA, 364 bp, Homo sapiens
aactccatctcaaaaaggaaaaaaaaaaaagaggttaaataagctgtgagaatggagcagaagaggtggaagagaagtaatagagggaagaaggggataaacagcaggagaggagaggggtacaaaatgaggagcacaatcccagggaaaaagaaaagaaaacaagagctagagagagaaggggagaatgagagatatgcacagaattagggagggaagcacagtaatgaagaaagaggggctgggcgcagtggctcatgcctgtaatctcagcactttaggagactgaggcaaagggattgcttgagtctaggagttcaagaccagcctgggcaaaatagtgaggctccccccatctctgtca

SEQ ID NO: 237649 - DNA, 270 bp, Homo sapiens
ctatattcccatgagtgggacgaggttcccttcatgggtttgcaacagcctactcaccatctgtgaggataataggaataacaacaactgcctctatttttataaacaagaacttggtagtaaatattatctccattctggaatatgcttgtgttatatatttcccagtagtgctttgtaattgaaacattcataacaagaatatatcttcattttttatcatattttgacccacaataaattttcatttctgaaaaattcatagtgtta

SEQ ID NO: 237650 - DNA, 415 bp, Homo sapiens
gggttgatgttggaatgagtttagactttgggggactgttgggaaggcatgattgagttttgaaatgtgagaaggacatgaggtttgggagggtccaggggcagaatgagatgattttctctgtgtccttaccccaatcatctcaaactgtaatccccacatgtcgagggaggggccgggctggagatgattgcatcatgggggcggtttcccccatgcgcttctggtgtaagtgagtgagttctcacaagatctggtgggttaaaagtgtttggcagccgggtgtggtgcagcatcatgcctgtaatcccagcactttgggaggccgaggtgggcggatcacctgaggtcaggagttcaagaccagcctggccaacatggtgaagccgcatctgtactaaaaatacaaaattag

SEQ ID NO: 237651 - DNA, 488 bp, Homo sapiens
agggaggaagcagaatacaggcagaaattaggcaataaacaagatcttaaaggtcatcttggggcaacctcctcatttttaaaatgaagaaagtgaggtctagagagattaagagatttgctcaaaatccctgatgttattggctaggccaggactagtgctcatgtcttctgattttcactacagtaatcttttggcaataccatgatgtcaagttagatcatgtcactctccagcttgaaacccttcagtgcctttccaactgcgtttagaataaaatcccaattctttatggtggcctgtaattcaaggccatgtgtgatctggctcttgccagcccccacccgccatcctcatctgttactactctgcttgcttagtgcagatttgaccaccgttcaaagtaagatacgtgttatatgttgcaacccaggacaaacgtgcacactcacataactgaagcaaaatttcattaaagaatacttctg

SEQ ID NO: 237652 - DNA, 1995 bp, Homo sapiens
  misc_feature (1406)..(1406): n is a, c, g, or t
  misc_feature (1451)..(1451): n is a, c, g, or t
aaaaagagtggtaacttgatgaattccagttattctaaggttctttgcctagtaaatgtttatttctctaataaatcagaacttattgcaactaactgctttgtgctttcatataccatccccaccccaagaattttgaaagcttttagcaaatactaatgtatttgcttccccttcataagttaaaaggataaatattgatactttcatattacattatgagggcagctgcagcctgtgtggagcggccactgagaagacgccaactgcagcggggtaggcacagctggggctgcgcgctccacagagccagttggagccaggaacaggcaggagcccagcccttttcagagttggaggggtgggggcctccccctcctgggtgcaactgtgcagccacccagcagtgacctgggtttccctgtgctttcaggggctgggaagtgtccctctccagccctggcccccacaggctcagaagtgcctgcccccactgtctggcctctccctgttcccggtgtccactctgattttagagcaaagttgaggctgagcctaggcactgtcgcgacccagctgcatgcacttacggcagggctgacaggccagccctctgccccctcagcaccccctctggactttgggtgcccgtgagcatgggagggaggctgagggggcactgaggcagctcgatgtgggcctgcaggctctgtggacgacatgatcaatggtggcaggaagcagacaggctcctgggcagaaaggggtaggttcccggtgaagcctcaccttcaagccaagaacggcctgaagcatgggggccaggctgtcaactgtgcatagagtccgtggcttacagtgagaacttatggtgctttttcccgacctactcttggctgcccatggaccaatccgcacacacttcctcccatctgaagcccatgaaaaccccagactcagccagactcacagagaccttggagatgagctgtgggaaagaactacccaattcggttgctgttgtcttgtcaggacaacctgcctgcagaaaggagccacccactgcagatccctcttcattgacagctggatacttctcaggacaacctgcctgcagaaaggagctacccacttcggctcttctgcctcttgatgaagctgttctgtctcctctccgccttggtcaccctcaaattatccatgtacctcattctacctggatgtggacaagaacttaggacctgccaaatggtgggactgaaagagctgcaacacaaacagggctgaaacacccccctcccccgcttaccacattatgggtgatgagaaggagagaagagctgcagcccttcagggatcccagacctaggggctccccaagccagggctgtgacaccctctttggngctctttggttcctggtgtctccaagcttcccagtgccactgtgntccccttatccagatgcaggtgcctatagctgaagccatgtgtggtacatttggtccagccacagccttgcatgaagctggcacttgtgctggtgcctggagctgtctgccttgccacagcagctagcatgcgtggctgtgcacagtggctggaccccatgctcattcgctcatacactctttgccactccgtgcctggctcccccttggcaggtgtgagatcgaggccagtagtgtgagccaagcgcagcctgccaggccaagtgggtggaacgagccctgtgggcgcgagcaatactcaggcagaaggcgctgcctgccacagaggtttctggctggcaaatcgacatcccaagggtcccgtgacaattatagcccctgcttctggatagagtaaagaaaagggaaacaaaaaaaatcgaataacccaacctccagacattgctggtgttaacttattgccaaattctttctgatgtatgtgtatatcatatgagtatttaacagttttatatcttagttctttgctaaatgcactttcagc

SEQ ID NO: 237653 - DNA, 689 bp, Homo sapiens
tgcatttgcgttctgcaattggaattccattttttaaaatgaccttagaacaacatggcatctaagtttcttcaaagatctttgtaaaaggaagaactcttctttagaaaagtgcttttaatttttgttcattgcagtgataatataatggtttagcttttttcagatccaaggtatcaataccatgacataaatgaagccttaaatgatgccttttttaaatgatgcatctcttttaaagcatatttttatttcggagggttctcctgttagaactgtttcttttcccttgactctctatgtaaaagcagatgttttaaatatttcctttaagaattttgataacattggtttaaaaataaaagctgaaatgtgtgtgtccttcctgtcaggtggtaaagtaagaagcatttttgtacaatgtctttttctctgagtctgttttcattcgtaagggatacttacttgttaggtggtacaaggcatcctaaacctgcgaaaccaaacagtttagtgtgatttttttcttacagataatttggatcaatagaaaagagtaagtttcagattttcttttaagaatatccagcaattgcttctggccctgtgttccatcacaaatgtgaatcagtgatacttgcttaagcaagttttgtcaattcctagttgaattcctttaagtgccaaga

SEQ ID NO: 237654 - DNA, 631 bp, Homo sapiens
ctgtgagtttatcattgattttctcagattctctgggtaaactatatcaactgtaaatagttttatttcttcttttccatttcctgtgaatcgatttttttcttttttaattgtgttggttataatctctaggaaaaaaatgttcaatagatggagagagagtaagcatccttacctttttgtaatctcagtggaaatacctctagtattttctgactaaacataacaccggctttaggaccgaggtatagaaaaatatgcattatcatttctcagccttatggctaagatcaagtgtagaaaatatgcctcaatttctattttcttgagtgtttttatcaggaataggaattgagcgccaagtgtggtggctcatgcctgtaatcccagcacttcgggaggctgaggcagcagaattgcttgagacaaggagtttaagaccaacctaggcaaaatagtgaggccccatttctaacaaatcaaaataaaaatattagccaggtagagtggtacatgcctgtagtcctacctgcttggaagactgaggcagaagaattgcttgagcccaggaggttgaggctgcaatgagctatgattgcaccactgcactccagcctgggtgacagtgaga

SEQ ID NO: 237655 - DNA, 439 bp, Homo sapiens
cttccttccacgaccaaatcaccttgagaagaaacttttgagagcagaatctaaatcgaacatggcagtaataatttagccaaagtgaagggagggggcagatccaagtgaagggaggcagagaagacgaagctaagaaaatataggccttattttattccatggaaacaacagaagacggagttctatggcctagacactagaaaatattttctggcccatcccttatccctaaaaatacaagaaaactcattccacttaaaaatgagtaacaaaataggattgtggtcaaatacagtgcacagttattataagaagaaaaatcagagtagcattcttaccacagagacatgcccccaaaacagatgaaaactttaatatttcaaaagagctaaaagaaaatgaggcagtaagaagagataaaggaacactaatccca

SEQ ID NO: 237656 - DNA, 490 bp, Homo sapiens
agggaaatcttttttactttcagtattgtctgtatcttcattgatcatatactgtggtcttagaatttagcacatcattcttttttcagtcttttaattgactgaaaaaacagtgacctgaaaattggtgatctgttttcatagtggaggagagttgtgagataattctttcctagatctaagtatctctctttatccacctgttaccattttgattcagctatatgggttacagtagtgggatctttgtgtgtgtgtgcccaggagtgatgtggtttcatctcttagtctgagtctcaatagaaatgatgacagctggcattcttcaaggtgtttttacttgaggatctaggtatgtatggttttctgttctgttatagatagttcagtataaatttctgtaataatctgttctgcattgaattttttttctaacattttgttatgaaattttcattaaagaaaagaactttgtagtgaatagaacctc

SEQ ID NO: 237657 - DNA, 299 bp, Homo sapiens
aacttaatcatgtttgcaaaatcccttttgccacataaggtaacatattcacaggtttcagagattaacatatggacatctttggaaaacattattttattctactatattattcttgatattttcatagatagaggagacatactctacccaggaatactcaatattaactttctactttttctgcaattatttcctctaaaaataacacacataaagacataaagacacataaagacacctgcccacttaaacggcgtgctttttcagtgtgcaaaagaagtttgcattaaacactt

SEQ ID NO: 237658 - DNA, 1640 bp, Homo sapiens
attgtctctccagagatgctcacatggtggcataggtcccccctacactcaaatgcagataatctgcattctctgctgaaactactgtccatgggaagtgtcttggtaaaaggaataggatagtggaaaaagttggtagccaaagaaggacggaagtagagagcaaagaggcagcagtaaccgggctggggactgcctccccaagagttataacagtgctggagaatgagcacaactgtcaaaggataacacaggttgttctcatacttcctactctcactcactttgtagaggaatcattcatataactacagggcattcagcaagaaggaaacccatatgagatcctaatagtacaaaggccagcaaatgcttgcataggttctgcccactcccagctgaaagacagtcataattaatcaagtggctcttttctactaagcgcaactgtgatctcagagcctttcctgtccagtgctccaggcaacctctaagaatcaactggcattggtatgtgggacggctcctatttaccagtcctggctgacactgtagaaagaattaaaacatatgtaagtagccaaaatgcaaggcaggtagcactaaatagtttcataaaataggtacatataaagtttcctaactttccaaaagaaaagagaagatttccttaattaagatgatcagaggagacttccaagtggagatggtatttgacatgagcagaattttgaaatcaggaaagggctatcatcaaggtgatttttttaaaaaacttgctttaaatatttattgtaaaaagcaaagctgtaaaaactatttaagctgatacttctgcctcttaatttgttttcatgtgaataatttttaagtaattaaatggcattttagtcgggaaaaatagaaaatatgaaacatttataattcttaatattctgaaaactcttcaagttttcagcatggtagaagtagattattttagctatttatttaaactcaattttcttcttgttttaaaaaaccatagcctttcgttgttgtttctcttctttttgacaactattgccaaataagttttatggaatacttgggtttttcttccccatgtaatgctgggcagttagcaatagttctgaattcaggtcacttctctgttgataagtgtaaaatgcatatctataggtcagtgctaacaaggggtctagttagcttcttagctatctgcagaatatattttcttttcatcacaaaacaagtaagactagatttggcatccttcattatcccaaaatgaagcaaaactacttgagtcatttggattatgcccaggaaaacatattgactcagaaagataaacaaggctgggcgcagtggctcacgcctgtaatcccagcactctgggacgccaaggcggacagctcacctgaggtcaggagttcgagacccgcctagccaacagggcgaaacctcgtctccagtaaaaatacaaaaattagccgggcgtggtggtgggcgcctgtaaccccaggccctcaggaggttgaggcaggagaattgcttgaaccaggaagtggaggttgcggtgagccaagattgtgccactgcattccagcctgggtgacagaataagactccatctc

SEQ ID NO: 237659 - DNA, 523 bp, Homo sapiens
ggaaataaaggttttcttttataggaaggactgctttgccagttcatgtgtatgtgtttatggtggtacaaaatataagttaccatcttaattgccaatttatgcttactatcaagttacatgatcatacatgcccattttgtggttaatgcctgttgtccgaatgtaattattaatagcatctccttttactttcaaaagtgccccagtctggatgataaattatgtggttacctcactataaaaatattgagctgggtgtggggtcacgcacctgtagtctcaactactagggaagcggaggcaggaggattgcttgtgcctaggcttgagatcagcctggacaacatagtgagaccccattttagaaaaataaaaacgtaaaaatgaagacgttagctttcactactgttaagaattgaatctagaaatgggcataaccagggttttatatttcctgtaagcacaaaagttgctaaatttctttgcatttattataaaagtaaaaacacttgtggctgca

SEQ ID NO: 237660 - DNA, 705 bp, Homo sapiens
tgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgc

SEQ ID NO: 237661 - DNA, 411 bp, Homo sapiens
agtgttgtttctactattgactacatatcattggtcaagccccatttcttctggcaaattttttctaagtgactttgcatcagtttacataccctgcttatcttcaagcacggtacttccaaatgggtttatggtgccctactgttcattgtgactaaagaactaataatcatcatcatacacatgaggaaagctgcaacatgaaaaataatacaagacaaacaagtagataaatggacttagcagaaacagagataaagccaggagcaaaatgcatttttaaaaaactataaagcctattctcaagattagaatattagatattgaatgcaataaagaaaataggaagcaattaaaaagggaaagttcagacaagaccaaagagatcttgggaatttaaaatacattaac

SEQ ID NO: 237662 - DNA, 423 bp, Homo sapiens
cagggccagtgagactgttacctcacttttccattgcttgtcctgtattggaaaggcaggggtgcgtagaaaatcctgagagcctatttttaaacagataaaagatctttcagtttaagactattacttattaaagtcagtgttttatgctagccaagaacaaaattagaataaagtcatacagttatataccttatgctgtcacaaacagataaaaagtaataatttagtcctcacttgaatgcctgaccctatgagttttagattattttaaattgttcccttataagcatacctggaatatttttattaagcatgttttgagtactgttttttaaattttttaattaaagaaatatgttccaaatagcctgtagattttaaaggtgctgttaaaggattcttgtaatactaaagttctac

SEQ ID NO: 237663 - DNA, 533 bp, Homo sapiens
ggtgaaggaagcaggtgtataaacaattaaaataagatgaagaaggcttcgaagatgaggtgattctgtggtgtgttttgaagtgggtgggcttatgaaattcttttgctttctctaatatatctaaacatctatgtaaatacctggatgatatacagtactagtgacaatattggagttttgtcttctagttagccgtgttttgctgctgtggtagggaggtaagtctcagctagggagcactcaggtgacagggaaatgaagacagggaactcctgcctgtaagtgagcaggagctctctgcaagactgagctctgccttgcacagtagccattggcctgggagacatcatgattattgctggaaatgctgccctttctgaacccttcctttttttgaaggagagtgtattgatttcagatttttggctactgtctttgcacttatcccttctgtgtgcctatttgaaatacccaaattgtgttaaatgtgcacttcttcatgtatacaccaaattattttgaccataaag

SEQ ID NO: 237664 - DNA, 441 bp, Homo sapiens
aatagtgacaggatctcactgtgttgcgcaagctggtcttgactcttggattcaagtgatctttctgcctcggcctcccaaagtgctgggattacaggtgtgagccatggtacccagccccaagtctttttttaatgcgtagaaacattttaataaaattagcacatttatacatttgtacatcctggttttttcaagcagttttgtttcatgggtgttttccataccattaactcttttcaaatgttaatttttaagtgaccgatatccatcatgttaaggtatcatagcttacttgggttgtctctaatgttttcctattagaagtaagtgtagcgacctgctacctttatgtctgaccctgtcaatcccagccagcatgaccacacctatgtccagctgtgaagtctccatctgactgtccccttctgtcgtcttctc

SEQ ID NO: 237665 - DNA, 446 bp, Homo sapiens
aaaagaaaaaaaaagaaaagaaaaggaaatttggttatagagctatgcctcctacaacaaattacaaatatggagcccagataacagatgagacctggtgtattctgcactacttacccccacccacctaaagtgctgcatgctgtttgaggctcctgtgactaggagagttatcctattccttagaggctgctgagagcaccaaattttggacccacctctaagagaaataaaggcacccaggaaactccttcacctgtagtacccttgacctcatgtttttctttgcactgcttattgctggttcaacagtaaagcaaagcaaagcctaggtaatgttagccaagcctgagtcgtcattcttgccaattctcaaaggaggcggggtcaactttaagaaaccatgatgtatgtcctatctcatcaggaaatcaaggctaaagaaa

SEQ ID NO: 237666 - DNA, 108 bp, Homo sapiens
agtagaattgtggttttgaaatattactaaggaaaacactctataaattgttttattccttttctggtaggtaaacctgcaaccaccaaggactccaaattgtgtatg

SEQ ID NO: 237667 - DNA, 1658 bp, Homo sapiens
catgcttttactagataagcagggaaacaatttgatgtagtctgtttcattttaactgacagagtgtcacttcttagttatacttatgtcactgtgtgccagattgctgctatcggaaagtgggtcttcatctcagagcccactgtgaataggggaagcaaagttggccccaaaatataactgcataatgccttctgctttcagacaagctttattaaaggggcaggtggaagagagtggaattcaaccaagcttttatttcgttgacatggttttagaagaagattcctgagtagtccaaagaatgttctcccaagaaaccactgctccccagccccacatgtcctttcctcaccacatacacaccccagccagctgggtggcatggtacgcatgcacctgtggtcctgtgggagaaatgaatatgacaggttcagtgtgtccaggccactgggacctccactgaccagtgggtcggggtgaacaagagagttatactgtgagagttcataccctcactagcacaaagactttttgacccccctgtaaggtatgtgtatgttttttgaagaggtgcttaattggtgtgccaggcaatgtgctatgtgcctgatgacaaagataaataagatacctttcctttcaaggagcttaccatatggtgaggatgacagatacttcccaagtaatatgttaaaatctaagctagaagtgaacagagattgcttttagagggttgaagggaaggcttcctgctgaagagataactgattggaggaataagagttactggacttggctgggcgcagtggctcatgcctgtaatcccagcactttgggaggccaaggtgggcggatcacctgaggtcaggagttcgagaccagcctggccagcatggtgaaaccccatctctactaaaaataccaaacaaaaattagccgggcgtggttgcgcacacgtgtaatcccagctactcaggaggttgaggcaggagaatcacttgaacctgggaggcagaggttgcagtgagccgagatcgtgccattgcattccagcttgggcaacaagagcgaaactccatctcagaaaaagaaaaaaaaaaaagttactggactgattaaagataggaagcaagtttaaagaatatttgccatcccttcctatttagttgaatggtgttgcttcaacccaatcaattaagttgggcttagattttcactgtttctctaataaaaatgaactctcgccctagtggcacagagtctgtaccttggaaacaatctcaggccatggtggccctcatatcaccatgagttcttgccatgcggcttagggttttgaatggtgaggcttgactaagagaccaacttcaggatgtatgtcctgctcgctttgacccttatcacttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaa

SEQ ID NO: 237668 - DNA, 1072 bp, Homo sapiens
gagcgcgaagcgggccgcaagacttaaacgtggcccaagtccagaattcgattggaccaagggggccgccaggatagttaaggagaattattgtttcggggacagagttcatgccctgtcactcaggctacagtccaagtggtgcaatctagtctcattcaaacctgcgtctcccaggttcaagtgattctcctgtctcagcctccccagcaaatgagattgcaggtgtgcaccaccacacccagcactttgggaggccaaggtgggcggatcacctgaggtcaggagttcgagaccagcctggccagcatggtgaaaccccatctctactaaaaataccaaacaaaaattagccgggcgtggttgcgcacacgtgtaatcccagctactcaggaggttgaggcaggagaatcacttgaacctgggaggcagaggttgcagtgagccgagatcgtgccattgcattccagcttgggcaacaagagcgaaactccatctcagaaaaagaaaaaaaaaaaagttactggactgattaaagataggaagcaagtttaaagaatatttgccatcccttcctatttagttgaatggtgttgcttcaacccaatcaattaagttgggcttagattttcactgtttctctaataaaaatgaactctcgccctagtggcacagagtctgtaccttggaaacaatctcaggccatggtggccctcatatcaccatgagttcttgccatgcggcttagggttttgaatggtgaggcttgactaagagaccaacttcaggatgtatgtcctgctcgctttgacccttatcacttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaa

SEQ ID NO: 237669 - DNA, 432 bp, Homo sapiens
cgtctgagccgtgtcctctcacaggagagtacatcactgaatatgagagccagggggcagtgccaaacacgcggcaccaggagaaggaagacatcatcaggctggcccagaaggaggaggagatgaagctgctgttcattctttttgactgcttgtgacaacaccagaagatagagatcctgagatcttttaagaactgctgctgggaatgtacactgatctgaccactttggaaaacagttcggctccatctcataaggttgaatattcacactcctcccagcccaggaattctactctacatccaagagaaattcttgcctatataaaacagggggcatgtacaaggaatgttcctaatagttctgttcaaaatagcaaaaacctattgcccatcaatagtgggtgactaaattgtgctttttattcctt

SEQ ID NO: 237670 - DNA, 503 bp, Homo sapiens
ttttttaacctactactgctttgtacgttctctgcattactgagtttctcaagtgagttgaaggcagggtgtttagtggcaagtggtattttggaggtaggagtgagaaaaaaacacaaggctagtgatggcagttttctcctcactttctttggttcctcttccaactaaaaagaaaagcaaataagagaaagggtgcacattaaaaagggataccggccgggcgtggtggctcacgcctgtaatcccagcactttgggaggctgagacgggtgggtcacttgaggtcaggagttcgatagcagtctggccaacatggtgaaatgccgtctctactaaaaatacaaaaattagccgggtgtggtggcatacgcctgtagtcccagttactcgggaggctgaggtgggagaatttcttcaacccaggaggcagaagttgcagtgagccaagatcgcgccattgcactccagcctgggcaacacagcgagactctgtcttaaag

SEQ ID NO: 237671 - DNA, 502 bp, Homo sapiens
aaagaagacctgtctgcagtaggaaggaaagaggctaatctccaaagagaagtagagagagggccacacaacagatggacagagaggaagagcgctggctctttttggtccctggttttaggtcctagttttgtgagttactcctgcattctttccagggaccgaagccagtcaatttcaccccccaacacagccacacacatcaatttgtttttggttaagctgatttgagcagtttccctcatttgcagctagaatggtcttgaggaatatgatccagatgttcaaagaatcaaagaggagaaatcaatatgaaaatggcatttcattcaatgagggtttgtgacaacaacctccgtaacagcaggcaaccaggcttgtgatacagcagagacactcagttgtgtggggtgctgcagtcataactgaaaaattgtatctgcctataagaaagactaaaacagaaaaggtgaaaataaaaaagtcatggtgttaagatggt

SEQ ID NO: 237672 - DNA, 417 bp, Homo sapiens
ccacgccacaagtcggcctcttccgcatagacctctgcctaatggtatccacccaccgggggcacctctgctcatcctttccccagaagtatttctgggtcctcaaagatctgtccttttccaagtggtatttgctgttagagcaagcctcggcctgggatttttatggcagtgatgcgttgtggaaagtgcgtctgcctaggaaggcaggccggcatgctttcaaatcttagctctgctgcctacttgacggccaggcttagcaagcgtctctagccgttccaagccttttctagatctgtaaaactggaagaagaatacttgtctcgcaaggaacatgtgagaattcatgaaaattgccaccacatactaggtggccaataaattataactttgtatttgtttttactgacacta

SEQ ID NO: 237673 - DNA, 686 bp, Homo sapiens
cttccccaggggacattggcaatgtctggatgcattttttgttgtcatgactggtgaggaggatgttaccagcatctagtgggtgtcagccaggaatgctgctaaacattgacaatgcataggacagcccctacaccaaagaattatctaccctcaaagtcaatagtgctgaagttgagaaatcatggtttagggagtcttgattaaaacttttcaactggggtaccctgagatggtgaaatatactagtatgctttgcttcacagtgtcaactttactcgcatctgcagcaggtgagttataatcttcacaggagccagctcctggggaaagactgatcatagaagaaattctcattggctttgaccaaatccttctccttgccaattaggaaatattgactttctaatcttttagcaaaagctccctctgtatttgaatatatgtttggttataacaaataacttgtttccacaaatggaaaaaagtatcgtaaatggcaacagatatagtttagtgctgactttagatggtggctggacctcctataggacaggcaaagctaagtactttctactcaaagccatcaaacaaaatgcttacaaattagaatgtaatggccattgctttacttgttttgataaaccagaaaaacaggcttcagcttattgaatctattattgaac

SEQ ID NO: 237674 - DNA, 632 bp, Homo sapiens
cttccccaggggacattggcaatgtctggatgcattttttgttgtcatgactggtgaggaggatgttaccagcatctagtgggtgtcagccaggaatgctgctaaacattgacaatgcataggacagcccctacaccaaagaattatctaccctcaaagtcaatagtgctgaagttgagaaatcatggtttagggagtcttgattaaaacttttcaactggggtaccctgagatggtgaaatatactagtatgctttgcttcacagtgtcaactttactcgcatctgcagcaggtgagttataatcttcacaggagccagctcctggggaaagactgatcatagaagaaattctcattggtagcaaaagctccctctgtatttgaatatatgtttggttataacaaataacttgtttccacaaatggaaaaaagtatcgtaaatggcaacagatatagtttagtgctgactttagatggtggctggacctcctataggacaggcaaagctaagtactttctactcaaagccatcaaacaaaatgcttacaaattagaatgtaatggccattgctttacttgttttgataaaccagaaaaacaggcttcagcttattgaatctattattgaac

SEQ ID NO: 237675 - DNA, 391 bp, Homo sapiens
gtatcatctacctgcctgtttctaacatcaaataccacacagtcacatcgtagagtcactgtgagagctgccattcaccaggcacattctgcgtgccagagacggtgttgagccgcgcatccgcacccccacttcaccctcacagcgaccccagctgcgggggatttctaaaatccatcttgtacagatatggactctgaggctccaagggaacaagaccaaggagggaatccaagaagcaaaggccgcatggaaaggacaggctcccttcaatcagaggagctcaaaaagcgatcaatgttatcttctttgaaactcacacaaaactgagttttgcattaagtttttggcaaaaaagagtactaaaaataaccgtaaaccattctgttaa

SEQ ID NO: 237676 - DNA, 373 bp, Homo sapiens
atttatatttcatatataattttcattgtcatgtatcataaattattactcttttgatttctttcaagcatttaaggatgtgaaaaccattcttagctcataggccatataaaaataggcagcaagctaaatttggcccagaagccatagtttaccaacccctatgctagataattgagagccaaaataaataagctattgtgctctgtcctggaagaacaaacaatcacggtggagacttgggcattcaatgaagtaaatgtcccataaaatggtaagtaccataactgcaacagggagctatggaagactagaaaaattttaaaaaaagaagaaaaatatgctagaatgacaatttaaataaataaataaa

SEQ ID NO: 237677 - DNA, 3415 bp, Homo sapiens
  misc_feature (1269)..(1269): n is a, c, g, or t
  misc_feature (2153)..(2153): n is a, c, g, or t
  misc_feature (2184)..(2184): n is a, c, g, or t
  misc_feature (2209)..(2209): n is a, c, g, or t
ggagttgtacattatgtatgataatgtatgcacattttcttatttttaacttcagggccatatgtggtgctgttgtcggagcaggtgaaaagtctgagtgtgtttaatttgcttgacaaacattaggctggggcttgtcaagtggagtatagtgaatgccaatctttatttactccttattgattaccccaaactctaaacatctgcataccttgtataaatttccacttatgaagctgaaattgatgaatgaaagcccatgccatttcccggggattggtacatttcaggagtgaatcacaatcaattattgtcataggactattgaaatataaagggagagctgggagggagggcccagcgccctgctctcacgattgattcaggcaggagcctgttccgaaccgtgtgtgccagattagcccgtgacttcatgacgagcatgggaagtatgctaattaacggctggctgccggcgccctcccctaaaatgggaaaatacatatttgggggttatgatttgatggcgacgttcaagtgcgttgtcacagattgggaaagcgttttcatcaagctggcttgttatgcctcgtttcgatgtggtttaagcagcagtcttattaggttaaccctgctcagtgaaagcaagcaggcttactttctgattagataaaatgtgcaggcataatgggaaaagtcattaagtgatgaatgtactcttagacatggactaatcatactctatttatgtagctggttcgtagctatgaccctctcgtgtgattcttgtgctatatttatggtcagtggtgattatcattaatttgtaacgcacataaacattcatgcaacacggctcactctctgagccgtcacaggaggcctcattcccggtctggacccatggtgttgctcacctcacaggtgtccggcatccgtggcaccaaaatccccaaataagtggaaatcgccaaacagctcattgcacttggctcctatggttccaatgacaacagttttatatggaaattgagttcatcaaattaattattcactgcttttacgggagtgggttccaaagcaggggcatgtgcacactgtgaagacctacccctctcctgtttccttgggggcaccccagcaccgcctcctggccccaggtagtttcataagggctccaaagaggaacccgactaagagccccgctactcatcagttggagcctgggacccggggagagacccgggatcatcctgctcagtcaagttnacttgactctgtcatttcttgccgctgctgagaaatgcttcccctgccagtgtcccagccctgggtcctcaggcaggccgttggccagagagaggcgggcccatcaatctcccttaacagcctgattggctgcaggtcagctgagaggaaaaggtttgagattgggacgggtttagccaggaatctcggaatttcccggataattgggggagagtgacgccaagctcttcctgtcacttttagatatttctgaactacctctgtaatgaattggaatgcctcttaccagggcctcagagacgccgtgagccactgaagtttatgctctccaattatccagaaggattctcaaaagtgggctgtgggcctctgagctctgttgtgcttgtaatacatggcatcacctccttgggtggcagaccaccgggccacggatccacaaaggatggcgcggcctgctggggaccctgtattggtacagacatcactgcaagtctgactcagagctaattgcagatagttcatttaactctgacttctgcaaaaatggatgtaaatatggagggaaacacacaacagtcgttttcgtgaagaacggccttaggacaaagacaaagaataaaaaatgtcttttgtatttacttgaaacaaatgaatggtatcaggtgaaaaatatctgtctgtgcttgttcagatttaaggcctacaaatttgcaccttattccaatttcctgcatgcacgggaggaagtgcgaatagcttattcagaggcagattaatgcaaaagagctgagagggcacataaatctacaagtagtgacttgtaccatcatgtaggtgtaatgattatcaaactggaatcagggctcagagtatcagcttancacagagaaaatttgcttgatgggagagtantaaagtcatgctataatatatccanatactgtgactaaattttatagttcatgaagcatattagtattacactatatcccggtacattcaaaaggtgatttccatttagatgctcatttttcatgaagataaatatgacatgaatcataatttccctgaagtaaatattacaaataataaaatactcaggcaagcaagttgaggaatgacagtaatgttttccatttgtatggtaagtggcgaaccttgtggcctatcaagtaacaaattgaatgtttaatctttctccatgcagattgaggatggcaaagtagcgcggtctcacaacaaattgagagttctctggtgactcgtggagtatcagctcttttgccttcagaggccaatagagggtgtcagcagagctttgtcaaaatagatcacgagcatgaagttgtaaaattgcaatttacaacaaaaagactttgggataacgggcaaatcttaggcatgctaaatacatagcaaatatttagagaggctttgtaagcaatttaaatattgttaggggaagttgcttagcatctgtggagcatcccagcggtaaagaaagaaatgtatcctatcaaatggtaaatagtctattccaaatgataaaaatattctttagatactagctgatcgagttaaactaattggttgacggtgccttaaagccgtgcccagtattaggctggcggaggccccgctgtgcacgtcacaccttatggtgttaatggcgctctttgtgctacatcatctttgccgatttgccctcacattttggagtccctccgggccttggggatcctggtgcagcaacagcttgtttccctgggatctcgatgctggcctggagccggcctgccgcctggggtctcggcagtccaggccacagttcagggtcacttgtaccacacagcccggggatgttccttctgctgaaggttctgttgtatattaattttaagttgcagtgtctgcactgcaagatgacaccactcgcattttgattaaggattttatacatgaaaaaattttcattatctgagttcccagagacctccctgattggttgcctgtctgacccacagctgtgtctccaagcgtcggggtaaggactcgggcacatgagtgtgccctgcactacctctggtacatgaacaattaatggggcttttgactctcagggaagtcaagactcttcataacc

SEQ ID NO: 237678 - DNA, 291 bp, Homo sapiens
tgtgggctgcaggaaccataggcatatcctaagaggttgaagcaaggggaagcttttaaaagcaaaaggaaaaagtgtatgtaatttgttttcagacaaagagaacactggttatagtggctatcgcaggaattgacgccagctcattagtgaagactgtggcaggcaaatgttcttgtacatctggctagctgtccttgtgactcacgtcacgagccactgtttgaaaagtcctttgcaaaattgttgttacaggcatatgtacataagagcccttcagagagtctttgc

SEQ ID NO: 237679 - DNA, 468 bp, Homo sapiens
gagtctcactctgttgcccaggctggagtgcagtggtgagacaccatttcaaaataataataataattattattataggagactagagagacatgacaactaaattaaaggtgtgattcttgattagatcctgcataaaacaaaactcatgtataagagatacttctgggtcaattgggaaaatttgcatctgagataaatgttgcatgatatcgttgttgttatgttattagaatggtttggattattattgttaataatccaaaacatatgaagtgatgatataaaatgtccttgttcttagtatattcaggctgaagtctttatgggcaagtatcgtaatatatacaacttattttcagatgatgcaggaaataaaagggatctttctatggagaaacagagagaaaaatgttacaacatattaacagttgatacgtctaggtgaaattgaaaaaaaaaggaacc

SEQ ID NO: 237680 - DNA, 759 bp, Homo sapiens
gagtctcactctgttgcccaggctggagtgcagtggtgagacaccatttcaaaataataataataattattattataggagactagagagacatgacaactaaattaaaggtgtgattcttgattagatcctgcataaaacaaaactcatgtataagagatacttctgggtcaattgggaaaatttgcatctgagataaatgttgcatgatatcgttgttgttatgttattagaatggtttggattattattgttaataatccaaaacatatgaagtgatgatataaaatgtccttgttcttagtatattcaggctgaagtctttatgggcaagtatcgtaatatatacaacttattttcagatgatgcaggaaataaaagggatctttctatggagaaacagagagaaaaatgttacaactaggacttgggagaatgaagtcagatgacacatatgtagcaggagaccagtgcctggcccatagttgagtgcccagaaaggtacaagttactactgttattggtagctcctccatgctgaaaatcacttatgttttgaatcgttcactggatatctgtaatatctaccactggagaagttaatagtcacgagaataactcttggccaggagcagtggcttacacctgtaagcccagcactttgagagactgaggcaggcagattacttgaggtcaggcatttcagaccagccggatgatcatggtgaaactccgtctctactaaaaatacaaaaatta

SEQ ID NO: 237681 - DNA, 403 bp, Homo sapiens
ttagattaatagcagccaggcatggtggctcatgcttgtaatcccaacactttggaaagcccaggtgggaggatcgcttgaagcaaagagttcgagaccagcctgggcagcaaagtgagatgccctccatctctaccaaaaaaataaaaataaattagctggtgtggtggcatgcagtcccagctactcaggaggctaaggcaagaggatcacttgagcccaggagttgaaggttgcagtgagccatgatcatgccactgcactccaacctgtgtgacagagagtgagaccctgtcttaaaaaaaaaatgagagagattagattaataacaaactgaaatcatatgtaccagctgtttttgacaaataagatctcatgaccttcaactttttgtcctcccttt

SEQ ID NO: 237682 - DNA, 414 bp, Homo sapiens
taaaattcacacatgcacagacactcaaagagacagagaagaaacacctttccttcctgggcaggttctcagcacctgagcccctgccttgtgtctaggaagctaagacacagctaagcccctgccttgctgtggaagctaagcccgtcttgcattatagaagctgaaaatggcaaattcacttacctcccttgctccaccaacaggacgcaccgacacacactttatatcagaaactggtgacccataggagtggggagagcgcagaactgcagcatttgcagcacccacttttggaagcttggtggtgctgttctggaccaactggaggtctgaccagcagggcagctgtggggccttgtggggcctgatctgggtatgactgttgtcattcctggccatgtggcctctgag

SEQ ID NO: 237683 - DNA, 4306 bp, Homo sapiens
  misc_feature (243)..(243): n is a, c, g, or t
  misc_feature (1056)..(1056): n is a, c, g, or t
  misc_feature (1354)..(1354): n is a, c, g, or t
  misc_feature (1384)..(1384): n is a, c, g, or t
  misc_feature (1577)..(1577): n is a, c, g, or t
tttcaacacgcagagttgaaaaacagtgaggctcataacctcacagtcccatgccagggaacctaagtccagcagtgtgttttctgaaggttctcaaagcacagagtaattcccattttccgggagaaccccacatctcatatggtttcaagccagacaatggggatccgcgcagagagaacatgcacgcacacaaacaggaaggacgcagacgggctttgggggtgatgagggacagcttcnccctgaggtctcaggcgaggggtgaggaaggagactcatgtgaactcctctgtctctgctctcaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaatttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctggtaagcaaataactcttatcctagtgtctgagtccctggggagacagaaggccccagtgtgagtgaaagctgtgccacctcccagctccatgaccctnggctaggcagcccctcccaggtccccacattccccatccacatctgagactgtggtcagtgcgggaatctgtaaggcctttcagcctcagacgctttgggactgaggcctcatccacaggggaggaagaggtcagagtcacctgacccttgctgaaaagcaatgcttctcattcctccagggaggtctgtgaacatgaaaatgctggaagatgggaaggatttaaaagaccatattcgatattcactgtctgtctttttttgttgtttttttttttgagacagagtctcactctgtcncccaggctggagtgcggtggcacaatctcngctcactgcaacctctgcctcctgggttcaagcgattttcctgcctcagcctcccgagtagctgggattacaggtgcccaccaccacacccggctaatttttgtatttttagtagagtcagggtttcgccatgttgcccaggctggtgtcaaactcctgacctcaagtgatctgtccgccttggcctcccaangtgctgggattacaggcgtgagccagtgtgcccggcctccgttgaggttcttgatggagaaaccctgctccttcccttcactgaccaatcaccccaacccctcccctacctccacctcacctctggggaggccactgacctgcaggagatggtccatgagagaggcagaaggatgggggccatctatcggagcggtcctggggcagtcaagattgccccaaggttgctgatgggtggttctctgaatttagtgggggaggctggatcacgctgcagcctcaggcacgcccttgccttgttttggtcttggtattgccacctctgaagtgaagatctggaagactttctttttcaccccacagacaccaccatggcaaacacagagcccacggaaggccaacggacggatgaagaggtgagttctcccagccgaaaccatcaccacagcttcatcccctcccattcccagtgcccctgccttcagccactaaatatgctcctcttttcaccttcatcctctcaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctcccccacaactttagaaggtactttgtaatattctcccccacaactttagaaggtactttgtaatattctcccctccccttaagaaggtactttgtaatattctcccccacaactttagaaggtactttgtaatattctcccctccccttaagaaggtacttcgaggctgggtgcggtggctcatgtctgtaatcccagcactctggggggccgaggtgggtggatcacgaggtcaggagatcgagaccatcctggctaatgtggtgaaaccccgtctctactaaaaaaatacaaaacaattagctgggcatggtggcgggtgcctgtagtcccagccacttgggagtctgaggcaggagaatggcgtgaacccaggaggcagagcttgcagtgagctgagatcgcgccactgcactccagcctgggcgatagagcaagactctgtctc

SEQ ID NO: 237684 - DNA, 3217 bp, Homo sapiens
  misc_feature (243)..(243): n is a, c, g, or t
tttcaacacgcagagttgaaaaacagtgaggctcataacctcacagtcccatgccagggaacctaagtccagcagtgtgttttctgaaggttctcaaagcacagagtaattcccattttccgggagaaccccacatctcatatggtttcaagccagacaatggggatccgcgcagagagaacatgcacgcacacaaacaggaaggacgcagacgggctttgggggtgatgagggacagcttcnccctgaggtctcaggcgaggggtgaggaaggagactcatgtgaactcctctgtctctgctctcaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaatttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctcccccacaactttagaaggtactttgtaatattctcccccacaactttagaaggtactttgtaatattctcccctccccttaagaaggtactttgtaatattctcccccacaactttagaaggtactttgtaatattctcccctccccttaagaaggtacttcgaggctgggtgcggtggctcatgtctgtaatcccagcactctggggggccgaggtgggtggatcacgaggtcaggagatcgagaccatcctggctaatgtggtgaaaccccgtctctactaaaaaaatacaaaacaattagctgggcatggtggcgggtgcctgtagtcccagccacttgggagtctgaggcaggagaatggcgtgaacccaggaggcagagcttgcagtgagctgagatcgcgccactgcactccagcctgggcgatagagcaagactctgtctc

SEQ ID NO: 237685 - DNA, 312 bp, Homo sapiens
cactaaatttgaccctagctgacattttctggctcagccacgatattttccaaacctctgtattaaaatccttaatatactgaatacaaatgaaatggctggtggccaccaaatgccacacaaatcaatgctttcttcttcaatttctcatcagtttcacctgtagtaacagtgcaggaccttttatggggtacagttagattctgttcatgagagtaaagcttggcaattcccaatatgtgcccagtgatcaaaagtcatagactgtgtcctcaattcaaaaacttagggaaaggatatatgcactattta

SEQ ID NO: 237686 - DNA, 775 bp, Homo sapiens
  misc_feature (697)..(697): n is a, c, g, or t
  misc_feature (726)..(726): n is a, c, g, or t
  misc_feature (735)..(735): n is a, c, g, or t
  misc_feature (750)..(750): n is a, c, g, or t
  misc_feature (769)..(769): n is a, c, g, or t
  misc_feature (774)..(774): n is a, c, g, or t
attacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccccaaccaattgcttactttcntggggtattgtcccaccaccttgcttggnagccttcangaaaaatggcccccnattggaaaaaaaaaccccnaaaanc

SEQ ID NO: 237687 - DNA, 412 bp, Homo sapiens
ctctaattaacaagatagtttgatttttatcaagatgtcgttaatgcaagtaaacaagtgacattcctggcaggtgataaaacgggtatttatgtaaagagtaatatttccggcctggcggggtggctcacgcctgtaatcccagcactttgggaggctgcggcgggcggatcatgaggccagaagatcaagaccatcctggctagcacggtgaaactccgtctctactaaaaaaaataaataaataaaaagccacaaaaaattggccgggcatggtggtgggcgcctgtggtcccggctactcgggaggctgaggcaggagaaaggcatgaaccagggaggcagagcgtgcagtgggcctagatcacaccactgcactccagcctgggggacagagcgagactccggtctc

SEQ ID NO: 237688 - DNA, 763 bp, Homo sapiens
cgtggggattaggggccaccaccttaaaaaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaa

SEQ ID NO: 237689 - DNA, 619 bp, Homo sapiens
gtcaattcattaccaccatgtatattggaaactttctacttatctttcaggattctacagcaattctatgttacctttgatgcagtgctatactgtcaccaatattcgttggtttctagactggaaaccaatcggttcttccagattggttttatgaagcccctgccccataaactgaactccgaggcaccctgagatggctccttgatactctcatagccctctctgcctcttgtgtagtgagtccatttcccttacttgacagacattccttgagggcacatcctgaatctttgctactacatagcagcacatctgtacatagtgtagactcaaagaatgtttactaaataaacaagggactgatttagccagataattttagctggatattattttcacccagatttcaagataaaactaaatcttcccttcctagacacaatcagataatcacctcagtttctcatttgtgcttttgttattagattactaccactgatcaatactgggtccaatttaacctactatgtatatactctgtaacttcatattatttcatttagcctgacaaagtgaaatttgggttctaacttcaaatacaatttaaactttttga

SEQ ID NO: 237690 - DNA, 219 bp, Homo sapiens
aaccgattccccacatgaggaggtaaaccctagcgcggaggacgtgagattgtgctgccgtaaaggacactggcccggagaagacactccagaggctggccgtgcagaaacccttagaaaaaaacagacatgctacaaggagttttattttttttaatttcaagaagaaagctattataaaacatttaaatggcctcaggttaaataaatgcctcattt

SEQ ID NO: 237691 - DNA, 479 bp, Homo sapiens
tgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatac

SEQ ID NO: 237692 - DNA, 440 bp, Homo sapiens
ttcaagatattgcttcctctgtaaaggtctgaattattgcaagatattgagaatttccaattcagtagttagatgtgactggaataatcaaagaagtctcaagtcctaagaacgaggtgtagggagagaatgttatctaaaacgccatgtgatatagaaatgcatatgagtcttgagctgtcatttacacaatgtatatctgggtgtcagggaaaccatggatctgcctcacaggtctgcctcacagcccaacatcagcttctgcctccctcttgctgtgtcagtacatacatacatattcacttgtgtgtgtgctaagtgtgtctcatcctttagcagaacttatttctatatatgaaccaaagagaagcatttatagtggaatttagaataatttgtatcaggagtttgaaaaataaaaagaaatgaaattaaaaact

SEQ ID NO: 237693 - DNA, 313 bp, Homo sapiens
ggcagacgcaggttcgggaccatgagctgaccaagattgatggacaaatgtcagacaatcaccgcaagcacgggaggaaagcctgaagcaatgtcctaataagccccggcaggagcttctgcttttccctccaccatttgctccaggaggccaataaggggctggagccttaaaaagctaccttccctgtcttgttataacctagttagtggtgggcaaagcggcaattcttcagttccctttcccagaggaattacgtcctttcagtgtcattctgggccccccagtcttgcaatatagatatccttttggc

SEQ ID NO: 237694 - DNA, 568 bp, Homo sapiens
tgtgtgaataaattgagccccagagatgtacaagattaatcagcccatggacatagggaacatatttgccactctgtcctcagaggctagtgtgtttgtttatgcaaagcgcatgataaccagttatgaatgaattaagataacagaatgtccttcaggaaggcttttgaagcttaattttggccatcagtggagaacgcaagcagctgatatcagtcagtgtcagggatacttctctaaagtaaaatgcgaaccatctgtcccctcccccacctgtttcttagaccaagattgatggacaaatgtcagacaatcaccgcaagcacgggaggaaagcctgaagcaatgtcctaataagccccggcaggagcttctgcttttccctccaccatttgctccaggaggccaataaggggctggagccttaaaaagctaccttccctgtcttgttataacctagttagtggtgggcaaagcggcaattcttcagttccctttcccagaggaattacgtcctttcagtgtcattctgggccccccagtcttgcaatatagatatccttttggc

SEQ ID NO: 237695 - DNA, 403 bp, Homo sapiens
gggcccctgtgcaaggacggcacgcgaattcctgaagtgttccaaataaataaatgatatccatctgtaaattggcatgataaggcccaagaactatgggcaggcatcgatgtcctttgctacacctctggcatcacttcagtccattcacacaccctccagtatgtgaaccgctccataaatgaacaagtgcagcagctatggttcaagaaggccatggtgaccagaggctcagacccttcagggaggaggctcagggtcaccttatcagcctggactttaaccacgtggaaagcaagattagaggccccctgaatagtactgttcacgaagactaaaaggaactgagtgtgcctgagcttaagcatcacgaagaccagtaataaagaactatttacaaact

SEQ ID NO: 237696 - DNA, 176 bp, Homo sapiens
aagaagatcggagaggaagacataatatagggaagggaggggtacctggactttaaccacgtggaaagcaagattagaggccccctgaatagtactgttcacgaagactaaaaggaactgagtgtgcctgagcttaagcatcacgaagaccagtaataaagaactatttacaaact

SEQ ID NO: 237697 - DNA, 1147 bp, Homo sapiens
tttagagcgtgatccttgtacttgtatgaaaaaagttaactgtgaaacagcctcaggcaggtcctccaggcagtatccagaggaaggcattgctatcacagagatgacagctccatgcctgttattgcccctgaagactttccagtgggacaggatgtggtggtggaagacagtgatattgatgatcctgaccctgtgttggcctatgataatggatctcaatatgttggccaagctggtctcgaaatcctagcctcaagcaatcctctagcctcggcctccaaaagcggtggaattacaggcatgggacaccatgccttgcctttaccttttctacatttagatatgtttggacacaaaaatgcccctgggttacaatggcctactgtattcagtacagtaacatgctgtgcaggtttgtggcataggagcaataggttatactacagctataggctataggcctaggtgtgtagtgtggctttgccatttgggtttgtgtaagtgcattctatgatgtttgcacaataaccacaaaatcactaaatgatgcatttcggagactgtatccccaccattgagtgatgcatgactttgtgtgtgtgtgtgcgtgtgtgtgtatatgtgtatatatctcacttattaggcataaaaatgttacaaatttagatgctatagataacagtatatctgatactgtatattactacagatgctgtggggattagaaagataagaatgtcatgaccaactttttataccactaaatatgaaaataggtgtaatatacaaattcctagagaaatatgttaccaaatccgactaatatatgaatgcaatttaccacattaagaaataaagaaagcaaagttttatgatcatcttataagcttcagaaaaatcactggtcacattcaacaatcattcagtatacaaacttacagcaaattagaaatggaaaagaactttcaaaacctgatgaatgacatctacagaaacctacagcaatatcatactcagtgataagattttaaaatgaggaacaagctgaggatagccaccatcactacttctaatagacattattctgaaacttttatttattgtcataagacaagaaggcagaaataaagccatggagaagaaa

SEQ ID NO: 237698 - DNA, 330 bp, Homo sapiens
ctatagaagttttgttagattgaatatatgaaaatgcctaacgtaatgtttgccactggtttagaagcatatttatcatgaaactgatgaagtttagtgaacctaattgcatggccctttctaaggcccttgcaggagcagccctagcaatcttgaattaatttgtgtttttcttaaggaccctcccacccagctgcccctttattataggctgctggtcaccacaaaatctgaatctgcctttggccacaggttaagtgagaaatgttaatttctctctcctctaatgttgtgacttcagttagtgtccaacctagaagtacttaactt

SEQ ID NO: 237699 - DNA, 398 bp, Homo sapiens
gtgaagtgctggcagtaagtaggggaaaggcttacttccccggctggtgggcatcgtcactgcggagggcaaatggaagggtctgcagaaaacgtgattttgcacgtgccctacggacctaggaactccagtcctcagtatcgcccctcaacaaacacatacatgtgggctcacgaagtagctcacacgaagatgtttgctaaggcacgatttctaataacccagtagttaccagggtaataaattatgctttatccacattataaaatattatgtggtaaaaaatgagataattatataccacagaaagattctaagatgtatcacagagtgaaaaaacaagttgtaaaaaattacatgcaaggtgatgacattaaacaataccatacatttactaa

SEQ ID NO: 237700 - DNA, 289 bp, Homo sapiens
gctaaaatttagccaagtttattgcaaatgcaagtgcaatttaggtgggaaaatagacatgtaaatttgtgcataagagaacataaagactggagtagtggctcacacctataatcccaacacttcaagaggctgtagcaggaagcttctttgagcctaggagtttgagtccagcctggacaacatagtgagatgctatttctgtaaaaataataataaaaaaattagctgggcttggtggcacacacctgtggtcccagctaattgggaggccgaggtggcagaattg

SEQ ID NO: 237701 - DNA, 480 bp, Homo sapiens
atgaagtggctctgtcaggattcaatcagagaagcaccacctcctcacggtcaaagggcaggggctttgttggaagggatcggaccttctgccaagatggagctccaggctgtctgtgagacgctactgcccggctctggggctgggcctgaagccagcaggacaggtggtcaggaaagaagatgggcaagaagtgggaaggggcaagggccacctggacttcacgaggccacacgtgaacccacgtggacagtccagtgccctacatctgtctcttaccactttatgctgcactgaataatgttccctggaaattcatgtccacccaggacctgtgagtgtccccggaaattcatgtccacccaggacctgtgagtgtccccggaaattcatgtccacccaggacctgtgagtggggtcttctgtggacaagggcttttgtgggtgcaaccaaataaagacaaagtcacactgaattga

SEQ ID NO: 237702 - DNA, 777 bp, Homo sapiens
tatcttgtctgcatcttgtgtttcagttgtatttatcggtaaaataagccaggggagtattctgacttgcagtttaaaagctgacaggcctaggggaatgttccacaaaatagtatattttgtatatggcatggtattatagataaatgagctattgtgctgcctggcactgtcttctcccttgtgctgtcttctgctgtttctcaaggagtgattcctctctgtgttttggaaccgtgtttctcactgcctacagatgatgtccatttggcttatttcactgtcatctcatacacagctgtttcaaactgcatggaatcctcagagaactacacgccccttcctgaacaaacagtgcttcttcctgcattttcttcttaaacttttatcacttttccccccttacatatacttttgttttattctttcactaaaaaaaaaatgaggtttaattgacttacaataaactacactaatctgctttcagtcactatagattagtgtgcattttatagaattttatgtatatatgttttatatagatgaaatcatacaatatgcactcctttccttccatcctttcttcctttttaggtctggtttctttcatccagcataattattttaagatgtatgtatcagtagtttattccattttattgttgagtagtattctgttgtatggatatatcacatttgtttatttgcctgtggatagatgtttgagttgtttccagtctttggctattgcaaataaagcttctttgaacattcata

SEQ ID NO: 237703 - DNA, 539 bp, Homo sapiens
ggacttgctcttctctgtagcaatatggcaggaggtgccaggcctcgccttcttaagaggcgtggttcaaagagaaaagagcacgcctgccagtgagctgggcctgagggcagcgctgaggagatgctgctcctgacttccctggaggtttctcagaagctgcatgctaacccctgggctctgggccatcaccaggtctcatgtgttgatccaccctctgtgcttctgtgtaaaatttcatggcgttaaaattcagtcttagccaggtgggtggttcacgcctataatcccagcactttgggaggctgaggtgggaggattgcttgagcccaggagtcaagaccagcctgggcaacagagtgagaccccatctctactaaaaattaaaaaaattagccgtgcatgctggcttatgcctgtggtcccagctactccagaagctgaggcgggaggatcacttgagcctgggaggttgaggctgcagtgagccaagatggtaccactaccgtctagcctgggtgacagccagaccctatatc

SEQ ID NO: 237704 - DNA, 165 bp, Homo sapiens
catttgtttgcacctattggtgtttcttgattgttggcttttccagtatctattctggggtatatgaagcaaaagaaaacccaggaaactcaccattgtgtgagtgtcattcatggggtcccatggtccctagcagatgtgacttctttccacccttcagagtct

SEQ ID NO: 237705 - DNA, 497 bp, Homo sapiens
ccaatttaggcaactggctggtaggcggtttttttaaaaatttttcccaaaatttacccttaggtttcgcttcgccaacgcttgcgactccagttggcacggcctttgggacggcgtccggatgggaatgggggctgtcccgccagggtttaaaggggggtacccgcgaggttgcccaagttgggtaatgccatggtttgcgcaatggcttgggttttcccctccgttacagtggtttgggtacgggctctctattggggtctttgtgccccgaggtcccccttggggttttttcttttttttttgttttttttttttttttttttttttcttttttttattttggcagaggaagattgagttcctggaaatgcttacaaaatgattcctgacactgggaggagatagttagaaaaaagaagaagaaaaattatacacatatatagataaaggaagaaggtggaaagaaagggtatagacaaaagaatataaagatc

SEQ ID NO: 237706 - DNA, 429 bp, Homo sapiens
tgggggatcagtgaaccgccacaccaccaatgggtgcgtgcactcctcggctggtgccagactctggtgggccagcactggcagttgtcggcccttcccctcacttgaaaataatgggagttggcttagacccaggctctaaccagaagtctcagagattctccagggatgcagcggaggccagaggagcagaggagacccccgcatcagacagacttggtgcaatttccagctctgcccattgtagctgtgggccctgcagcacatccctccacccctctgtgcctcaacctcctcatcaacaaagtcacagcatggcccagaagagtgagagagagacagttgctatgtgcggtggctggcacacaatggggctctggaaaaacgtgagttctccccaggggagcctttggcctcaccccctcctgg

SEQ ID NO: 237707 - DNA, 298 bp, Homo sapiens
gttatgttgctgtttacatagttatttaagatttgtggagatcaaaaagaagaattgtatgttttttttctttttggcagaccttattgttcaatgtaagtagacttaagcggacttcatattttcttccagatgtaaaggaaaggtgcccaaattggcaagacgttaaaaattattattaggccaggcgtggtggctcacgcctgtaattccagcactttgggaggccaaggcaggaggatcatgtgagcccaggagttcaagaccagcctgggcaacaaagcgagaccctgtctca

SEQ ID NO: 237708 - DNA, 400 bp, Homo sapiens
tggacactggctaccctcttcaaaagccatttgttagggcacacagtttccactttggagtcaagtacgcttggttttctccccactctccatgccgttgtcaattgttgccatgcctctacaaaggtggggctacagtaacaaaactctgaagtcagacctcattctgaatcctgcctcatgaaaccacatgcaaagatatctttgagcttcagtttcctcatgaagatgataacagtggccaattcaaagggttaaatgacataacgcatgtcaagcacattgtaaggattcaataaatgtcaattattataacaacactaatttttgcctgaaaatcccagaaggatctgtgagaatggagggatggcacagtgggcaacacagggctggggggcct

SEQ ID NO: 237709 - DNA, 696 bp, Homo sapiens
gccagatggacttttttggagcatttagttccaagcaccttccctgcattttctcagttaatcctcccagtgactctttgaagcagggactatgacaatcgtcatttcacagatggagcaactgaggcacagagaggaagtcaatggccacggtcgcccagctgaggaaggatggagccggctgagatcctgttctggggatctaactctgcagcctgcattctgggctgctgtattctcccttgttgctatctgacgagcacagcatgggctcagagtacagacaggaggaaccagctaataaggagaggtctagggtgaaggctggtgccttggggaagaagagagaggtctcattctaaagggatggcattggaagttcatagtgataaagcaaagccaacaggttttggggctgagagttaaacacacagctctggtttctgccttttcacagtggtgatgaaagagcactgagagcctctcgagctaaagttgtcatcattgctcttcatagtctgaaggtgcatgaaatggtcaactttcttccaaagggcttttatgcctaagtctgtggttagtgtataaacagatatttactgaagtcctgctgggtgcagacactgtggccagccctgaggctacagtcaagatgaagccagtctctgtcctcatggagacctgtctattgataag

SEQ ID NO: 237710 - DNA, 393 bp, Homo sapiens
tataagtatgaaatgtataatatctaaaatgtacagtatttctttgataccttcgtccagagtttacatacatctcattggcttccttggcctccagggctgctcttctctttattaataacagctttattgagatataattcacataccataacatttaccctttaaaagggtacaatttggggcttagcacagtggctcatgtctgtaatcccagcactttaggaggttgaggcaggaggatcacttgaggccaagagcttgagactagcctgaactatacagtaagaccctgtctttacaaaaaaaatgtttttaaattctccatgtgtagtggtgcatgcctgtagtactggctgattgcttgagcccaggactttgaagctgcaatga

SEQ ID NO: 237711 - DNA, 650 bp, Homo sapiens
gattagatgcctactcttaagaattcaaactgtacagaagattataaagtagctgcatctttagtcataaattataccctctgtatatgatacgatagattcataggctctttctgttccctcaattctgttcttgctgtggtatcagcttgtgggccctggttggggatagagatgaactagaaaggcaaactgagtggggtgcaggtgtgagtggttgactttcaccacaggtgattagaaacactgattctggagccaatctggctagatggagtcccagctcttacttaccagctgtttggacttggacaactaataggagtgcttactgtgtgtgatatgcatacatggtttccccatttgtctttatgagttagatgtttttattccctttttatacagatgacaaaactaaaattcagggaggttacgtatggaagtagaatgaatcattagacccatttctaggactacagacaagataaatactgaaagctgcttgtccaggagatagcaaaatgctgacaaatgagaaacagacctgcatagccatcacaccctctagaaccaaggggtagtgttttaagatagaggactgggtgagtatcagaaagctgtgctttgaaaacctgactgcttttaagtat

SEQ ID NO: 237712 - DNA, 315 bp, Homo sapiens
aactctactctctctagaagaagacactaactccagattctcagtcctctggtatccataatttctggcagacaatacaaaaaatctacacacaaaatgaagcagataaatataagtaactgaaggaagagttcagtcagcagacaaaaactctgagagatgatccaactgctggaattagcaaggattttaaatcagctaattcaaaagtgttcaaggactttaaaaaatgaccataataaatgagcagatgagcatatgagggaatattagcagagatagagggcctatagaaagaatcaaattgaaattcta

SEQ ID NO: 237713 - DNA, 436 bp, Homo sapiens
ggaggcggaggttgcagtgagctgagatcacgccactgcactccagcctgggtgacagagcgagactctgtctcaaaaaaaacagaagaaaaaacaaacagaaaacaacaagtgttactgaggatgtggattaaattagacccttttgccctattagcaggaatgtaacatggtacagccattgtgggaaacagtatgaagggtccttaaaaaattaaaactaaaaattaaaaaaattatatttactgaatgattcaacaattccacttttgggtgtacttccagaagaacttcaaggagaattgcaaagatatttgcacacccatattcattgcagcattatttactgcagccaagaagtagaagcaacccagatgtctgtcagtagaataaagaaaatgtggtatatacattcaatagaatattatccagcctt

SEQ ID NO: 237714 - DNA, 441 bp, Homo sapiens
cttgcatattttctggagacaaagatgttaagtggaagaaaaaggacacaaaaggtctaggtgccccagggaaagagcagaatagacaccaccaggagcacatagaaaagaggaatgatgtggtcagttcaaaaacaacgtcaatgcctcctcaatttcatctagcattggctctgcacttataaaattatattagagtcaggctcctattcacttaactgtgattgatcatttcctttcccatcaagagaataaacccagaatagggaagcaaacaaggacagaagccaatgattattgagtgcctactgtaaacacacacttttaaataataatattattggaatttcacacagacacccagcagttctatatgattatccccttcccacaaatgagaaaatactgagatacagccatgcttggtcatgcagctagaaa

SEQ ID NO: 237715 - DNA, 807 bp, Homo sapiens
atatggatatttgtctgcatttaagagagttaacagaaaggatgtttcctgtaatttattgcctacttctgccttaattgggttataattatagaatgaaaattggattaaatttctgtaagcatgacaagtactgaatgtacagcaggtattcccctagcaaacaaaatggcttaggcaccaggaatatgtacaacatgtgttcctttgtcctcaagaagtacagtccaactcaggccaggaagagaaaggtaggcagtgtagcacagtggttaagagcacagactctgagccagactacctgaatttgaattctttaacactctttaccacaaaacagttcattttagggaaacagataaaagaattagtttttagaagcatatacatcttgtaataagcaaaataaacttcaatatgggtctgaaatttattttgcttattatatttaagcaaaaactaggccatgtactatttgaggaagcagacttatttgcctttttgcatattttataccatatattaaaaccagagtccatttgtaaactagtctacaaacaacttcagagtttagaatttgtccaaaatatttttgtttgccttgacaataatgaatcattatccattaatttatttaaatctatcttttaatttatcaacttaatgtttgtcttatggaatagtacacaacatgattaaatgagatattccaccaaaagaagttttcagatcactgaagtttaccctaccagacccccaattttttttgttttgttttgttttctgtttttttaatcttgttttcac

SEQ ID NO: 237716 - DNA, 753 bp, Homo sapiens
atatggatatttgtctgcatttaagagagttaacagaaaggatgtttcctgtaatttattgcctacttctgccttaattgggttataattatagaatgaaaattggattaaatttctgtaagcatgacaagtactgaatgtacagcaggtattcccctagcaaacaaaatggcttaggcaccaggaatatgtacaacatgtgttcctttgtcctcaagaagtacagtccaactcaggccaggaagagaaaggtaggcagtgtagcacagtggttaagagcacagactctgagccagactacctgaatttgaattctttaacactctttaccacaaaacagttcattttagggaaacagataaaagaattagtttttagaagcatatacatcttgtaataagcaaaataaacttcaatatgggtctgaaatttattttgcttattatattgcatattttataccatatattaaaaccagagtccatttgtaaactagtctacaaacaacttcagagtttagaatttgtccaaaatatttttgtttgccttgacaataatgaatcattatccattaatttatttaaatctatcttttaatttatcaacttaatgtttgtcttatggaatagtacacaacatgattaaatgagatattccaccaaaagaagttttcagatcactgaagtttaccctaccagacccccaattttttttgttttgttttgttttctgtttttttaatcttgttttcac

SEQ ID NO: 237717 - DNA, 398 bp, Homo sapiens
ccggaataaaggcttatgcccagttccctgtttaaagttgctacttattcagtgggaaccttgatgagattatgttttttaaattcttggtgtctcatatttctcatctggaatgtcagtaatgtttgtactacctcagaagttccctaaatgatataaagagttttgcacagtctctagcatatgcatggagctcgaaaatgttaactgttattcttaattcagtatactccaagatggtcatcatactgtggagaagaccaaataggaggaggaaagtcaaaggtgtgagagctgcagctgggctcttgagggatgaagtatgagccccatgcagacagaggcaccaatcaggtgaaggagggagcacccaggaatttaaataaggccagagggag

SEQ ID NO: 237718 - DNA, 456 bp, Homo sapiens
tgaaaaagatgaagcacgttcaaagctggggtgaccttacttctaggagcatcagcaaatccttacacactgcatgtagccacttcttattagaattcgagtttggcagagttggatactcaaggaacagatcagcgttggagttaacttcccattactgaagaggctggggttgagctggggcttgaacccaggttaggctctgaacaacttaggctctggacaagaacactcccgcttctggtgctacacccccccaaatgctagtgggggtccataaaccagacgctgaggaccgtcaccaccaagcacagagtgaagtaggggggccctaatgccttccttttggctcacccactttctgtgtttgtgtagttattgattcctatcaagtgagaaaatccagggcaatgttctcaagcttttgaccattaaatagtgggaaattttttgttt

SEQ ID NO: 237719 - DNA, 207 bp, Homo sapiens
cagagtttcactcttgttgccccggctggagtgcaatggtgtgatctccgctcaccgcaacctccgcttcctggtttcaagtgattctcctgcctcagcttcctgagtagctgggattacaggcgtgagccactgcgcccggcccccttctttctagcagttattaggtactagttcttatcattctctgcacagaatagcatctta

SEQ ID NO: 237720 - DNA, 878 bp, Homo sapiens
tgggctttccacggaggtaggcgtccttcaccttcctgagctcctcctggacatgctgcttggcccggatctccgcctccaggccgactgcagctccagccgcgcggacatgtccagcttctggctgcggcgcaccttccacagcgggtccagtgttcttgaccccagactagaactcctcaaagcctcgagctcttcggtcatcttggaagcaagagctatgacggtaacccatgctaatttccagtcatcagttgactttttgggctttcatttacaatcatctgggctgctgcaaaaagagtttttcctgtgtaaatttatttacaatataaatgagatgtttttaaatttcctggccaattgccctaggaaagtggatttccaatacagagaattgttactgccacccatctctaaaatgctggaacctccattgctttagtttttcacccaaatttataccaattttgatttgctcacttaaacctcttggtacattagttagtaattccttttaccttattgagttactatagttatgctccagtgatctgtactttgaaaacacattgagtccctttaaccaggaagaactcttctgggcgaccgtccacatgttcctttcccttcctaatgacctgaagtctgaactctacagagcctctgtaccttctctttaaaggcagctctgctcaccaggaattggctataattctttccaactctctcatcattttaatagctatcagcaaatgtagaggtgtaggggattttgtaacatctgatgtatgtaaaaagaaatattcaagttggaaggcagactagaactgccctgagagatgtttgatgtacacattaaaaataagaaattttac

SEQ ID NO: 237721 - DNA, 1021 bp, Homo sapiens
ccggcagctcgcccctgagctcaactggctggcaggtctgatggcttccctcacaccatccgcactcccaagccgtgtgcaaagatccagcacgttatagaaggtttaaacaagggtccttgaagtaaagttttcagaaccagttgtctggcgaacaaacagatgcctgttccaacatttgtgtgaggatggcttgaaattttcattgacagctgaaaatagagccctcatgtcctatagattaatataaaggatgtgagggctctatttatcctctagcacattctagacggaaaccaagtttcccactgttagtggacagaagaagaaaagaggggagatgggcaactcccgaagtccgctctatgccagacacaagttctgatctccaaatatcatctgtacgtgtccggggtgggcgtgggggccttggtcgtggtgtcctatgattcagacacaaccgtcctgtctattctttttttttttttttgagacggagtctcactctgtcccccaggctggagtgcagtggcgccatctcggctcactgcaagctccgcctccagggttcacgccattctcctgcctcagcctccggagtagctgggactacaggcgcccgctaccacgcccggctaatttttttttttttttttttttttggatttttagtagagacggggtttcaccgtgttagccaggatggtctcgatctcctgacctcatgatccacccgcttcggcctctcaaagtgctgggattattcttaaatgattttatacacacccatttttccccttttacctgtaaactttgaaatgaagttgaaaggccaccagtgtccatgacaggtccctctgcacacatggtggcatggttaggagatacatgagcctgttcccaccccagggtttttattctgtcatgcagagccatgtgaaggatgccggtgactattgaagcctaaacagaacaaacccaggagcccggggggaaaaatggctttattctcagtatgaaa

SEQ ID NO: 237722 - DNA, 842 bp, Homo sapiens
ttacagtgctgtccggcagggcagtgtgaggccactctgtcctcctttgacctctttcttcttcagcagccaaatggaggctctctaaaggtgatgattaacttggcataaacatgccaagctttcctgagcgtttgccctgaattgggctgtctcttgctgctctgagacagggagactggctgtctggctgaccagcccttggggctgaggtctggctgtcaagttgcaggttccaggcaaccagcaattcctggttgtcacctggctctagagattagagcagcagtgttgctcactagaactttgtgcagtgatagtgttctttaatctgcactgtctagtactgtagccatgggccacctgtgactttcaagcccttgaaatgtggctaccggccaggcacagtggctcatgcctgttatccaggggtgtccaatcttttggcttccctgggccacaatggaagaagaattgtcttgggccacacataatatacagtaacactaatgatagctgatgagctttaaaaaaaaaatcacaaaaaatatctcataatgttttaggaaagtttacgaatttgtgttgggctgcatttgaagtggtcctgggccttggtctgcgggttggacaagcttgttataatcccagcattttgggaggtggaggcaggaagatcacttgggtccaggagtttgagaccagcctgggcaatatggcggatccccatctccacaaaaattgcaaaagttaccggaatggtgtcatgcgcttatagtccagctgcttgggagactgagcagggagaattgcttcagcctggtaggggcagaggttgcaat

SEQ ID NO: 237723 - DNA, 579 bp, Homo sapiens
gccaggcacagtggctcacgcctgtaatcccagcactttgggaggccgaggtaggcagatcatgaagtcaggagatcgagaccatcttggctaacacagtgaaaccccgtctctactaaaaatacaaaaaattagctgggcatggtggcgggtgcctaagtcccagctactcaggaggctgaggcaggagaatggtgtgaacccgagaggcggagcttgcagtgagccaagatcgcaccactgcactccagcctgggcgaaagagtgagactccgtctcaaaaaaaaaaaaaaaatagccagatgtggtggcatgtgcctgtagtcccagccactcaagaggctgaggtgggaggatcacttgagccctggaggttgaggctgcagcaagccatgactgcatcactgcactccagcctgggcaacagagcaagactctatctcaaataataataagtaccttgaagaagaaaacagagcaatatgacaggtagtgccataacaagtaggatggcccagaaaagattctctgagaaattaccatttgagctgagagctaaatgatgaggctgtaaaagga

SEQ ID NO: 237724 - DNA, 734 bp, Homo sapiens
acctctggcactaaaaccaccgcttcatatactttaagtggaagaccaccagattttcaggatttagaaagacctccttcaacccttcaaaatgaagaaatctgtgcatttggcaagctaaaaagagactgctctttgagtgaaaatgttgttggccaaaatagacgttgatcaggagtgatttcatcgtgacaccatcaccataagaagctgtcttcccaacatgttacccgaaaatagaactaatctttcctctgttcatggcattctgtcatttatccagtcttctactcgtagggcttaccagcatatcgtggatgagatgggtgaaaatcgcagacctgtgcagtatggcaggtctgctgctaccacttctaatccgcatcgtgacaacatcaggtatggcacttcaaacatagatacaagtgaaggaacttcggatgacatgactgttgcagatgcagcttcgttaagacgacagataatcaaactaaatagacgcttgcaacatctagaagaggagaacaaggaacgtgccaagagagaaatggtcatgtattcaattaccataggattgtggctgcttagtaactggctctggtttcgccgctagaggtaacttcagctcttaaacatactgcctcaacagctagaaatatagagaacttgcaaacttaagaacaccacggcagccactcgaaccaccccgactcatagaggcaaccccatcctcg

SEQ ID NO: 237725 - DNA, 633 bp, Homo sapiens
gtgtgtgccccctccacctagccactccaccatgtctacaaagattgaacgactgccccacagtgtgaagggactttccacatgggacttcagtcacagaccttgaagcagacctgatggaatgaatgaagaaaaaaatggcttcctttcaattgatacttattatattgttgacagatttaaaaattaattgaggctgggcatggtggctcatgactataataccagcactctgggaggtcacaatgggaggactgcttgagcccaggagttcaagaccagcctgagcaacagagtaagaccttgtctctactaaaattgtttttaaaaatcagccaggtgtgatggtgcgtgcctatagtcccagctattcaggaggctgaggtgggaggatcgcttgagcccgggagattgaggctgcagtgagccatggtcatgccaccgcactcgagcctaggcgacagagcgagactgtcttaaagaaataaaattaaaatgaactcaaaatacacttgtaattttaaaaaatgctaatcctgatatgccttcttaaaaaaaaaaaaccctgtttctttttaaaaaattaccagttaatctattttcattttcaataaaactcaaaaagaaaaacaa

SEQ ID NO: 237726 - DNA, 337 bp, Homo sapiens
ggtcttttctgtgggaactggtgaccttttgagggaagaaaaatatttcttctaacttataatctcttcaagtatcctgaatacactgaaaaggatatccctcttcttcccaaaatacctgtttactggtaacttaaatacttctaatgtgatggttctcaatctttactggggtcaccgacatctttgagaatttcatgaaagctgtgggccccatcccagaaacatgcacttatttgttctcagataaaaatttttgtgtgtatagactttgcgtatctcctgaaggctatcatcaatttgtctgatggcaaattgagaaaggagagatgccaga

SEQ ID NO: 237727 - DNA, 565 bp, Homo sapiens
tgagttttagagatttttttttaaaaaatagttttgttttacaattctatacactatttcatagttaccatatcaaattcataaaacaggcatggtcagaaaaatcaagatttaatcaactatccaccctcatttgttctcttttcttagatgacaagatactactgaaacaaccaaacaaacaaacaaatgcccagtcaagaaaaagccacattcaaaatcgtaggcaatttcatggtgtttttactcacccttgccccaccacttcactggcacaaagcaaaatggtcagaagaaagaggctcactccctggtcccctccattaaaatggaaaaagcagagtgctaattgtaaagttattgcctgtgtccaagggactggtatgtgtcttacctgtcttggagctcagagagataacagtgcatagtttgaatattagactgaaaggtgaagaagggagtggcaggtgcagcagcatgtgatactgaagaagtactacagagtcacacatgactggtagcaatagattgtgggtagaggaatataatggcatatctaaggctc

SEQ ID NO: 237728 - DNA, 465 bp, Homo sapiens
atgtgaatttatttatatggtaaaagatttgtcttgttttgtgggaatccttccattaatttcctcctgcagccccagtgtggggattaggaatatgggctctgatgctgggtagacctgggttcaagttctgattatgccatcacttgctctttgaacaaaatccttagctactttatgcctcagtttcctcattacttaatataagacaataccaacttcatagggttttaatttttccacgtgtatatgtgtaaaacataactttattcctggtaaagtactatgctgtcacccttaagtcgaatgtttgtgccttgttaaaaaaaaacactggtttaaaacacctacttgtggtcgggcgcaggggcttgtgcctgtaacctcagcactttggaaagccaatgtgggaggattgctttagtccaggagtaacatagggagtcccttgtctctccaaaaaaa

SEQ ID NO: 237729 - DNA, 462 bp, Homo sapiens
attctcttgaggccatcagaacaagatcaaaggttgtagagccttgaccacagtattaaagcaaagcctcaaaatgacttaaggaatcttaggaaataaaatgccacagtcctggacatttatcatttggcagcaagctaaacatttcctaaaacttttacaagtaatttaggtacctaatggaaattttttgtttttaaattctggagttgcctaaattgtttaggagaaatttagctggaatctggcgataggactgtttatatgtgcttggctcagggtggctgtgttgtccacattagcatgaccatgggctccttatcgaagccctggttcccagtaagtgctgtttgcaagagtgaggtggagtttggtggctttcaggccacccagagtgccatgtgtatctgtttgataaactctgtggtttgtctgttctctgtgtttttgccagattgttta

SEQ ID NO: 237730 - DNA, 2163 bp, Homo sapiens
  misc_feature (1493)..(1493): n is a, c, g, or t
  misc_feature (1595)..(1595): n is a, c, g, or t
tctttaattatgtcacagtttgttgatgaatacattgcctttgcttcagttaaatcaagtaggatgcagtgactccaagtctgaggggtgcttcccaggaagagccaccccccacagccatttgcagagcattggagtaagttttaccttcatcccttagatgtgaatttgttatcctcactgtgacaatcccttatcacatggcttttagaaggattctcaaaaagctagactctcacattcaactttgcaattgcctggctgggtgttacgtttctttgcctcctattagagaccctatcagcatctaaaactagcgttgtttgaggatgttggagccaacggttctttgccagatagaactttgtgtgtccaaataaatggttcaaaatcatcaagcaaataaataccctggaataagagaagcctcatgaggatttgactccaaattgacttcctctgttctgcagtaagaagttaggaattaaaccaaaccttgcctgaggttcaggtatactcaaaagcaatgaggtgtggctcaggtgtgcgctggcaaggtcactgtgaagttcagccagaggctttgcaagcctgggcctgagaagccagacctcttagatccagaagggccaatggagctgggctggcctgctgccactcacaggcagagactctgccagcagaagggactctgctgtcagagctggagggcagcggaccacatggctgaggcccaaccacaggtctcctgactcaaaacctcttcccagggcttgtcctcctccctaaatatatgtgccccaaattgtcaccagatctcgggaaagcactggctttgtctgggataaacaccaactccacagcacacccagtcattaccagattggcagttgttgtctaggtcttgtggcttcttggggttttctcgggtgtctctctcccaaatctttcccctttcctttgattatattcacataaacattgagctttgtagccctcaagctctctcaagcataactcactttgtccctctctgtttccctatgcagtcgcctctccctctgctgtcagaggcccatccaactgctccagccctgtggctccagcgtctcctcctctctctttcccctgctctgtttctgggaagatctatctgagggtcctgaaggaggagactcgaggttgttctcttggacaaagaggtctgggtggatgacataattcactttacgtcttagaaaaataaccttgtggctcttggctctcctgggctgtcattttggttgcctaagggctctaggcagaaggccagggagcccagccccagcctagaacttgcagggctcagagagctgcagtgacggggtgtccgctgtgcctgccgccccccttgccatggactctacttgcagaacttcacagctgagaggctggccctgagattcccctttatgcctcccaaagcttgcgattgcttaattatacgctgctgngtaccaatttccactttctctcccggtgtgttttgactgataactttgacttaacctcctgatgccagaaactatgttggctactgctctggcggcaggaanaggccggttccagggaaggctgaatgcctattgttctggatcattttgagaaaaaaaaagagataccttgaagaaagatgaagacaaaatatggaagggtgctgaatttacaaaaagcctaaggggaaaaaactcaaatgtccctcaggagtggaatgagtaaacaaatcatggcgtgttcacacaatggaatgctacctaccaataaaaaggaatgaactgcggatgcacacagaaacatgggtgaatccactaggcatcatgttgtgtaaaagaaagccaacttggccaggcgtggtggctcacgcctgtaatctcagcacgctggggaggctgaggcaggtggatcacttgaggtcaggagttcaagactagcctggccaagatgatgaaaccccatctctactaaaaatacacaaattagctgggcgtggtggtgcgtgcctgtaatcccagctgcttgggaggctgaggaagagaattgcttgaacccaggaggtggaggttgcagtgagccaagattgcaccactgcactccagcctgggtgacagagtgagactctgtctc

SEQ ID NO: 237731 - DNA, 621 bp, Homo sapiens
gaacgattattgggtagtcatattagcacccagcttcaacttagctacgctcgaagtgttgattgggccgatacaactcaccaggaacagcttgcatgttacgaattattcgctcactataggaatttcgcctcgagccaagattcggcacgaggaaccaggtgattaaaaagttgaagaaaattacaattaagaattgataaaaaaattgaatgatactcaggtcatgtgtgtggtattttctgtgaaattaagcccagctgaaaggtatgggcttaggattctggctgacacagcaagcggaaatctggccatggggctagcctgttctctctcgggtgagctgaatgttctggagatgcattcaggttccaatgataactttaaatttcttctcaatctcattggattaaggagagtgtaacaatctgtcacatttaggaactaagtattaaagaccaagtgaaagtgattattttacttttgacacaacaatttctagtgaatattctgagtaattttctgatgaatattctagatgtataagttctgtttaaaggcagaatttattttgaagtttgtaactttaataaattgaatattaatttcaaaaaagctgta

SEQ ID NO: 237732 - DNA, 362 bp, Homo sapiens
ggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaaaggcaaatagtgtctctaaattcagacaaacgtagacctattcccacttttttcacatagtagtgcgctgtttcagagttaaacaaacaaaaaaaaa

SEQ ID NO: 237733 - DNA, 2498 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctg

SEQ ID NO: 237734 - DNA, 2420 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatgggactgaagatttgaaaatacatccacgaacatttcaacatggaacgaagaattatagttccttctctggctatatccataaagaagtagttatgaaatgtttaaaaccaaaggcaaatagtgtctctaaattcagacaaacgtagacctattcccacttttttcacatagtagtgcgctgtttcagagttaaacaaacaaaaaaaaa

SEQ ID NO: 237735 - DNA, 2392 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatgggactgaagatttgaaaatacatccacgaacatttcaacatggaacgaagaattatagttccttctctgggtccatgccatgtaagacggcggcccgtgaagctcgtaatcctgagccataactgtttccctatgtgtataatacgaccgtcctgtgaatccgtgaatcatagtcatagc

SEQ ID NO: 237736 - DNA, 2438 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctg

SEQ ID NO: 237737 - DNA, 1511 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggtaaaaaggcgtaagtgtaaagaaaatgagttttattcagcagg

SEQ ID NO: 237738 - DNA, 1287 bp, Homo sapiens
ccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagaaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatgggactgaagatttgaaaatacatccacgaacatttcaacatggaacgaagaattatagttccttctctggctatatccataaagaagtagttatgaaatgtttaaaaccaaaggcaaatagtgtctctaaattcagacaaacgtagacctattcccacttttttcacatagtagtgcgctgtttcagagttaaacaaacaaaaaaaaa

SEQ ID NO: 237739 - DNA, 2036 bp, Homo sapiens
  misc_feature (776)..(776): n is a, c, g, or t
  misc_feature (1041)..(1041): n is a, c, g, or t
  misc_feature (1473)..(1473): n is a, c, g, or t
tacaaccatccattcctctgcccttcctccattcatccacccatccctctgtctattcttccattctttcctccatccacctattcacccatacaaccttccatccccccatccatccaaacatccatccatccactgaacaaatccatggcactgccccactggccttcttttatttcctctgtgaaccccttctctcctacctctgagccttcacgtacttcccctcccattcccatatacacccctagggaatacctactcagcttaagaaaagcctcacctaaatcccagtctgaagtaggtcctcctgctattcctctcctgaagaacctcattccctccttttcgacagttgtcatagacatcaccaaacgtttgcttttgggttgatttacttattcctgtctccctgaccagactggaagctccaagagggcaggcattaggtcttccttcagtgcctaccccagagcctacctggcccacagtaggggctccatagggaagtggtgaatgctggcattgagtgaacttagaaagtactgtgtgcagggcacaggcccagatgtcttgtcaggatttgcttctgaatgtgactgcctctcaaggcttagcatctatagaaagagataaagaatgtgtatgcaggattgcaatgcaggatgcgactcaggaaggaggcagggagggatggcatggggagggccagggtgaacatggactgaacctggccctcagtgttcacagctgcataagccactcgatctccatgngccttcatttcctcaccagcaaaatggagctaataaaactagagaggagaaagaaacactattaccataaaattgctttaaattgttcaaatatatcttctgagttctgtgaaaagttttttaagtagataaaattattttaagaactgaaatcaatgtgattcattgatgtaattttttatagacagagccaagtaatggaaattaataaacaactaaaaacatatatttatttaaattgagattgtcatgttattgtaaggancatgggaaatctacctagaaagaagttcttggcagggtaagtgctcaactgctctgtttttgaattctatttgaatggttttgggtaaacttcattgaggaggtgatgtttaaactaagctgtgaaaaatatgtaggcttccaatattttaacactacaaatattagatacaattttttaacacttttatatactcttctagtttctatggctatgtaacaaactaccccaaaacataatggtatactgcaatcatttatcatgttcacagattctgtggctctagaatctggacagagaatagcaagggcagcttgactctatcctgggatgactgaggcctcagttgaggctcagtctggggctgaaggctggggctgaagtcctctcagggcgcacgtgtttgttcacatgtccagcgttggtgctggntgtcatctgacctcagttcctctccatgtgggctgctcccacatctgcttcggctagattgagcttcctcacaacatggtgactggattccaagggcgagtatagagagtgagagtcaggtggcagctgtatcgtttagatgacctagtctcaaaagtcacatggcatcacttcctgcacattctactggtcaaatagtcacaaggtccctagattcaaggggaattgacctgtgccccatctgtcagtgagaggaatgtccatcatactgtaaaaagagtatgtgaatagtagcaaaatattgatgcagccatccctggagagacacagcctgacatacacatatcatctcatgaaatactcagtacaatctgtgaggaaggagcccttcttaactccattttatagaagaggaaattaaggcttgacaaagtcaaaagttttgtcctagctgggcacagtggcttacacctgtaatcccaatgctttgggagaccgaggtgagagctttaaggccggagttcatgaccagcctgggcaacatagcgagactgtgtctctac

SEQ ID NO: 237740 - DNA, 498 bp, Homo sapiens
atgctgccattgttgatatggttcctggcaagcccatgtgtgttgagagcttctcagactatccacctttgggtcgctttactgttcgtgatataagacagacagttgcggtgggtgtaatcaaagcagtggacaagaaggctgctggagctggcaaggtcaccaagtctgcccagaaagctcagaaggctaaatgaatattatccctaatacctgccaccccgcttttaatcagtggtgaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaaagttaaatgagaaaaaaaaa

SEQ ID NO: 237741 - DNA, 530 bp, Homo sapiens
tgttgtgccaactgttcctgacaggatatggttgctaagactctttacttaccattaagaatatcgtagatattcttaaatttgtggatattcttgaattcgtcaatctgaaaatgtgatttccagaactaaatcagtattctaggtagtatattacagcacaagaacagtgaaaccatcacctcccctaatttgaactttaaacctttgttaatacagcctcagactgtctgcttttcaaaaattcttggccagccgctgtggctcacgcctgtaatcccagcactttgggaggccgaggcaggtcgattgcttgaatctaggagttcaagacaagcctgggcaacatatcaaatccccatctctacacaaaatataaaaattagctgggcatggtggcatgtgcctgtattcccagctactggagaggctgaggcaggaggatcacctgagcctgggaggccaaggctgcaatgagccatgttgtgccactgcataccagtctgggccatagagtaagaccctgactc

SEQ ID NO: 237742 - DNA, 455 bp, Homo sapiens
agggttacattacaatctagcgcttcatgtggaccaggaaattggaggaaggtcctctggtcttcagttcatcatgactgcaattgggaagttcaattgtccaagctggttggtctgtttgaaatcaatgtgcaacagggaccaggctcttgctcttggaggtgagtcctcctggcacccactcagcatcctctcatgggtcctgtcacactcagactctgcatggtggagggacagtcacccctttctcccatgtttgaagacacatatcagtctcaggacagattttcaacttccagggctgatatcacaggacattctagcaactctatgtgtggggactttcaacccaggccagagagtcatgggatacaaataaaacacacaaacaagctttaatgctgcctttaagtctcagtaaggaacaaagagaagggtcccaggacaaaaaaaaa

SEQ ID NO: 237743 - DNA, 227 bp, Homo sapiens
agctcctcccatggtggttccggggttggagaggcttacgtgaccttatggtagcagggcagaggcagggctatgctgctcatggggcattctgtaaaagtaagatgtgtcttccttatgataccttccttccagttgttggaaagttgtcgtgctgcttttattagagcaagcatcttgttgccatatgctttaaaatggacataataaatgtgcaaatcttcaat

SEQ ID NO: 237744 - DNA, 761 bp, Homo sapiens
aacaaatgattgatacccacaataacctggacgaatctccacagaattatggtgagtggacgaagggtaatcccaaaggttacatgtagaattccatttaagtaacattcttgaaatgaataaattataagagtggggaatagattagtagttgccaggggttaaggagggaaggaggagcagcactgaatagaaggggtcataactataaaaaggcaacatgatgaatcccggtgttgacggaaatgttctgtaccttgcttgtataaatgtcaatctcctggtactgtggcatttgcaatatttgcaaattttatttatttattcattcattcatttttctgagacggagtcttcctctgtcgcccagactggagtgcagtggcgcgatcttggctcactgcaacctccgtctcctgggttcgcaccattctcctgcctcagcctcctgagtagctgggactagaggtgcccaccaccatacccagctaattttttatatttttagtagagacggggtttcactgtgttagccaggatggtctcgatctcctgacctcatgatccacccacttcagcttcccaaagtgctgggattacaggtgtgagccaccacgcccggccactatttgcaaatattaccattttggaaatattaccaagatgttaccattggaggaaacggagtaaggcgtacaagggacctctctttttctgagttaagattgtatgtgaattattaaaacgtaaaaattaacttt

SEQ ID NO: 237745 - DNA, 402 bp, Homo sapiens
gtttgatctgagagcctaacttttgtaaaccttaatctagttctttccttcttagactatctagcttttaattaactaaagcaattgttaaatcaccctaagcaattgctagtcaatcaaaactaaattaacatttccaaaagggatgactcttaggtgtactggatagcttgttggctgtcatggaactactgtaatttgaaagccctctctttttttgttattttggctgaaatgctctttaaaaaacttgtaagtagctttggaaactagcaaaattaggttattttaatacaagtgaaaaagcagattcagagaagcagagatggggaaaaaaaggagaaaaaaagaagttgagagcctctacataccagcattttgttttaaccctatatttggtac

SEQ ID NO: 237746 - DNA, 393 bp, Homo sapiens
ttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttc

SEQ ID NO: 237747 - DNA, 705 bp, Homo sapiens
gtccagccactcacattgcaggggctcctgggcaaaggtgatatacatccaggaggcaagtgattgttctctacaaccgcagacatacttataccttccaaggagaccatggttggcagagtattctatgaataaaaagatgatgtatgcatgtgtgtgcgtgcacacacatacttacacgtgcccctttgtgtgcatatacaatatcacacaaatacacaaaagagaaataaggcaagtataaattatatctccttccaaaaaggatctgaagaggcttctgtaaaataataccaatacaagagaaaatagaatctctaaaatgagaagagaagaatacactaaaagcagagtattatgtcacatgaactaagatttacctcatctggacgttacttttcctaaaactccaacaatataactaagactataactaagaagcagggaggaataaacaaaggcttatgaaggccgggcgcagtggctcatgcctgtaatcccagcactttgagaggccaaggtggggtgaatcacctgaggtcaggggtttgagactagcctggccaacgtggtgtaaccctgtttctactaaaaatacaaaaattagccgggtgaggtggtgggtgcctgtagtcccagctactcaggaggctgaggcaggagaattgcttgaacctgggaggcggaggttacagtgaaccgata

SEQ ID NO: 237748 - DNA, 418 bp, Homo sapiens
tagcttacatatcagatccacctggagagtgcttcccaacccaccaccactactcaagaatcagctccagttgatttggggtggccctagcattcgtctttttgaaaagctcccccatgattcaaacgtgcagccagggttgagaaccaccagcctacactggagccagataggaacagatgtgatctgggccctccaagaaaggcctccatgccctgatgtgtctgccatgtgggaccgcaactgaggtggaggctggctttattgagctacataaaggcctttaaaattcatatactggccgggcacagtggctcacacctgtgatgctagcactttggaggcccaggtgggcagattgcttgagcccaagagttcgagaccagtgtgggcaacatggtgaaaacccatctctaca

SEQ ID NO: 237749 - DNA, 473 bp, Homo sapiens
accaccacagcagcggcaaagactgggattagagctgagtctctcctcccagatcaagggattctctttaagcacctactatgtgcctggcaggcactgagattcatctgtatctgagaatacagaatagaatcagaaatgatgtttcctagactcagctgtctgcacaggcaatttggtctcttgtgaaaggaggtatgtagggataggatgggggtttctgtgaccacagtctcccctgtagcttgaacttgaagaaaaggccgcaaggtcatcttatccagtcccctgcctgcaaacctttaaaggcaagaattctctgacaaatgtccaggaaagaagatcctgcagcctcccttatggtgaatgcccctgtctccttgttctaatgtccagcctcaattcctattcctgcagtttcaattccttcctcttgcccagggctcagtggaagcagagtccatgggctgcca

SEQ ID NO: 237750 - DNA, 457 bp, Homo sapiens
gggggtgtcggtaagcagcccggctcagaccctgggaggcccagtcacctctgttctctcagaaaaacaagaagccgcagcatggacccatcatcttgcaacacgtgtgataacctcctctgaacctccaggcctggcgtgaaggatgtcacgcctgtttagccacccgtgggggtcgatacctgccacacatgcaattggctgggaaggtggccagcctgagtctgaggtctccccttgaccaggcagcaacattagcatccacagcggtgtcaacacctgcctcccagcaggtaccatgcatgataggtggcttgtcttcatggacaaactctgaagaccggggaccactcacctcctgaccttgcctgtttccaccacagcctcggggccagccatacctggctctttagttacctactgaaagggaggagtggaatcggaccttccggtggca

SEQ ID NO: 237751 - DNA, 453 bp, Homo sapiens
gaggctgaggcaggagaattgcttgaacctgggaggcagaggttgcaatgagctgagaccatgccattgcactccagcctgggggacaagagcgagacttcgtctcaaaaaaaaaaagaaaaaaaaaaaaaaaggcacacaactcgggtgctctgtcaacctactttccacttggaattaaattttaaacagcttaaatgttaggttatattgtgttctctgaaccttggtatgaaggagtctttacttttggttataggtgttcatctaaaagctttttagctttggaagtttacaaaaaatacacttagatatgttcaaccttctttctgcttaaagtttttaagagtaaaagatttgtttgtttgttttgttttgagacagggtctctctgtcgcccaggctggagtgcagtggcatgatcttggctcactgcagctcccacctcccata

SEQ ID NO: 237752 - DNA, 512 bp, Homo sapiens
  misc_feature (174)..(174): n is a, c, g, or t
  misc_feature (209)..(209): n is a, c, g, or t
cacaaaagaaacacggttctgtgaaccagcatcaacagagacaactgaatcagacccagagaaaatttaggtattggaattattgaatatagaacataaaataaatatatttaatgaaatagaaaagtaaataaagaccaagaataagaaatgagagaataaagcaagactggntggtttgtaaaataagcaattaaattattttaganataaaaaaataatgattgaaagaaactcagtggaggggaacttacagttctggtgatagctgcgtaacaggaagctgatttatgctgctgtcttaagtgaataattggacaaagtatatgaaaaaatgttttcagatattggacaaagagtagcatagaacagtgattcctgagagaaaagaaagaagtttgagcactatgattgtccacctttcagcctgaagaaagtttctgggttgaaactagggttgggagggatacacatacagagctggcaatcttgaattgaggagacagaggtag

SEQ ID NO: 237753 - DNA, 863 bp, Homo sapiens
gtttcttggtcttcagaaggacctgcagaaaaggagtagggactgttttggagcatttgtaataagtgttccaatatgaatccacttcatcttgttatcacacaagcacacgctcctgaacacgcaggtccacatttttcctaggttcctcctattccatcagtactatgccaagccttgaagtgacggagactggatttctgggaggtgcatggggacacttggctcacctctaaatccagtgcctgctactacttctagtgcctacataccaggtacacagaaatacttgttgaaccaactagttttttaatgaaataagtagcagactgtccttgtgaaaacagaatcctttgtgaacacagaggggacagaacagttcattctgaccttagggattgcaaggccctttccttcttgccgcagggccttcaaacatctatttgccccttcttgccctctgcctaaatcctattcatctttatattgcttccagagaaccttccctaactccaaacccctcctccttgtccttgcatcattctatttcatgacatcatgtcctttctcttcaaaatacatagcacaacttactattaatatctatttgtgtgtttgtttgttgggaatctactcctacaatagactatgagcaataatgtctttcttatccatggctatctcgccagtacctactatggtgcctgatgcctaggagtgcatagtaaatatttgtaagttgtttattgaataaatgcatattatttacaaaggaagtagaatttgagcaggaccttgaaaaagattttgacagagatatgcaagaagagaattcgaggaggatggaacaacctaatcagaaa

SEQ ID NO: 237754 - DNA, 394 bp, Homo sapiens
ctcaacttcaggagatgaaggttgcatttttaagggaaaaaaatgtacccaaggaacaatttgatgacaaaatctccaattttctgtaacatggattgaagtttgtgtcttcccagttttattcgaagatcctaaaattcatactgctttttccaaatcctaacatttagattgtttttcaaatctaaagttgtggatgaattcttgtgacttctgtacgtactttgactgctacggtcactcgaagcttccttttcaaaaccacaggatggcttagctaaaccatgtcctttccaaactactttactgagtccctcctgttataccccaaagagaagatgtactcctttattagcagttggaacctgaaagaataaataattcaaaatagatt

SEQ ID NO: 237755 - DNA, 247 bp, Homo sapiens
ctctcccagttttgtccgccttccctgcctcctcttctgggggagttagattgagttgtaacaagaacatgccactgtctcactggctgcagcgtgtggtccccttaccagagtgaggatgcgaagagaaggtggctgtctgcaaaccaggaagagagccctcaccaggaacccgtccagctgccaccttgaacttggacttccaagcctccagaactgtgagggataaatgtatgattttaaagtc

SEQ ID NO: 237756 - DNA, 305 bp, Homo sapiens
cttagagacctccctccttaagtcccctgtcctcctgccaatctggatggttgcctgtctaggcctgatgtacagctgtcatcctgtaccttccctccaatacccccttggatcctggtctatgtactataacaaaagcccagtatttcatgggattctgttgcctgaatcctccaggaaaaaagcaatctacattacagaaaaatgaaccacatgctgtcacagaatagatttcttctttcctgtatcatctttcttaatttgtttcctaattttgatagaccacacctcctttcagctcgtgc

SEQ ID NO: 237757 - DNA, 2451 bp, Homo sapiens
aggtttgtgatcttgatgtagcaaagcgattcttttcatcttcggcgagcccaggggatggactcatcctagtgctcatggtctgaacctgccgtgttcttggcttttcgtgggaggctgcattgcggattgagggagagtgtccaaccgtggcaatggaagggactgggtacttgctggattttttggtgccaccctttagaagcaggtattattggctctgctttgcagatgaaaaaaactgaggttgaggtgggctaagtgtatccatcaggccggacagaaaacatgacccatcaatgtggccccaaccttggtgacaccttagaatagcagtgattcatttggtctcagatcttgatgtgtgactagctgcagccacccgcaccttcacagacataaaaaccgccagacccctgacacgcccatgaagacacacccaaagatgtctttggagatccccgggcaacagggacactggcatttctttgcatctccgtgccccaatcctggacctgttctggtgcacaggaagctggttacgaagggatgcagtggagatggtttgcagaaagaacaccaagtttgccggactccgtgttatggagatattttgtacttctggggatggaggctggagcatgcccaggagaccacatagtcatgagcattcacaattacccagcaattaacatgtgctgggaaccctgcccagtgagagctgacagatcttctgtcatttatttttcccaagcctgtgaggtaagcgctaacagtaggcccattctacagatgagggaactgaggctcagtgaagtcaacggctcaagggtgcatggctgggaggacacagaaacagggctcttgcctgtgtgccaggtggggactcgcccctcctctcgtccctgtgcctgtggtcagctaagaggagcccaaggctctggagtgggacaggggatagcgtttggctgtgttgtttgctcactgctctgagaaccagcagaagggctgagctgaaaacttcactcctccttgccaagctgtgtgccttgaagaagatatgcctttggggttcgaagtggccctggagccagccctatctggcagtcctgctttgctacttgctagtaagttattcagtctcttggagtctcagatttctcatcccttaaatgagctaataacaccgaggtggtggtgagggttaaatgggatgaggtcatgtatctgcagtgcctggcacatcactggaaaaacagcaagcaccgattgagccctcagagcctgacacgtacaaactcctgcaattcttcctgcaagcctctggcgggaactgctaccaacctaattttacaggtggggcatctgggccacagagaggtggagtagtttgcccaacctcacgcagctctaagtggtagagctggcaggcagacccaggcagtttggcaccagagtccattttcaaggcaccattctcatctttctcagtggcaggtcctcagcaatagggttagaaggctgctgccattcagatagcacagacaagacagaggtgagagttggcattggattctgtaaaagcgttggccactggtgcatttttttgtacaaccccaggggtaccatccacagcgattctcggagtcatgctctagaatgtcgcactggagttgtgtagcatgtgctcttgagatccagcctatgtgtggcctgggaaatgggagtcatgaatccagtcactggcatggctgtcattcatctggctgggtgactcccagcaggtccccatgttctctgggctttatttcctcacttactcaatgggagttggcttcagtgatggccaaaagccgtttggtcactacatgctgtggatctctgccatttggacttagagacagtaccactgaaacatgcctgaccacacacctcttcaagagtccaaactttgattctaaaagggcacatgctttgctttcttcagaggctgagtcggggcctcatctccggtgcgcagagcatgaagatgttactttcttttggtggaagccattttggtttcccatacccggcgaccggaagaattctggagggagtctctaattgcaggtggaggccagagctacgtggaaatgctgccttttgggatttcctgtaatgcagttacgtgcctccaagaagaacaacggtggctgcaaagaccagaacgacttcacggcaccgtgcgtagttttcagttcctggcttttggcatgttggagagagacctgtgcttattggatggagtgagaaactaatacccatccaggcctgctgttccaaactttttcagttgggtcttttccttagccctgcgattagcacgggatgaattcatctgctttttggactcactgaccatctcagactgtttttaacatgcttggggtttgataaaactggaaagat

SEQ ID NO: 237758 - DNA, 740 bp, Homo sapiens
ctgtagatgaatttggtgaaatagtataactttaagcattataagtttcatttagagaaagtttggaagtatgtaaagtgaaaaagagtttaatgtttgtggttttttaattaggtaagcatataggtctcacttggtcttccagatctgtcaaaggaatgggggcaggctctcctagagccagaggcagccgcggtagaggaactaggaagctggtgcaccactgaacaaagatagagtgtttctcagggctgcataagacactcactgtggccaactcaggtgaaggttttccttcagaggccacagagtctccacgggaacagcctgccccgcttcagcattcctgtagagtgcttctgttgtatatcagaatctataaattgtggagcactcgggtggggatagatgtgattgccttatttgtcatgaatttgaaaaaagaaaacattttggaacacattttttacaagtagccatttgatatttgtttcttgaaaagtttatgagattttttttaaagagctcaaattttgttgaacatagagccataaataatggttgttttattgactttatatgttatgtgtttgtatccacagtgtccttctcatctcttgcctttgtaacctacctaattcctgtgttgccaacacaatcatagaaatacaaaggaattatggtaattggccataagtgacgaagtatgagttacatttaattatatattcaaaaaaaaa

SEQ ID NO: 237759 - DNA, 557 bp, Homo sapiens
tcatgctctgcatggttggttgaatgaatgaactaattatccatctgggtgaaaattgagacaatatgcatggccaagcacttggacaaatttcaggtggaactgagacttaaaaggaaaaaatggaaaatgcctactcaacatgaagacagtgaggatgaagacctttatgatgatccatttccacttaatgaatagcatcaaccatgagcttgttgaagaggcatttgggggtagcgaggagcagagagagaactttccaaccacactacctgcgtttttgaaaggctgacatggctcttggttctcaaatcagcctcaaaatagcctgaaaagcctggagtccactcacagaagagcagacctcctccggtatgcaccatgctgacagcaccaccttacacactcaggtgtgcaaaaaccggcgcgggggacatctcacaccttatgtagatcaaatgctccttccctgatcctctgtagggaacttccttttctctaatcctagatcttttcaaaaattctaaccaaaataaaatttaaaaagaagacaatgt

SEQ ID NO: 237760 - DNA, 637 bp, Homo sapiens
aaaatctatttaaaaatacacatattaaatagatcctattgtataaatacatacatgcttaatttgtacacaaaatcgatcttcctccatagaatgtaaactacaacaaagcagacttttttgttcggttgcttcctctgctgtaatatatttccaacttctagaatagtgcacggcacttactgagttcacaaagaatatttttgatatagactgtgatggttaattttatgtatcaaccaggttgtgtcacagggtgcccaggtactgggttaaaccttattctgggtttgtctgggaggatgttttggatgacattaacatttgaattgccagactgagtagagcagattgctatcactaatgtggtggccttcatccaaccaattgaaaccttgaatagaacaaaaaagctgactctcctgtaaataagaggaaattcctcctgactgactgagctggaacatccacctttttcttaccttttgattcaagctgatacatgggctctttgtgggtcgtgagtgtgtcagattttgaaccacaccattggctctcctgggtctctagcctgctgactgtagatcttgggacttctcaacctccaaaatcatttgagccaattccttataatctc

SEQ ID NO: 237761 - DNA, 515 bp, Homo sapiens
agaagtctaaggatgttttgttggttgtcacccacaaagatattcaaggacaaaggagaagattctatttgagtcttgttcagaatcacagtgcactgcaaaccagaacgtttagaaaagatctagtaggggtggagacagtcctaaggaggacacagacatgatttgggtagttgatgaaacaaacaaggaggttataataggtcacactcaaaagattaggaggctacacaacagcctccttactgtggtctttccttcacgcctgccctcttccctgcacagcagccagtgtgatcttctgtgaaaattagatcctatccttcttcagcttaaaactctcaacgctactgaccgatgacactgggctactcacagtcaggaacaaggaagaagtcctggccagaagtgctaaggtggcatgtcccaaacccataaagcctggaaggggcttgtggtgaactcagctctattttctatgggcatttctggaaggtgatgggggatgagttttc

SEQ ID NO: 237762 - DNA, 415 bp, Homo sapiens
aaaaaaaaaaatatatatatatatatagatgtatacctctatatatatatacataaacttttgttagtaacctttaaatttagaatacacagaaatttttaagaaagaaaatcatctttttaagaaagaaacatcatagtcactgtttttaagaaaaaaatacatattaaatcaaattttggaagtaacttttaaatcaagaatacacagaaatttttaagaaagaaataatctagtgccccagtactgaaagaaattttgtttgcctatttttccactcaaatacattttttacactgatcataatgaatgtgcaggatttatctttcttcttcccaaataatttgtgaactttttttcaccattaaaccatctccaaaaatatcttttctgatgactgaaagatgggaagata

SEQ ID NO: 237763 - DNA, 211 bp, Homo sapiens
acatctttggttcttgggttctagcagaggacaaaatgagataataagcatcagacacaaatttacagttggttatgactattttgaagactttggtggacttctagtcatttttttcacatgcagctaagatgaagttatatttttttcttccttctatttccctttttcctttccctttcctttcttttgacagggtcttgctgtgtca

SEQ ID NO: 237764 - DNA, 462 bp, Homo sapiens
tgatctacctgccttggcttcccaaagtgctaggattacaggtgtgagccaccgaacccatctttactcaccgataatatggtcaagtttcaaaaaatattttagccattctaataaatgaggagtggtatcccattgcagttttaatttgcatttttctgatgaatgaatgcaataatcttttcatagatttgccatcagtgtatctttttgatgaagtatgtgatcaatctgcccatttaaaaaaatggaaggctgggtgcaatgggtcatgcgtgtatcgcagcactttgggaggctgaggacggtgaatcatttggggttaggagttcgagaccagcctgaccaacatggcgaaaccccctctctacttaaaaaaaaaaaagagttagccaggtgtggtgacatgtgcctgtaataccagctactagggaggctgaggcaggataattgcttgaaccc

SEQ ID NO: 237765 - DNA, 718 bp, Homo sapiens
agcactcccgcctgggcgacagaacgagactccgtctcaaaaaaaaaaaacaaaaaacaaaaaaacaaaaaaaaacacttcaaaccttgcatctgaataaaggcagactgtacctcccttacttataacctccctacttaacactagtatagcatttttcttcccattgagtatatttctagtactatatttttacaaagttttctcttgctggggaaaataaaagctaagattagttttttattgtactttatggaattgcattacttataaacatttcctttcatcatatgtactcatactcacaaaatagcattaaaaaagcattaaaggctgggcatagtggctcatgcctgtaataccagtactttggaaggctgaggtgggcagatcacttgagcccaagcattcaagaccagctcgtcgtctgtactaaaaatacaaaaattagccaggtgtggtggtgcacacctatagtcccagctactcgggaggctgaggtgggaggattgcttgagcctgggaagttgaggctatagtgagccaagatcacgccactgcactccagcctgggtgacagtgaaagaccctgtctcaaaaaaaaccattaaagatactatgctggctgggcacagtggctcacacctgtaatcccagcactctgggaggccgaggcaggcagatcacgaggtcaggagattgagaccatcctggctag

SEQ ID NO: 237766 - DNA, 402 bp, Homo sapiens
catatttttctaaccccagtttgagacccataatatgacaagtgcaggatatttatggagacaacaagacacaaccgggactgccactttcaagagccatcattgtagattcaaatcaactaaaacacttcataatgggagaaacttggttgaacaggagcacatgttaacgaaggggttttggttgagaaacttactgaatcagtaagacaggacccttaaaaaggctactgtgactgcagactgaggggaagtaccaaaaataagctaatcctactctattatgctggttagaactcacagaaagcattttattctgttctacagagcagatacatattgaaacagagacaaataggaatgtgttcagagaaggtcaactaaatgaattgcaaactgaag

SEQ ID NO: 237767 - DNA, 396 bp, Homo sapiens
tataaaatgtcagtaatatgaacacgctcttaatataacagaatatttaattacatcagtttcccatgaacacaccaaagtcacttaataattatattggccatttccactgtcttgccagatttagttcatgttcagcctgaagaatcacctcttctaattgaccgccttgaagttggtcttctaattttttaacatctggttccgctttaaccatagccagcttctcatttgtaatctgttctgtatactttctatatgctgcatttttagggatttcctcaagaacatcaagaatctttgtgtacaatattcttagcctctcgtgaggagtattgcacacagccaatcccacaaggccagtggtcttcttcagcacacccgccctgacagcgc

SEQ ID NO: 237768 - DNA, 328 bp, Homo sapiens
tattcctgtgaggacttcttccctggttcttttccttctgaagccgtagccttctcggatttgcctgcaagggctaccctggaacagttgaggagcctcattgtcccccatccctgcgggcacgggggcaggacactccctagcccaggctcctgattagaaatgtaaaagagtttctcctgcgggagcagatgccccgccacttcctgagaggtccctccttttctcttaaagacgcagggcacacagaagacgcagccatgcgtgcagctgggcgggccattcagcgccctgcccttcctgggctctgcagtggccggggcggccg

SEQ ID NO: 237769 - DNA, 446 bp, Homo sapiens
acagtggtgtgatcatagctcactgcaaccctgagctccttggttcgagtgggcctcctggctcagccttgtgagtagctaggactgcaggtgcacaccactgcattggctaatttttaaattttttgttgggaggctgaggcatgagaatcgcttgaacccaggaggtggagattgcagtgagctgagatcacatcactgcatttcagcctgggcaacagaatgagactcagtctcaaaaaaaaaaaaaatactactggaacaattaggtgtgatataatgtagcaatttgaatagcttgttcaattttaatagaaaatgtgatgctttacatcttattgtcatttatttaaaacatgcaacattatcagaaacagattggtccttaaaaaacaaaacataattttcttttgcttaataaatataactatcacaagtacattatc

SEQ ID NO: 237770 - DNA, 454 bp, Homo sapiens
ttgagagaacagaggggatgtgggagaaagtgaaagagagggtgctgagaagttaagaaaagaaggaggctcagttcagagagaagagaaatgaaacagccccaaaagtggaggaggagggaggctctgaggtgtggtaccaggtgtggcccagttcaaagcccagtttgccaggagctcaccttgggcaaatgctttatccacctgtgaagggtggagtttggcctccatgtcagtttccctccaacttcagtcatttgtttttatctgtaaacaacccacgcgattacccatttagtcttgttttcatcagttcaccattttacctgattatgttctctttaaaagaaactttttaatgcaattaagtggtttataatatcgcttgtcatcaacaggagctaagcattaaaataaatacaaagaaataaaaatcatcctatgattaaattcc

SEQ ID NO: 237771 - DNA, 441 bp, Homo sapiens
gaaattaatagtagttttaaaaaacctatggctagttactctttggtctattacaaacatctcccttataaataagcatgcataattgaggaataactgaatggttccatatagcaatttaacatggattaaaagaaataacacttttgaatatagaagacaatgtctgaagccttggtatagatccaaatactctcagtggtatctaagaacaaaatttttattactagaaattctcttcacaaatacctagtggggtagtaaatttgcaaaagtagtcctcttataagataatgtagattataagatgctttagtaaactctggaatgtcattccaatgacccaagaccacacatctctatccactaaacgtatctgttaacctagctcaactactgattatgctgaaataaagttgtttttgttacatcaccatcagt

SEQ ID NO: 237772 - DNA, 451 bp, Homo sapiens
tgggtactgctgggacttgaacctgacagttcagttcagcctcagggcccatgtgtctaaccagcattgccaaacagtctcccaagcagagatttggaagcctattttatttatttatttttatggtttttttttaattgagatgaaattcacataatgtaaaattaaccattttgaagtgaacaattcagtggtgtttaatattaatacattcacaacgttgtacaatgaacacctccgtccagttccaaaatgttttcgtcaacccaaaaggaaaccccatacccataaagcaattgctccctgtttccccctatcccctcccagctcctggcaacaaccaatgtgcattctgtccctatggcatttacctattctggaatttcatttagaaacggaatcgtgtattttattcattttttgtataaacttcacagataagcaagcacgc

SEQ ID NO: 237773 - DNA, 539 bp, Homo sapiens
gtcacattgggtcctcagttttcttatcagtaaaataaaaaattaaataaatatcatttatttgtgaggcctgttagtcaaagaaaatcttacaggaagccctttgtatacaattgataagaatgattcttatttgaataaaatggggaaaacagtggagtcctgaaaattcttatctcctccctttccttgctaatcctctagatacttggataatactggacaggaggacttcccaggcccctttctgttttcagtcaagtatttcaactacagtactctcttctttgaagtaaaattaactttagaagttgtgtaatacatcttttgcctcttctgtggaatgactttatattttgcttttcccctattttaagacttcttaaaatatatccttatgtcttagccaggcatgggggcacacatctgtcgtcccagctactcaagagactaggagttcaaggctgcagtgagctatgatcacatcactgtactttggcctgggtaacagagtgagaccctacctctaaaaaaaaaaa

SEQ ID NO: 237774 - DNA, 2153 bp, Homo sapiens
  misc_feature (1510)..(1510): n is a, c, g, or t
  misc_feature (1757)..(1757): n is a, c, g, or t
  misc_feature (1939)..(1939): n is a, c, g, or t
tttaggagaaattcataggtgaaggaggagaaagcaggagatggaaaggtgttaagagcagagggaaaagcgtgtgtgcagagaggcgcagaggaagcagtggcacatgtttgggcagctgctcagtggctggagagcagggactgtggagagtcatccaattcccatgtaaggaagggaaacaggaagagacttgttaattcagcccagcagtctccccacaacctctggggatggcctcatgggtgtgcagggcctccagagctaaaactgtttgagagaaggcttctgtgctgtccataccaggcccctccccagaattcagccttgctccaggcgggctccactggctgcctacagacaggccaacccttggcttccccatggccctcgccaccaagatcacacagccctgctaattagttattgatctggtattttgttgtggctgcgcttcccactcctgtgtttagtcgattcccaagttaatgaagctggattctgtaccgccccccttcccccccatcacctctctgtgttcccactgctgctactccaacggaatggctccagacaaagaccactgaaaacgagccgcactcctgctaacaggaagacagcggagaagcaggtgggaggaatattccccctggatcagctgcagaggacgcctgttgcctttgttgggtcaggtctcctgcggcccagcattttccatggtggcctgaaagccaactgtggcatgagggcgatgtggatcaaagagcttcttccaccgtcacaaccctgtgtctctgggtgggcctgtagggtagcagatggtagtctgggaaaaaccacttcttcctttctgggtaatttttattcagtcatttaactcctctcagcttccatttccttaaaataggcattctgttgtatctttccagggtattgggaggatccagttggatgctctgtgaaacttctttgaaaacagtaaaatagtataagaaggaatcatgggtttgctattactcttagggagggactgggatccaggacaatctggaatggggtttcagatgtggaaaaaattaccattctgctcccctgcccatgtttgtattaaatgaaactgttcatgagagcatcagaataaggggttgatatccagaatatataaagaactcctacaactcaacaatgcaaaaacaacccaatttacaaatgggcaaggaagttgaatggacatttcaccaaagaagatatacaaatggccaatgtgcacatgaaaacatactcaatatccactgatcattagggaaatgcaaatccaaactgcagtaagatactacctcctacctattagaatggcatgatttaaacacacagagaaaataacaggcgttggccaggatgtggagaaatgagaacctttgtgcattgctggtgggaatataaaatggtacggcccctgtgaaaaactgtggcagttcatcagaatttaaacagggagttcccgtatganccaacagctccactcctgggtttctgtgcaaaagaactgaaagcagagaccctaagagatatgtgtacacccatgttcatagcagcattattcacgatagccagaaggtaaaaacaacacaaataggcattgacagatgactagacaaacaaaatgtggtatctgcatacaacagaatattattcagccttcaaaagaaaggaaattctgacacatgctgcatcattaatgaaccttgaaggatatnatgctaagtgaaataagccagttgcaaaaggacaaatgctgtatgattccacttagatgaggtgcctagagtagtcagattcatagagacagaaagtagaatgtgggttgccagggcctggtgggaggagggaagggggatagggtagtcgaattcacagagttggaaagtagaatgtgggntgccagggcctggagggaagagggaagggggagttgctgtttaatggctgcagagttttggccggggatgatggggtcattctgaagatggatggtggtgatggttgtacacagtgtcagtgtacttaatgctactcaactgtacacttaaaatggctaaaataatatgtatattttgccacagtttaaaaaataaaaatatttttaaatggtt

SEQ ID NO: 237775 - DNA, 648 bp, Homo sapiens
aaaaacattttctcctacctacattctaacaccccttactcatataatattaccagatatgttgttagtaaaaatcagtagtgctggccagcgttttaaaacaaacatcactaactacaaagatactctacttgaaatcaggtcacaaaaaaccaacgctgcttttcaattaaaactcaaaaagggccaggagctgtagctcactcctgcaatcccaacacgttgggaagccaaggcagaaggatcccttggggccaggagtttgaggccagcctgtgcaacatagcgaggccttgtctctactaaaattaaaataaatgtagctgggtgtggtagtatatgcctatagtctcaggtactcggaagcctgaagtgggaggatcacttgagtcgaggactttgaggctgcagtgagccatgactgcaccactgcacttgagcctaagtgacaaagcaagaccctgtctcaattaaaaaaaaaaaaaaaaaaaaagcctaagaaatagatgactattttctttatacttttctgtattttaaaatattttgtaacaattataagtcaagaaaaaattttaagtgtagccctaaactccagctccgttttgcaaaataaggcataaattaaaaattgtgtgcaaaatcgta

SEQ ID NO: 237776 - DNA, 353 bp, Homo sapiens
ggccttcacatgcactctttaaagcaacaccaggttgacgtctacttgggtttcacaaactatgacccaccgcccaggccaaatctgacgcactgcctgttttggggcagtcggtgagctcatggttaagcaaaatcaaaagaaggataataatgttcacgacacacgaaaatgatgtgaagttcaaaattcagtgtccataaataaagttttattggcacaaagccctgcccactcctttacctgtttttcgtgaatcttccgtcatcccacaacagcagagccctcctacctcagcctcccaagtagctgggattacgggcatccgccaccacacctggctaatttttttt

SEQ ID NO: 237777 - DNA, 784 bp, Homo sapiens
gcgggtcatattggattagggcccactctggtgacctcatcttgactacatctgaaaagaccctattttcaagtaaggtcacattcacaggactgagggttaggacttcagtataacttcctttttctttttttgtgggggacacaatttagaactatgcacatcattagaggccgtcttcgaggctgactcccatacaccattagtctggaagacaatgagaggagacgatgttaaagagcctagtgaatgaggtgactgacggaagctggtccatggtaggctgtctggcaggggctagagccgccatggaaaggcttacttgctgccagaaatgctacatgagcagaaagaaaatgggagaaaaacctggtttcctccccaccttgccctacgccaaagtagacagtccaatttctcttgctggaagtcagttgacaagggagcctgtaagagtcagccctcctacaagactgagcagagtgggagaaaagcaagcaatggatttgagggcaagcagtcccccaggactggtgtatattaatatgtattgcataagatctgcagcgaggggtcccagggtgctgcagtgagctcacagagatgccacaggagattttccattttttgaggttaatgcagtgatacttaatatgagttggatacagccgggcacagtggctcacacccataatcccagcactttgggaggctgaggtgggcagatcacgagctcaggagatggagaccatcctggctaacacggtgaaaccccgtctctact

SEQ ID NO: 237778 - DNA, 296 bp, Homo sapiens
atgttgctcttagtttgctcttgttaaatttgggttccttctagagggttgtctttgaggctttgagtttgctttttatgttgccattctgaaagtcacctcctagaaaacataaatttaaaaatcattactgtagaaaatctgtgtatgtgtttgtatgagtgtttctggtagataggaacacatctaattgccctggatgtctcttcttagccatctctttcccttgctctctccagtaaactttcagttggtctgtggtttagcttgttgctgtcatagaactgccaccctct

SEQ ID NO: 237779 - DNA, 499 bp, Homo sapiens
gctgtccctgaagaggtgtaatgttatggctgggcctatgacttaccactgatctgacgcaggggttacagacagtcagcaggtctatgactattaatggattgtatctttccatagagagctgaaaagccaaggataaaatgctcaccttataatttacttttggaaaactcaacatcttaccttttcacctttttggattgcaacataaacatcacagaatttctgatattaaatttattttggaatgtatgtgtattattttttacttggcaaggggtataaattcagaaaatgttcaatttagttttttaaaaactggtttaacagtttgtctgaagcagattagtggcccatgatcttcattaatcttttgagcaataaatgtttaaattgttcaatctgtgtcaaaaccaatctggcccattgctttatttcctttttttaaacaaagtttaagggccaggagcagtggcttcatgccctgtatcccaaagct

SEQ ID NO: 237780 - DNA, 518 bp, Homo sapiens
ggctgatctgcaactcctgctctcaagggatccccctacctcgacctcctaaagtgttggaattacaggtgtgagtcactgcgcccagcctaatgtctatattccttaactgccttctaatagagatgtaattagaaggttagaagcttcctcagatggttttgctgaaaacaaactcttatctctgtgtgagaacggctctgatcctagtgttagtgtttccttcataccatgagaaatggatacatacaactcaaatagcaaaattatgttatcagggccagtatatgatcaaaagacaaatgatggttctgataccacatcatgagttatcatgcttggattacagtaactaacattatggctattatgactcatactgtgattgggaatggaggtggttcatgttaaagtctactcttagctacatatccctcaaggaaaggaaaaataagctgttttaagtccatcttcacaatatccaagatgacacattggatataaattactgggtagag

SEQ ID NO: 237781 - DNA, 518 bp, Homo sapiens
tctgcctctctcctgcctccttccagcacaaccttcctaccctgcagagttctgaggagtcctggggcttctggagaaggaaatcagtgggacagggaagggcaagagctggggcttctttcctggcctcatgctctggtggcctccaagccacctgcccacagcccgctgtcttggaaagcacgcgtgtgggtgccagtgctcctgtttacaagctgtgtgactttgcctgagttacttaggtctctgatcctcaatgttgtcatctgtactttgcgggtattaatagtagctacctcctagtggtttgggcaattaaatgagctagtaagtgtgaagtgcctagcattgccccttgctaatccccttcccactgcactgtctgcagtttctgagaaggtatcatggcatattctagtcccaatatatttgcactcaacaagcacttattgaacaccaactgtatgcagagcgttactgaacactgagggggagcagatgagtgagtggtgtggagg

SEQ ID NO: 237782 - DNA, 412 bp, Homo sapiens
ctcaccgttctggagggtggaagtccaagattaaggtgccggaaagtgcagtttctggtgagggcttcctgcccattcgcagaaggcagcccctcgctgtgtcctcacctggcagggagcgctctctgggtgcctctttttctcctaataaggacatcagcctgttaaattagggccactccctttgacctcacttaatctcgattgtctcctaagagtcccatctcctgaaacagtgaccatgggatctggggcttcaacgcaggaattttgggagggcagaattcatcccagaacaaaagtcagtgctgtttagagggtgacagtagatgcagggctgccgtcatcaacaacgtcctgcccaaaagtcactggacgtccaaagacacagaaaagtatgacctatgttaaa

SEQ ID NO: 237783 - DNA, 101 bp, Homo sapiens
taatatagctacttctactttctttagtcttagaattttatacctttctccacccatttagttttaatctcactatatttttatatttaaagtgggttctt

SEQ ID NO: 237784 - DNA, 1792 bp, Homo sapiens
atttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtaccttttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatgg

SEQ ID NO: 237785 - DNA, 247 bp, Homo sapiens
gtaaaaaaacaaaaacaaacaagaaattgtcttacacgtttctaaactttgtataaatgacatatgttgatacatatagcttcaattccattcattttcactctatgaagttgccacaatttacccattctcctgatagtgccattttccattcttataaacaaggctgcagtagtgatagctaacattaatgtgtgccaggcactgctataagggctttccatttattaaaccagtttaatcaata

SEQ ID NO: 237786 - DNA, 433 bp, Homo sapiens
tttttcgtctttttactgttcagcgtggctttccgtgtactgccaaaatcaaatcgctctcaggaggcctactggtgtgaacaaaggcgctaaaatcaaagaacttccaagttttaatctgtcagagattggctgtgaagtatgggggaagagtcatttaatctctctccatcagttcccacttctgtacaatgagggtaaaactatggcggcacctctcatgggtactgtgtggactgcctaattaaagctaattaagcccctggaaagaaccagaaaatactacgtaaatgctgagtatttatgtgccgctaacagacacaaaaactcccaagggacaagattctgtgccgacagcacattctctattggtgattactaatcacccactgcttacaaagaaaggcactgttttcagtaacagggtagttta

SEQ ID NO: 237787 - DNA, 375 bp, Homo sapiens
gtaatgttcagtgtgctgcctctgtcactcagggcggtgcctgccatctcagaggtgcccaataactatctgggtggatggataggttaggcatgagaaacatttcagtttgtagtaaacatctgtgcctgttatttgcaggaaattgtttataaatgttaatgtttgtattctggctcactaagttaactgttgtttctttcattggcaaacatttagtatggacctaatcaccctctaaaatttcagggtggtagtaattggtgcttcaaatattcttcattactttgtagctaacattttttaatgcctggaagccatatgaaaaatcaaaattttcttaactcaagcaaataaagaatatattcaaagttt

SEQ ID NO: 237788 - DNA, 442 bp, Homo sapiens
atgcaagcctggggctaggtatcacagaaaaatatgctggagcggttgagaggatagacattttcaaaccggtatgaaacgttcatcagtgtatttcatttcatccacaattctgaaaaagtttaaatactgaacgtttgtggttttctgccccagaaaggagcttacaatatgcatggatgtaagtgaagtcgaagtggaagccagtaagcctgatgaaagcaactggtcagagtagccactctgaaacctgcttcagtcctttgatacctttgtcctacacattctcaagttggcctatttttgttgccttttctatgtttgcaaagtgagttctgaactttagagggtgaaaaatgggataaggaaaccccagcttatggaaattacacattaccagagggaatatgctttctaatggaaaaataaaactatacatacc

SEQ ID NO: 237789 - DNA, 626 bp, Homo sapiens
gtgtatatgatagttttttcaaaatgttttctataaaatcctccctgaggagagcttggaaaaagattcttaatagctagatcattttgagtccttctctaccatgtactcaacactctaatatattctgcacatttggttctatgtcatttgccatagtcttaaggacgtaggttccataatcatcccttattctgtagaggaggcccaaggttagtgagcagaggaaggttccactgtcgggaaccggtggtcttcaaactcctgtgctcctcttttgatatctttctgctcatatatgttggaaacagcccagcatgagcaaagcaccacctcctagcccccagcctgtgccagccctgcaaagaggaaatatggctccactcagggagcccatcagcgactcagggagccctggagcacctggcactcagcacccatgaacacgagggcaggcatggtgggacaaggcagtctgcttggggcaagtgagcttcgggaagtagctgagctttggggagcagctgtctatacccagcttctcagggctgtgcaagtagcctgagggagaaagaccctatattagctgaaactgcagcccagatgagtcagtattttctgctacg

SEQ ID NO: 237790 - DNA, 288 bp, Homo sapiens
tcatttttgtttcgctttattgtgcttttttagatactgcgtgttttatataaattgaaagttcgttgtaaccttgtgtcgtgctagcggattggtgcctttttccaatagcatgtgctcacttcctgtctctgtgtcacattttggtaattcctgcaatatttcaagctttttaaatattattttatctgttatggtgatctgtgatcagtgatcttggatgttatgattgtaattcttttgggtatcataaactggatccatataagatgataaacctaattgata

SEQ ID NO: 237791 - DNA, 493 bp, Homo sapiens
tgattacttctattttctcagtgaagaaaggaacaaggtgttcagctaataacgtggtttgggaagggagtttgaaaagagaagataaagaaatactcatctaggagagtaggagtgtggatggactagaaaaaagaaaaagaaattcttggtccccaacatggaaatccaagatgcaaggaaatcataggctctgaatcacctggggaagaaaccgctgcagaccaaattgcatcttagatccattaaatcagaaacttggattgctggattcaggtacaagtatttttaaagctccctaagtgattataatgtatagccaaagttgagaactactgctttggagccactggtctaatggaacaaattgcattgatttacttcccttaatattactatgtataactaactaaataagatgtattattttatgtttcttcttaatattggcataaaccaataaattagtgtatgtatgtttcattgttagaaa

SEQ ID NO: 237792 - DNA, 191 bp, Homo sapiens
ctacatggttaagactattctcataataatgctaatgtgttatttgctattttcatcccgttggtgtttgcaccgatggtggaaatgcggtgatgcataaaattgctgacaccttaccatgaattaaggcagtggcgccagactccgctcctaggtagacattgcattcttcactgccaggagctcataaa

SEQ ID NO: 237793 - DNA, 399 bp, Homo sapiens
tgtgttttctgaaatatgtcagacctcttctttaaccagtaagtttgaaactaattaatactttaatacatttagcttttaaaaatgtctttattgaggtataatacacagtaaagtgcactaatcttaagtgcacggctgaatgaatgtttccatgtgaaatggaaacatttcacacgtgtgaaatccccagccacgtcaaaatatagaacatttccagcaacccagaggctccctaaggcccgtttccaatcggtgctacccaaaagaaactggccgggcgccgtggctcacgtctgtaatcccagcactttgggaggctgaggcgggcggatcacaaggtcaggagttcaagaccagcctggacaacgtggtgaaaccccgtctctactaaaatac

SEQ ID NO: 237794 - DNA, 2320 bp, Homo sapiens
  misc_feature (568)..(568): n is a, c, g, or t
  misc_feature (650)..(650): n is a, c, g, or t
  misc_feature (993)..(993): n is a, c, g, or t
  misc_feature (1576)..(1576): n is a, c, g, or t
  misc_feature (1610)..(1610): n is a, c, g, or t
  misc_feature (1766)..(1766): n is a, c, g, or t
  misc_feature (1802)..(1802): n is a, c, g, or t
  misc_feature (2252)..(2252): n is a, c, g, or t
  misc_feature (2297)..(2297): n is a, c, g, or t
  misc_feature (2311)..(2311): n is a, c, g, or t
  misc_feature (2313)..(2314): n is a, c, g, or t
  misc_feature (2317)..(2317): n is a, c, g, or t
  misc_feature (2319)..(2320): n is a, c, g, or t
tagcaacatcaatgactaaggttttggtcaatctctcaaaattgagtaaatgtccaaaaggggggaattgttaaggcaaactaaatatgtcctgagaaagcctccatccttctatatttgcatccttgtggatgaactgtaacctagcttaatagtcagacaaaactgaaaacctaacttaatagtatgtacctgtaacaatgactgagtgttggccaatcccagtagccatacttcaaccactcatagactgctgaatgttcaaactgtgttcagaaatgttgagctgtaaccattcttactgtttctgtacctcacttcagattcctgtatatcactttatcatttttgcctataaaattgttctttccacaagatacccctggagtctctatgaatctgctgtgattctgggggctgcccaattcatgaatcattcattgctcaattaaactcctttaaatttaatttggctgaagtttttcttttatccaggtctcacctctttataggagtggtataaaaaatttgtagtcattttttaaaagcaccatagcacccaattcanaggtttttttttttttagagttttttttttcttttcctaattatcttacaaaaaagaagatatctggcactttataggaggnaaccagaggcaagtcctgtgttttactataaagtcaggtgcaggaatactaaccaattcctttatatttcccaatattacccagttcattcgttggtacacagtaggttccagaaaaatgttaaggggaaaaattgattgctatgagaatttcacatgaattatgtttcttccaaggctccttgcagtcaatcaggatggatgttgcattagtgttttctctgatgtaacagtcattaactacagctctattagctgttcatttgtggcatgaaatagatccaaatacagaggactgtatttgaactgagccattgtttcatgaatattagaacacaaatcantgcatattgactgggcttgtgtagatgaatgtgatagcattgccctcaacaaaatatggttcatttcttcagaacagtgtgtaaagcttagaataaaaataagaagcacttaagtttttcaagatattgaactctaggcactgagttaataagttcatttttatagatgcttgatgctgtatgaacagatactatactttctaaagcagctacttctgtgtggatggtggtgggtaagaggccagagaaggatggtaactataggtaacactcttatggcactttaacgagcatctatcctctctattggcactcaaaagaaacttgtgaggcaggcactatcatcccaaatttataaacaagcaaattgataccacaggttctatgcagtatgccaaaagtcactgtcttgcagtggtggaattggagatttaaattcctcagatatgattgcctctggagagtcacatctgatcctcctcagacaaataagtactctttctctgtgttctcgtgatatcttgaaatatatctatatccaccactttgtgttgtaattatcttcttatgtgtttatttctcnccacttgagttcaagaaaaaagaaaggtccttgnctcatatatgagcatccctaaggatttaacccaaagtgaccagtgaatgcttgcagaatgaaagaataaattattgaagatcctttaactctaaaaatctctaccaatccatgatgcattttaagaaaaaagtgttctgttagaatagggtgaagnaaagctgatatttgtgagtaggatgcaagggaaccntagacatagagacctgcaaatcatctgtggccttgttttatcttattctctggaatatactgggaatagtaaggaggcatgtgtgcctgagcagaatgattaaggggaaaatattaggaattgaggtcaaagagttaatgaggtgggggtaagatcatatatagccttgtaggacagttaagaaatcccgagtgacctgatcagagcagacaaagtgatccttttaaaacctacaaggaaaatagatgggggctgagcaagagtggaagtagagagacctatcttgattgatttactgaagtgatcaagatgagaagcatggttccttggacgaaagtgagaagtggttggattttggatgtattttgaaagtagagccaagaggaccaattagatatggggtgagagcgagagagaggagtgaaagttgaaaccagtatttttggcttntgacttaaaaggaaggattacattagttgagatgggaaaatgtanatagatgaagcaantnnganann

SEQ ID NO: 237795 - DNA, 489 bp, Homo sapiens
tgtgctttacagacaggaactggtagacgtaacctctgaatagtgaagaatattgtgactgtttccaagtgtaattcacatgtttctttataaagatgaaagaccagtattaatgtagcttttttttaagatagggtaaagtgttgccaatactatgatgatctgtgtttaaagtctgatttttattttaaatcctgaaatatgttaatttttaaatgtattttaacatagcactgtattagaaacaaacttttaaaactcataatccctcctgtactccagcctgggcgacaaagtgagactccatctcagaaaaaaaagtgctttcccttctctcttatttatttattcataccagtatgcactcatggattcttattttagtcaatgagttataatctgtcactgtcattatttaatatgttgcttttaaaatagtatatgaaataataaaaatgtacccgtaaatggttattagattgcttacct

SEQ ID NO: 237796 - DNA, 2423 bp, Homo sapiens
  misc_feature (2219)..(2219): n is a, c, g, or t
  misc_feature (2292)..(2293): n is a, c, g, or t
  misc_feature (2318)..(2318): n is a, c, g, or t
  misc_feature (2340)..(2340): n is a, c, g, or t
  misc_feature (2344)..(2344): n is a, c, g, or t
aaaagtgatatgacagacccaagggcagaataagtggctggcagagctaggattagtggctgtatctttgtggctgcacagctgtgttctttcaaggattgctatgcagcagtcaggccagaggggcagatgaccccggacccaggacccaggctctgagtgggaagccagcaccccacaaccctcctgacccccctaccagtctgttctccagggctgcctgttcccttactcttacaggtttggcgttccataagaatgacacccaagccggagatccagggagtagaggcagccagactgccttagagcggggggtccctaagtcatccaggccactgctcaagaaacccacacctctaggtacacctaccccttcctccccaccctcagtaggcttgcagccacgtgactttgggttatggtcacatgtctgccacctgcctgctgagggacctcggtgagtcccttaactctcctgagcctcatctgaaaaataggagtaatagaacctgctctggcctccttgctgtctttgctgggttgaactttcactggataaaccacatgctggactctggctgggtgccaagatgttgatgatggacaagccatggccccttcccgagttaacctgcagcatgcttaggttatgggggtagagaggagggaggaaagaacatgaggctgtgtggacaggggtgacatttgaattcagtcctgataaaagatcaggagtttgccaaagtgacaaggcaggaaaggctttcttggtagagggagccaccatacaaatgctggggatataaaatagactgttttcagggtctgtggttgttcagtttagctcaaaaatagggcccaatgataagaatggctattgtttgtaggccagttacatgtcaggtgtatatatttataggcattatttcatttgcttcttgccgccaccattgaggtatgttactttgatccgcatttcacagatgaggaaactgaagccccagtaaatgaactaaccttctaggggtcacgcaggtggtagaagccagaatttgaacccacaaggtcaggttgcaaaacctacattcctagttattgtgctgggcagttgaagatgatggccttgatttctatgctaaggagctgggacttgattctacaggcagtggaagccacagaggggtttggggcctggtacatagaaggttctcagcaaatgttgactgagtgagttgagtgcagcagttgcacttgattttaggaatgatgagggtttggagtggggaaggctgtggggcagggagctggtgggtaggctgttctgatcatctgcaggaattatgtcaagagtctagaatgctgggtgaagtggagctcagtctacaaaagcatccctaccacagcccagcccctgggccctgaccaacccatcccttctccccaggctgctgagagatgacagtgtgtgtatggatgtgtgcatggaggggcctgtagaacatttggcccctggggagagattaggggcattaaaggggctcagggggcaggatgtcctgggagtggcaatggggagctgttccaggggcagggagattatgtaatgggtagagcacagctgtgcctacccagctgtagccaagcagggctacagctgccccatggacccagctcctggctccaaagtccagatccagacctgttctagagcaggccttcctagctgttgggaacctcctgtctgcctcaccacactctccctgttctaggaggggtggggcaatttctttcagcttccaaacgcccagatagggtaggttacttgcctcacatcacacaggaaacagatgggctgggtttgacacaccccagcatatttaataaccacctgagagtgaagtctgggggctggaaaaggcaagactgaccagaggggggctctgggctctgggctgtttctcagctgacctgtttggagcacctcctggatttgggaccagattttgaatccccactcaccagttgtgtgaccataggcatcatcactaggtcccctcagagcctcagtttccttctctgccacatggggccagggctacctcccagggctgtcatgaggattaaatggtgccacaggggccaggcgcagtggctcacacctgtaatcccagcactttgggaggccgaggcgggcggatcacctgaggtcaggagtntgagaccagcctggccaacgtggtgaaaccccgtgtctactaaaaaaaatacaaaaattagccgggcatgggnngtacgcctgtaatcccagctacttnggaggctgaggcaggagaatcncttnaacctgggaggcggaggttgcagtgagctgcgattgcactactgcactccagcctcagcaacagagcaaaactctgtct

SEQ ID NO: 237797 - DNA, 392 bp, Homo sapiens
ccaccctgggaagtgaaactgtggcagtgccaaggagctaagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttaccatggaattccttggaatcaaaaatcatgtcctcttctcccgtgcctagaagaatgcccgagaggtgttcactatgtatttatagggtgaaattttcctatatatgtcttatatcccttaagaaatttttttccagacaataaatgctcccttttcaaagc

SEQ ID NO: 237798 - DNA, 281 bp, Homo sapiens
cttacttgaaaaagaattcactaggttggttattaagctaaggcatcagagaaaggtgaagcccaatgtaaggatataaaaaaaaaagatacaagaagtaaagggagaaatattcaatgaactagatagcataaataaaaaacaatcaaaactttaggaaataatggacatacttatagaaatataaaatgctctggaaagtcttagcaatagaattgaacaagtagaagaaggaaattcagagcctgaagacaaggtcttctaattaaccgaatccaata

SEQ ID NO: 237799 - DNA, 601 bp, Homo sapiens
tttataattataaaaaaccctctatttctttacttatataccattcaaacagcttgcattgcaccaaatgtttctactgagaggaacattaaagacagtgtcataaggtcttccatcagcctttcctaggtcattggtagtatcactaactagacatcactgttcatctgacatggacatacagacttttctacagtccttaagcaggttgctattagaatctgtgagtgatttctgggtctctgtccactgtccattaaatcaaacttctttggaatttagaattatttagaatcttaaattttgttttgtgtttatttgttgtctcttgattatcatgatagttaattatagctgtatttgctttttctttatagtaaccatatctgtacaaaagttaattcaactcctgcctttatagggatagggttgccatccaatttattgttcaattcaagagacttgagagtgaaaggaagcaccattaataattatgttggtacaacaggcataaactgggatatacggttatcctatctattagcctttgttgaaaatttacatggttcttcctgccaaggagcttactactagaataagc

SEQ ID NO: 237800 - DNA, 753 bp, Homo sapiens
aatactgagctgggaagtaagatccttggggtttagctttagatttgccattaactgcatgacctttgatactttgtctgtaactaatagaatttatctgcatgtaactgaaagtacttatttttcatttaggaagcacttttgacctttttgacaatcttattatatatagaaatacaacacatagtcaggatcctgaaagtaagtggaagaggcccctgaggttccagacagacggatctcacaaagtccatgcactaacacttatgcaccctaccaataatcaccacccacaggctttcactgaaactgccttattcctagactgaactattatacatgaacatgattatctgtattgtaaagggcagcaagccatttgagaggacaaggtgaagaaagatctttctgggagctacactggtggcaataaaaattacattacctagtaaaaactaaaggtgcaaaaacccgtctagctacaattcaaaagagtagcagtttgaggacattttgggagggtaccatcagctcctatgcacctcacttgcctttgagggccttattatagaaagttggagtagtttacagtttaaaaattactatcccatagagcattaggacaaatacctaatgcatgcagggcttaaaacctagatgatgggttgataggtgcagcaaaccaccatggcacatgtatacctatgtaacaaacctacatgttctacacatgtatcccagaacttaaaatta

SEQ ID NO: 237801 - DNA, 171 bp, Homo sapiens
tgatggcagcacgagagcagaatatgagctgtggctgctacaggagtcatggcaggaccagcatttggaaagtttcttccactctttggaagaaagtattggttgaaaggcaaatattggttgaaaggagtgcagcagaaactgtaaccaaaggagacattaggcttccag

SEQ ID NO: 237802 - DNA, 139 bp, Homo sapiens
cccaacttttttttttttttggccttattgcattggctatggcatcctgtccttcaccatgaagcataatgttagctttagggttttctatagatgttcattatcaagttgaggatattcccttctattcctgtctctc

SEQ ID NO: 237803 - DNA, 515 bp, Homo sapiens
caggcagagtgagcttccaaatatatgatttatactccagacacaccagtggtttctcatatcacagttaaactctgaattccttgttgtgaggtagaccctctatgatttgtcccgtgtggtcagatctcattgctgcccggttgtccgtcctgtgctcagctctgccctcactggccatgtggcgacaggtccagaatcctcatgcccctgtctggacttcttttccccaagctctttgcaaggggaggccttctgcaacccgtcatcagaaagagcatcaccgttgctcttgtcttcctacctgctttactttcttcatctccatgattattctctgaagctacatgactgattatcttgttgtcatttcttccccactgtaacagaagccccagaaaaccaggcatatcgtcttgtttacttctgtaactctagcccctgaaagtatggctagcagagtagggactctgtaagtatattttgaatgaacaaataaatgaattgataaatat

SEQ ID NO: 237804 - DNA, 483 bp, Homo sapiens
aacctgtatagctaacaggtaaatgttgctgtgtgatgaaaagaggaagaaaaaattgcctagtcttccagaataatcagaatgtctactctagcagaaagcttttgagcaagataaatcttctgaaattaactagtttaatgtagattgactataataaagaactgctgtaaaaaataagtatttttttggggaggggagcacttttaagttccttctgactgtgaaaacctgttaaatcctgaaagagggagttaaatttataaatgatctgttgatattggcacatggatagaggccttaaggcaataatggatgcagctggtaaagaagcagatctcagtcacagaaaaatgagataaagagaccatcaagaagaaaaaataatggttctattatctgtttatgtagtatatctttggatagttaagaatatcacatgaaaatgtaaagacatgcaaaataaagaccataatgaaaaac

SEQ ID NO: 237805 - DNA, 377 bp, Homo sapiens
gttttaattacaacaaaggtcaagggtagcttcacttaagaaaagctgaaggccagagaggaaggtgggagcaggctctcagggaggtaaggcttgtgcctgcacttggccatcttttgacagccttccctgcaaggccagcccacaggcagttgggaaacagttctgctgacttgggcccttagaggtacagcaattggacaatgtgtggcctcagggtctcagctgtcctttccctggcacacatgcacaggcagcaagttcatctcgagtccccacctgttctccagccacctccctaggggatcgggtgctcccctctgctccagggagagaactgactggggtcacttgtcaggaggactgctccgcttttc

SEQ ID NO: 237806 - DNA, 402 bp, Homo sapiens
ggctggcgtgcaatggcgtgatctcggctcaccgcaacctccgccttctgggctcaaccgattctcatgcctcagcctcccgagtagctgggattacaggtgcgggccactatacccagctaatttttgtattttcagtagtgatggggtttcaccatgttggtcaggctggtcttgaactcctgaccttaggtgatccacctgcctcagcctcccaaagtgctgggattacaggcgtgaggcaccacgcctggcctgtcaattgcctcctttctagtcttagtccagtgggtaaccttggctaccaacttcagttgagggctccccagacctgtgcatgccccaagcactgactcagaataaccaggctgtgggtggcatgcagttcagcctgctggggtt

SEQ ID NO: 237807 - DNA, 362 bp, Homo sapiens
atctcagtgtggaagaggagggtggagaggaaagacttaggggagaagcaaggccaagtgtaagctttctaggcccaaaggccctgtgttccctcatctgcaaaatggcgctgaaaccatctgtgcacttggggttgtgggaggaataaatacatgtaaaacacctgatgcattacacagggtaactgtcataaaaaccattcatcttcttatgaattatttccctgaggggaggagggtacacattctccatacgactatccttgcaagagaaactgcaaatgtaaacgacagactgaaccaagcataaagggaataaaataaaataaatagcagtaaggaaggcggtagattcaggttgc

SEQ ID NO: 237808 - DNA, 429 bp, Homo sapiens
gtctccacccttctcatccccttatatctctgtgtaccaaaattaccctttcatctcctactctatagtcacatgctgttagaaaagttgcttttttaaaaaagattaacttctgcctcatacctgttctctatataagaatttatctgttaggccaagcatggtggctcatgcctgtaatcccagcactttgggaggctgaggcgggtggatcacctgaggtcaggagttcgagaccagcctggccaacatggtaaaaccccgtctctactaaaaataaaaaaaaattagccaggcaggtacctgtaatcccagctactcaggaggctgaggcaggagaattgcttgaacctggaaggcggaggttgcagtgagccgagatcatgccattgtactccagcctgggcagcaagagtgtaactccttctc

SEQ ID NO: 237809 - DNA, 439 bp, Homo sapiens
cttttcggatgtcatgagaatttaatgggctctcccagaaaggtgcctggtagcggcaggcatgtcggtacatggtagttattaattatcattactgtacaaattcccagactggaaaaaagacatgtgctcctaaaaggacaggcaaacaggtaacaagataaataagatccgtaaaagtattcttagtatacattttacagtgtgcttcatttgaaatttccagatgtgaaaaacttgtccacatcttcccttcccagctctaggatttctgtgatttgcttgtatccttattgttagtgtctgtcaatcctcccagaatgtaagatcctcaaaggcagggttcttaattttgttgcctgatgtatccaagggtctttagaacactgcacgtagtagcacatagtagatactaaataaatatttcgtgaatcacaaa

SEQ ID NO: 237810 - DNA, 2398 bp, Homo sapiens
  misc_feature (17)..(18): n is a, c, g, or t
  misc_feature (1611)..(1611): n is a, c, g, or t
  misc_feature (2003)..(2003): n is a, c, g, or t
  misc_feature (2017)..(2017): n is a, c, g, or t
  misc_feature (2021)..(2021): n is a, c, g, or t
  misc_feature (2029)..(2029): n is a, c, g, or t
  misc_feature (2212)..(2213): n is a, c, g, or t
  misc_feature (2233)..(2233): n is a, c, g, or t
  misc_feature (2236)..(2237): n is a, c, g, or t
  misc_feature (2239)..(2241): n is a, c, g, or t
  misc_feature (2244)..(2244): n is a, c, g, or t
  misc_feature (2260)..(2260): n is a, c, g, or t
  misc_feature (2284)..(2284): n is a, c, g, or t
  misc_feature (2297)..(2297): n is a, c, g, or t
  misc_feature (2312)..(2312): n is a, c, g, or t
  misc_feature (2324)..(2324): n is a, c, g, or t
  misc_feature (2384)..(2384): n is a, c, g, or t
  misc_feature (2397)..(2397): n is a, c, g, or t
tttggttcttcccaganntgctgcctcagtttatagatggagccaagtacacttccctctgtggtagggacagatgggtggaaactccaccaccaccatttcagaactaggcttcctggcactggatggcatgtggctagttttgcagggctcttcttacaatgggcctagggtatcgttgtgtgagggggagaatatcttatccaccaagaaagtcgaacctccctcttttctggagcacagcagaaggtgtatacaaacacaaatttttgttattgcagactattgttattattgccaaaacagtcaactctttctccaaggctttggctcccctggactctccacagatgctgccctaggccctgttcccccagtacccccactcttaacagcttcagtacacagtgaggacagccctgtcatggacctctggggctggattccgcttggctggtcagctcttgacagaagccctgagatgtgtcattctaggagttgccctggagactccagatgtaactgaagggcattgccaggcctctcagaggctatctttgcccagacttcccaagcaaacacagggtgcttcgctgcagtattctctgcctctgggaccagttccttgcccagttggcagaaggcctgtcttgtcctccaacttgctattctagcttgattagcagcaaatctctggcatcaatctcagctccgaatgacctaatcaatttgtgtaatagggaaatgatgagttccctgcacataggcacaggatttttagggaaccagccccgtgataaatgcggcttttgcccactaaatcaatatttaagctactgacttccagctggctatgctcagagcctttacctcagccctgaattgctgcaatagactcctaaggacaagggcttgcttagtgtctccccgcttaggtccatcctgcctgcacctgccagtcatcgctgtgatcatgcccatctgatatgatcatgtgattgaagtatctaaaccacagtctccaatggctcccctaaagctataaaaatgtagtctttaaacccttgaggctgccattcaaagaccttgatgaggtgattcctaacaaatcattccagcctctccttctactaacttttacttattccccaagtactctatatccagcccaatcaccaggcctttacttgtgctgtggcccctactacagcactatcttctctcttctctccagctctttacaaaaaccagctcaactcaagttagacattttttccagaaagtttttcctttgtaggatgttttgagccaatcactttgatgccatcttttcaactccatgattattgaatctgctatgcatgcaaaaatttcagataagacacgcaaataggtacggcctctctttctcttttctgtctctctctgtgtgtctttctgccatacacacacacacacacacacacacacacacacacacacatgcacgcacataaacacaatataggagtgttaacccagaaaattaggtaaggtcaaatggaaccagttggcaactccactcctaggtatatacccaagaagataaacaaaaatgtaccttcacaaaancttgtacatgaatattcatagcagcaccattcataatagccaaaaagtagaaagtgatcaatctgtaagtccattaattgattaataataaataaaatgtagtatatacaatgacatatttggcaataagaaggaatgaagtactaatatatactacaatgtgcataaatcttgaaaacatactaaatgaaagaagccagtcacaaaggaccacatactgtatgattccgtttgtataaaatatccagaatagacaaatctataaagacaaaacacttagtggttgcttaggggtgggggttcaggagaatggtagtgtctgctaatggggatggggtttcttttggaagtgataaaaatgttctaaagttgattgtggtgatgattgcacngctctgtaaatatnctanaaagcatngaattgtacactttaaatgaatgaagtgtatggtatgtgagttacatctcagtaaagctgttaaaaaacaaatacaatggaccaggcatggtggctcatgcctccaatcccagcactttgggaggctgaggcgggtggatcacgaggtcaggagatcgagaccatcctggctaatacagtgannccctgtctctactaaaaatncannannnttngctggacttggtggcnggcacctgtaatcccagctactcnggagactgaggcngaggaattgcttgancctgggagtcanaggttgcagtgagccgagatcgcaccactgcaccactgtactccagcctgggtgacgganaaagactctgtcnc

SEQ ID NO: 237811 - DNA, 537 bp, Homo sapiens
ctgatacaaggacaactcgctgagttgcgaggtaacgggacggtcaatcatgttatgagaaagatgtcaatcctttctagctgaagggatttaagaatggcttggttggtaatatattctccctgaggcaatagacagaaatctcagtgtctggtacagagtaagatctcaaaaatagatgagtgaagaaagcatgtattaatgtgtgtcagtcgatgtgtttgtttgaaagtgttcagatggaattcaaaggtatttcagatggtcagcataagtcgcagaggcaatagaggtcaaaacagtggttctcaaagtgcggtcctctggactagcagcatcagcatctttgggaaatttgttagaaatacaaagtctgaggtcccacccacgtgtactgaaggagaagatctgggggtagggcccagcaatctgtgttttagcaaacccaccaggtgattctgatgcacattaaagattgagaaccactgactgaaaacacagatgcgaattcagattacttggagtatgggatatatg

SEQ ID NO: 237812 - DNA, 258 bp, Homo sapiens
cccttctttccagaagcttaaccagctttatgtctgtttagaaggaatatcttcaaaagcaatgcattttttaaaattctatttaattttcctattacaaacgccagccacctagagtgacctttgtaaatattatttaatatagccttctaatgtagctaatgtttaatgtgttttttataaaaatggaattgtaaatatcactttgtaacttactttgttcacttaataatagatttaccatgtttatgatttcca

SEQ ID NO: 237813 - DNA, 389 bp, Homo sapiens
caggggaggaaagactggtgggaagtgagcagctggagggaaaagaggagcccttggtgctgtagaactgcggggagaaaggcatgaagagagcaacgcccagaacatctgagtgagaggctgccttctgatgatgctgcaaaggagagctgcttggcttcaaggcacccaggattgattgcaggaatatctggatgtgagttagttgaaaaccgagtgttaccgcaagaggtgtaaaaatccaggttcatgtttgcacacatcaaaagtattgtgatattttcataaaagaatttctggaaaaaatgagtattaaccaatggtagatgcaactttaaatgctatcagtaagtcattttcttctgaataaagcctttcttaagaaagca

SEQ ID NO: 237814 - DNA, 416 bp, Homo sapiens
atggtgtttctaaggtgggggaaggggctgagccctaaaggtagaagcttctggaaagtttccagagggcccagagcctgtttaagatgtcgtgcctgcgttaagtgtccagaactgtctgctcctttcagtttctcttggactgaccttttcctataaaactgtaaggaaataaaaagtaatgatgtgatgtggatcatgaggtcaggagatcgagaccatcctggctaacacggtgaaaccccacctctactaaaaatacaaaaaattatccgggcatggtggcgggcgcctgtagttcagctactcagcaggctgaggctagataatggcgtgaacccgggagacggagcttgcagtgagcagagatcgcaccactgcactccagcctgggtgactgagcaagactctgtctc

SEQ ID NO: 237815 - DNA, 1005 bp, Homo sapiens
cagagtcttcctctgtcacccaggatggagtgcagtggcatgatcttggctcactgcaacctccgcctcccgggttcaagcgattctcctgcctcagcctcccaagtagctgggattacaggcatgtgccaccatgcctagctgattttgtgtttttaatagagatgaggtttcaccatgtttgtcaggcttgtcttgaactcctgacctcaagcgatccacctgcctcggtctcccaaagtagtgggattacaggcgtgagccaccgtgcctggccgcttgtgtcattcttattttagttctttggttacttctttagataaatctggactcctaatgcacactctgtagttctcccaagaactggctgttttgctgcctccttaattttggccgtattgcgggccatacaggaggaacctgacttgcaggcctgagtatcacttttactaccaaaagttttagtcagtcaccatcttactcagatcccagttgaacggatctgtcagaaaagagacacttggctagggtctatattagttgagaggctatttccaattcacttctcagcctgcatggttgtaggagcaagaactgggatcagtgagccacagtgaacctcattacatgccaggcactgaaaaagtcagataaaacagtccatgctagcaatggggcaaaagagggagaatttgcaagggaatctgtggcctagagggcccaaaatagcagtagggaaggagaggaggaagaaaaagaagtgagccagggagaagagcttgactgtagtggtggtggatgtttcagacctgtgatatatgaccaatcatcatttaagtggctttgggctgtggtgagctttcccagggccagagaataagccagacccataccaagtaatagaacagatgggcaaagagtcttccacattctacttggaaaagtaacttggtgggagaacagaagagaatccagcaatagaaggtacagatgttagtcttcagc

SEQ ID NO: 237816 - DNA, 354 bp, Homo sapiens
cacccttgaagacatgcatctcccaagaagcaagatatacatcataatttatatagcatattcaaatccccagtaaacaattcagaatgcaggcacatctccacaaagagttggcacacaaagcagaatcacgcttagcaaagcctctggcaaatgccaggtgagatggtcagaggcctgagatactgccttcatctgcaaggtgctactccctgtccctgtttcccagggtccgagactaattatctgcttgggagggatctactgtgcagcttatttcattttagcaaatgagatggttatctaaaaatccttgtttaagaaaaaaaaaaaagcaaatcaacaatgctgctc

SEQ ID NO: 237817 - DNA, 428 bp, Homo sapiens
gtttgtttgtttttctgtttttctgagacagggttttggtctatcacccaggctggactgcagtggcagcctgaatctccccatctcaagcaatcctcccatctcagcatcccgagtagctgggactataggcatgtgctacatggctggctaagttttaaaatattttgtagagaggaggtaccaccatgttgcccaggctggtctcctgagttcaagtgatcctcctgcctcagtatccggtgtgctaggattacaagcatgagtcactgcacctggtccagtagttcttttcaagcaggaaaagttttgtatagagaaatgtaggcaaagtcatttaggatacagagggaagtaggtgaggctctaggggaataagttgtactacggtaagaaactaaaagtgtagctaaactgttctacataag

SEQ ID NO: 237818 - DNA, 762 bp, Homo sapiens
agaagactggcagatgggaggagggaagaagccaggatttatttccctctgaagctcagccaggggctcccttcaggtggccccctctgtggttctggctcctgcagggtgatcctagcctcttggcatcagagcaccattcacttcctttatctctccagtcttaagagtagtagtgacttccggctgttgctcatctttggattgcctcatcatcccccatttggtcattcaattctttccctgtatcaaatttcccttgtctgaaatacctagggtaatttctgttttgctgactggttgttaactgacgtatactctatagtccactctctacacaggggctgaagtggatcccgctaaaaacaaagcagatgggggcatgacccagctctcatccctccaagagcttcccatcatcagaatagatgagaatagaatctcagctcctctggaactaaaaaaaaggcagattcctccttgcccacagtatttctagccacagcagtctgcttgctgttccttccgcccatcaagccagtttctttgcatttgctgtttccattgcaagaacacccttgctgcagatctgtccatggcttgctccctcacatgattcaggtctctgctctagagggaccttcagcgaccatcttttttttttttgagacggagtcttgctctgtctcccaggctggagtgcagtggcacatctcggctcactgcaagccccaccttccgttcacaccattctcctgcctc

SEQ ID NO: 237819 - DNA, 625 bp, Homo sapiens
aaatattccaaaatacaaaaaaaaaaaaaaaatccagaatccaaaagtgtctcaagcatttcagataatgggtgctcagcctgtatactgctagatttcatttgtttatgtatttttgggggaccttttcatttggtcatgagggatatcagtctgtaattttcttttttgaaatgtttgtatcaggttttggtatctgggttttcctggcctcataaattagggaggtataccttgaatgtttgctagaattcactagtaaaaccatctgggcttggagctttctttttgggaagtgtattgattattactcagattctctgtttctttttgagtcagttttggtgaattgtgtttttaaggaatctgttgtttcatctaatgtgttgaatttattggcataaatgtctatagcatctgtagtgatatcccatgattttggtaagagattattaatttttaaggtagccaacttttgactttgttaattttctctgtgttttgctttcctcttttattggtttctgcttttatatttaatttcctccatctacttactttggatttagtttgctcatcttttttctagattcttaaggtggaagcttaggactttaatatgcat

SEQ ID NO: 237820 - DNA, 631 bp, Homo sapiens
atttttctaggaatctaatacagaaaaagtttgatccaaatatacttgtttcccagaatggaatggtcataataaatttgtacatgggtaattcacccagattctttgaggtttagtttccagttaatttctggtggcgcttattgcctccttgtctgtgtttttaggggacagcttacaaacaccaggaagtacagctacccctaaagtccctctgcaccaaaatgtgaaaaacaacctggctgtttagagtagaatatataattcatttaagaacaattttgttgaattatggcccagcaccatggctcagtcctgtaatcccagtgctgcaggaggctgaggcaggaggattacttgaggacaggagctgggggctgcagtgagctatgatagcgccactgcactgcagcctgggcaacagagtgagactgtctcttaaaaaggccaaggcgagcagatcacgaggtcaggagattgagaccatcctggccaacatggtgaaaccctgtctctactaaaataaaaaaaattagccaggcgtggtggcgggcgcctgtagtcccagctactcaggaggctgaggcaggggaattgcttgaacccgggaggtggaggttgctttgagcca

SEQ ID NO: 237821 - DNA, 665 bp, Homo sapiens
gtgggggttgtgaaaggatagagttgggtaagattatggttttttagagtataatgtttatgagagcttagctgctggaatctgattctcaaatcctgtctccaaaattcctgtaactttgcacaaattatttctctatgcctcaatttcttaatctgtaatgtatttacttcagagagctgttggaagaatttgagtagttaatgcatttaaaatgctcagaatggtcacttagaacttagcactctataaatgatattttttgacattatgaagagttttgaaatctagcaaaagagtttaaattttatgtgataagtaacgtacagccaggataaattccttattatatgttcaaagcagcatttaaggaaaagtaagtagaaaacagaggaccaattcaaatggaggaggctggggtgaggaagaccacctactaagctgtagtattcggaaatatcaggttttaagttaatgagaggctaggataatagctacaacaaatataatgattaataaaaccgaaacctgtattttctttacaaaacacttttgacataacagtacgtcctggatacaacagtatctctaatttggagacaaagaattggaaacttagtgctggcttctatcattgtggtaagagtgaaaataatggatacaaa

SEQ ID NO: 237822 - DNA, 1317 bp, Homo sapiens
  misc_feature (110)..(110): n is a, c, g, or t
  misc_feature (479)..(479): n is a, c, g, or t
  misc_feature (541)..(541): n is a, c, g, or t
  misc_feature (708)..(708): n is a, c, g, or t
  misc_feature (719)..(719): n is a, c, g, or t
  misc_feature (776)..(776): n is a, c, g, or t
agcttgcctgcttctcaaaggtcatgatttccaccctggggctgggaggcagctacatattcctacccgctggcacaggatctggccctgcactcccgagaggtggctgngagccttgcggaggcagagagagaacaaaatggaaaggaatcttcctcccggagagccatcttctgtgcatgccggtgcctgcaaaagacaggcgaggcgagacagctgcacctcgggcctcgtcgctgttgctgagaaagaaaggaacaaataaatttagctccatcctacgcatcctttgcagctgctgattgaccaaacagaaagaggcctctatttcaaccctggcttctcagctttttgcctgatggggtctgctatcgccctttacaagggacttttgaaggaggaaacgggccgtggccttatttagcgcctggccggctggaggctgcacagacaggagttcaagtttagggtgtctcttnttgcccatcccaaagcaaaatggtggcccggaaacgtttccaaatgggcttcggctcctggnatttccaatgtatttatttggaagccagaacatggtgggtggagagatgtgtaactgtgccgaggccagcctatagctcccgaagccattagtttaatagcaccatttgtggaaataaagaactcgctgactgggcttgaaggtaaaagactggaacgaagcactgngggggtttcgnggggctcactagcgtggagaggtccctgcgggatgggggacaagctgtgtggacttngagtcagatagacttgggttccagtcctagctctatcacctaaaggcacgttgtctctggacaaagagagcctttgctctgtgatatgtaagtgaaatgctagctgtgacactgaacctctctgagcctcagttccttatctgtaaaacagcaatgatgacacgaggtcgtcacaaggattaaatgacaaagaatactgaacctacatagcccagctcttgctgtgccatgatggtgtagagtggcccctgtttgacctgcccaggcccattctccaaagaagctgtacaggtgaggtggctcacccctgtaatcccagtactttgggaggccgagaagggaggatcacttgagcccaggagtttgaggccagcctgggcaacatagagagaccccatctctgcaaaaaaataaaaaaaattagctgggtgtggcggtgcacgcctgtggtcccagctacacaggaggctaaggtgggaggatcccttgagcccaagaggtccaggctgcagcctgggtgacagagcaagaccctgtctct

SEQ ID NO: 237823 - DNA, 495 bp, Homo sapiens
atgaaatcatggcatttctcttactgcttttattccactataaatggcacactgacacatttccataatatgatttttatgatttttcattcatcatatgccataccttgtgataagtccttacagtgtgttctcatgcaattctcgtgatagtcctgtgaggtcaatatcttattactctcattttgtaggtgtataaatgtgggccttcatgtcacaaagcatggaaattgtctgtggctgtcatatgactgtttcaggaaagtactcagaatgttggaatgttcatttactgaatattcactgaatgtttattgaacacttcgagatgctggggacacaacattgaatgagataaaaccattggtatcacggagcccgtattgtggtggtgggggtagcattaaacaaataaataagcaagagaaacatcagaaagtactaagtgctaagtgctgtgcagataattaaaacggagtgatgtgataaaaaaaa

SEQ ID NO: 237824 - DNA, 479 bp, Homo sapiens
atgtcaattaagaaaggaaaaaggtaacatggggtgcaggagagggttattgacaatattgcaagaggcaaagccaaagaaaatagagtggcgtgcacacatggggagatgggcgagctacctcctccatgattacgggcaggttttgtagctgtgcaggggttgggtagctcctatttgatagcttctctttgatctgtgaggtggaaggtgagatttccggctgagattacaatgcaggtgactggaggaagtggtctaaattttgagaacagagtagctttctgtgaagggcagataggcaaggagtttaatgtgagtttctttagcagtgctccagtgctgatttgccaggagtagaaggagtaggggagatcaggatatggaaacaaagtgtagttgatgtgaatgggccatgaaatcaaagctgaacaggaaacgaagtgaagaaagaagtgaaggtggtaggaagctagtag

SEQ ID NO: 237825 - DNA, 349 bp, Homo sapiens
tattcacatcaactacatgtaattacttgactgtacttttaatgatgctaaaaatttaaattctgtggcaacgtaaatctctgacaagacagtatatttactaacactgaaggaatgtaagaccattgtgcatttttagaggcttgtatttatgcatatggcacaaacatttgcatttttacattcatttatcttaattattggacacagttaatttaaaacactaacttggacaaaactaattgttctgtattatatcagaataaataacatatctattttataatatataatatatgccaaactatttgccatatctttataataataaataacatttaataaataa

SEQ ID NO: 237826 - DNA, 435 bp, Homo sapiens
gcatataccaccacacccggataatttttttgtattttttgtaaagatgaggttttgccatgttgcccaggctggtttagattgtgctttcttagtgcttttttcaaaaacctctgctattttatttatttatttatttttaaggttggctctcactctgtcacccaagctggagtgcactggcacgatcacggctcactgcaatctcaacctcctgagctcaggagatccttccacctgggcctcccaaggtgctaggattgcaggtgtgagccaccttgcccagcctgaaataattcttttgattggttcagtgaaatcggagaaggtacattgcaatttgtgctgttcagaaattatgattataataaaattttgtgtctaagactaaattaaaaactctatactagccaaaatccctatatcagtgttcta

SEQ ID NO: 237827 - DNA, 354 bp, Homo sapiens
tagtgtttatttcctcaggttttatcattagattcttttataatggcagacattcatattttagagtcatattttagtcaggtttacactatcaatattcatgtctgtttttgcaatccagagataatctttaaaagcagaaatctatctaaaaggctagggtttaaagttcttttcattttcactaactccttaatatggtattcagtgtactccatagcttgcaatttacaaatgctgtatctacatggtctgccaatacagatgcaattgtatattaatcagaatttttaaaatcagaatggaaaagaggcagggaacaatttttaaaagtttaatagataaagaaacaaa

SEQ ID NO: 237828 - DNA, 439 bp, Homo sapiens
ttttttgtagagatgaggttttgccatgttggccaggctggtctcaaactcctggcctcaagtgatccacctgcccagatgccccgcccagcctcccaaagtgctgggattacaggtgtgagtcaccacgcccagccttctgacgtagtttctaaaactccatttgttaattgaattttgacttcttggcattttctaaaaaacacagagagggtcgaatagcagctgttttcatgctctgtacttgcttgctgttgacacacgcggtgtggctctgggtccggttggctttgcctaggggaggagggccagtcatgcaggtgcagctggagaggctcaccaggtcccttgtatggggctgggagccctgccccaggaggcccgtggcacggtgtggcctcgccttccaggccatctccacagacctgcctcggccttg

SEQ ID NO: 237829 - DNA, 406 bp, Homo sapiens
gtgcagatggaacagaggaaacggggctgaggcacgttcctggggtccactgacaagatctcgatgcttcagatgttggggaaaccattattctattcacgcagttgcccattccagaaatatgaggttgtcgtctcctcctcaatccactgaatcatgaagtcccatcaattctacttcctgctgagtccatttactcctctctatctatatggcccatctggtctcctaacgcatgcaactccactccattcgcaacacaaaattcatgttgatctttttaaaaatgctaagctgataatggcattctcttacatgaaaaaaaaacctttaatggctcagaaagaggctgaaaacccttcactttagtctctaatgccctgcttagctgtgttcctgcctccct

SEQ ID NO: 237830 - DNA, 341 bp, Homo sapiens
gaattcttgcacttattaaaggaaatgcattcaacggaaaaggcatctagtcagatatcttagaatggcttcttaagtgaactgacttactcaaatcatcccctaaataactcttctctgttataagaggataagcaaagttattgtcacttgaatgctttatatatattatattatttcattttgagctaaattatgtgcatttgagatataatatgctatctgaatattttatgggtcacaaggtgccctggcataatccagtggagatgattggtctacttgtttacagaacttaaaattacattttattgttttatgttattaaacagttcaatcat

SEQ ID NO: 237831 - DNA, 310 bp, Homo sapiens
agttatttaaaaatatgtttgaaagcaaaaatgataatgtctggcgtttgcagtgtatgtagatgttaatatgtaggacaagtgaaatacaaaaggggacaaggtgtggtgatgaagtttctgcattccacttgaagtagtaaaatactgattctaagtagattgtgaaaagttaatatgtatattgtaatccttagaccaaccactaaactatacaaagagatggcaaaaaacataatagagaaatcaaaatggagttctaaaaaaagttcaaaaagcttgaatcaagacaggaaagaagacatggagg

SEQ ID NO: 237832 - DNA, 278 bp, Homo sapiens
gaccaatgcacactattgaaactcatcttgctctcttctctaggtgagtaaagcattgttcctttcagtgcctgtgtgagtcatgtctttcttagtgactccaatacctgcaaatcacatagtgggttgacatcctgatgctgctgctcctgatggtaggcaacaagtgttgcttgatagcaggatttataagtacagaaaatagaggtcctcaatcatttgtattttcttaaatgattatgaggcaaggtcatcaactgagaaaggaaagttggcaa

SEQ ID NO: 237833 - DNA, 506 bp, Homo sapiens
actcctacaggaactggacctggttatggcatttccaacgcaggggcaagcgatgaatggcagggttgaccccaccattcccctggtaatcactgctgggtgtactactaacattgcctcgcattctctgaacaaaccaataaagcaaaagtaattcccactttatggataaggaagacgtagaatgtgacttgtccaaggccacagagtaaacagatgagctcagattcaaaccttggtgaataccagcttcataaagccagtgctctgtctaccgtaatatgcaacactctaaagttagcaaaatcaagtttattatacccacgctgtaatccacatacttgcaagcaattaataaactcagagtggaaggttaaatcatctgaaaataaacatcaaaaatgtatcactaattcttggcaattcttgtatctaagcaatcaccaaaatatttaataactcaaagatgatttatcatcaaacataagaattaactccctgggagg

SEQ ID NO: 237834 - DNA, 313 bp, Homo sapiens
agattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaa

SEQ ID NO: 237835 - DNA, 446 bp, Homo sapiens
tctgaatgtttttcaggtctcaatctccttcagttcatctctgacttttggttattttttgtcttctgctaggttgggggttggtttcctcttacttctctagttattttagttatgatgttagcttgttaaactgggatctttctttttgatgtgggcatttagtgctctaagtttccctctaagactaccttagctgtgtcccatagatactggtatgttgtgcctgtgcacatatacactggcaaagtgatgggactggcaaagtgatgggagttgccatgggctcagggtaagctgcagtgtggggagggaggaggcaggctggtatgtggcatgggagcctccccacaggaactctctgccagtcagttatgattcaccagtgcaggagctatgaggagggcctccaggccacctgaagcagtattatttttgtttattaa

SEQ ID NO: 237836 - DNA, 712 bp, Homo sapiens
catctggctagatggcaccaaactgcatcacttcaggccacacaatgttcattaacacttaaaggactttttttttttgtatataaattatatagccaaaaacaaagtaaaacataacccaccaaaaatattttgttttacctcttggttggcaattttggcatcaagcacacatactttaatcatagtaatacttttcttacagagacatggaggttgctcgctaaatagagcaaagcaaaacaaaacaaaacaaaacaaaacaaaaacacacctttcagaatgaacagggcattcatacagaaactgtggaggtgaagttggcacttactcatctcaaaggacattgtcttttggccaaggctgccatcctgtctgctttgacacttggaaatggcaactgagttcgtaacacaaaactgaatgttgcccttcttaatgtgaggagagaatgaaatagaacacaaaaaaaatggcattcaagaatataatcgccatggtggctcatgcctgtaatcctagtactttgggaggctgagatgggtggatcacctgaggtcaggagttcgagaccagcctggccaacatgaggaaaccctgtctctactaaaaatacaaaaattagccgggcgtggtggcatgtgcctataatcccagctactcaggagactcaggcaggagaatcacttgaacccaggaggggcggagcttg

SEQ ID NO: 237837 - DNA, 1014 bp, Homo sapiens
atgcacggtcagaaaatgacatagaggcgggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataataaaataatatgtaaaggctaaccaaataacccactttagtctttacttactggcaggcagcaacatgtcctatttacagagggaggctttacctaagtggttatatgtaaatgaaccaccttttcaatgaaacaggatgcacctgtctagaggtgtctgttactagagcaatggatgtttgattggactgacaaattttatttcctttttggaaaaaagaatgtaggtggtatcaaatcaccctttctcctggtaacaataggaattacttcttgaacttgagaaaccagtagttgcttgacctatgttttttgcatttagcatagtcttctaaagtagtaggagcatacgtttttgtctttaattccctgcagaccccttccccaatgatcatcagcaatacatccacccataaatcaatgaaatcataaaaaagaaacataaaattcacttgaaaaagaatacctacaaggcattcctagaattctcaatgtaagtcattttttgccagcaaagctaattgttctcaaatatttgataacaaggatggcatacgtagttcattccaagacctcaactgtgtgacagacgcaagggcagtagagttgagccccatgagctgttgttgtcatgtgagtgactccagccttcatgtgaatttcatgtttttctttacaattctagccacctccaccaatctgccatccatttcccccatgggatacaatggaaagaaaaaggtgcctgacaaggtatacagtctgcccttcatatccgtgagttgcacatccgtgattccatccagccacagatagaaaatattcagaaaaac

SEQ ID NO: 237838 - DNA, 978 bp, Homo sapiens
gcaccattgcactccagcttgggcagcaagagcgaaaacaacaaaaacaaaaacaaaacaaaacaaaagaacgctttttctttgaggaccatgccacctagcttgcagacactttcctcttcctgttcctgccatcttctgacttactggcctctctgtattgctaacatctttgtctcctggcttatactcctgccctccaccttcaccttgtcgttattcacatggattcatcttctgtacagacaacacccttacttctttctcgcttgaccagcttgatacctccccccaactcgatttctccttatttccactgttctaggccaccctggcaaactatagccaaaggccaaattcagctcactgctaattttgtaataaaagttttattggaatacagccatgcctattcatttatatattggctatagttgctttcttcctaaaatagcagagttgcattgaaatagagaccacatggtccataacaccaaagatatttactatctggtccttcactaaaacgttttctaacccctattctggacaaacaaaataaaaatatctttctacgaaagtaaaacttgagcattatagaaagtttaggaaataagacaaagcattaatacaacaaagaaaagcagctccccattattccataattcagatataaccactgttagtattttagtttttcttcctgttacttggtaattttttatgtctgtatgtgtatattaatatgtctacatatataaattaattttagaaattcaggattataccactttataacccacttttttcatttcaaaatatattatcaatgtttttctatatgaattgttactttttaataacatttaattgttacttttttataaacatgattttaaatttctgcaaagtagtcaatggagtgaagataacatcatttcactagccagcctactagtacagaattttttttttttt

SEQ ID NO: 237839 - DNA, 1032 bp, Homo sapiens
gcaccattgcactccagcttgggcagcaagagcgaaaacaacaaaaacaaaaacaaaacaaaacaaaagaacgctttttctttgaggaccatgccacctagcttgcagacactttcctcttcctgttcctgccatcttctgacttactggcctctctgtattgctaacatctttgtctcctggcttatactcctgccctccaccttcaccttgtcgttattcacatggattcatcttctgtacagacaacacccttacttctttctcgcttgaccagcttgataccagagaccagcatctaactccatgtgaaactgatctactctttgactgccatttttccccccaactcgatttctccttatttccactgttctaggccaccctggcaaactatagccaaaggccaaattcagctcactgctaattttgtaataaaagttttattggaatacagccatgcctattcatttatatattggctatagttgctttcttcctaaaatagcagagttgcattgaaatagagaccacatggtccataacaccaaagatatttactatctggtccttcactaaaacgttttctaacccctattctggacaaacaaaataaaaatatctttctacgaaagtaaaacttgagcattatagaaagtttaggaaataagacaaagcattaatacaacaaagaaaagcagctccccattattccataattcagatataaccactgttagtattttagtttttcttcctgttacttggtaattttttatgtctgtatgtgtatattaatatgtctacatatataaattaattttagaaattcaggattataccactttataacccacttttttcatttcaaaatatattatcaatgtttttctatatgaattgttactttttaataacatttaattgttacttttttataaacatgattttaaatttctgcaaagtagtcaatggagtgaagataacatcatttcactagccagcctactagtacagaattttttttttttt

SEQ ID NO: 237840 - DNA, 417 bp, Homo sapiens
caatgcatttgcttcatggccaggggaagccaagcgtccagaaagtggaagagcgggtactactaccaccccctagtggtggcatgtgacaacacggtatagcaataaaacattgaagcaaagataccaattgcacatccaacttagccaaacccaacgcagttgataaaagctgatgtgtacaaatcctgattaatttagaattaaatctgttactgctagaacatggctatgtacctactttcatttatctcaatttattaatatatagccatgggattagccatgtgatttttgtgcttttgttagtagtatattactacattgagacagatttacagtttgcaacggaatgtcagtgtagaattgactatacttgcatgagaaaaagaatatattttcagtacaaacctatta

SEQ ID NO: 237841 - DNA, 401 bp, Homo sapiens
agttgttccatcattttcccagggcctcatacatcacagggttccataaatatttattcaatgaatgaatggattatacaatcttaaccagttgctattgccattagctatttctcctattttcctcagcaataattcactgggaaaaaatgtttggggttcatattcgctcacggaaataatgaaaaggcccgttacttttctatgaaatcaaataactgaagaacaaaatgttatttaaggtattgattaatgttctatataaaatactgaaacgcacagccataaattatgctggcattatgtgtatttctatttcttatgtttccaactaaggctgttgatgctagaatgttaaaaaacgttcttcatttcaaaataaattcgtatctcattgaggt

SEQ ID NO: 237842 - DNA, 531 bp, Homo sapiens
tcctaggtgttaagattgagtcagagcagacccaagtgtccagtggttgccttagctcagccttagaaagttgcaaaatgcagagatgggacaccagaagagtgggcatgttgtgtgggaagtggggttggtgggggagcccatggacttcaggcctccaggtcactgcaagttctagaacaatttcttccaccaatacactatcactgactggttatgccatgtacaaacactactactaatttaaatttaattattattatatgccacactggtggttgtaaacatcagttgaacttttcaatgtctaaatattgtggttagttgtttttatgtaatcgtattctattcatactttcaaaaattagaggaaatattggttactgtaatagcattttgctaaattgaagaagggagtgttttaaatatctggcgatgtagcaagctattgtgtgggttgccttgtcctactcaacttcaaatattcaccacccccctcataataaaagcattataggagatagagaaata

SEQ ID NO: 237843 - DNA, 425 bp, Homo sapiens
agacagtgcctaagtagaggcaggagagttgagcctgtctctgtggtgtcttcatgggaaacacgaacattttcttgctctacttctggtgttggttggggaactcagttatttcttggaaagactgagtgtgtcaaagaatcattctgtttgctgtctgaaaacaaatgacacagtatttgttttcaacaaatgaaacagtatttgttttcaacaaatgaaacagtgtttgttttggtgtgcaaaggcctttgacactttctgtgtcaacgtacttttatcatcacataaacatgtatgaccaaatttaaatttttgtagtgtgtattaatgcctttttttgtttaattattataatcatttttcaaaatatctttgttttaatattttatcactctttattaaattaatggaaatatcaccca

SEQ ID NO: 237844 - DNA, 154 bp, Homo sapiens
taaagttgaaaggaggaaaatgtcatcagcactataatctttgtctcacttaagaaaaaaggccttaatttgcggcagggaagtatttaaatatacagactgtaaatattggagggtacatttttgtggcttagaatgtgaatgggggaaaata

SEQ ID NO: 237845 - DNA, 440 bp, Homo sapiens
aattacatttatgttaagttttctttgcaagaattcctgacagctatacgcagatgataggtaagaaatcagatccaggggtaaactatacagattagccataggtaattagctaattatcttttataattaggtaaataattacaaaagcaaaatgttaaatatcttttcagttaatttatttttttgctgtggggccatctgtgtttactaggggagtgtccatgcattttttaaatatgtttgatatcatgtgagatggaccctatagaaataagagtgtgtagaacatagagaggtctccagagtaataatgttaccccttggagaaggggatagaacacttagaggattcagttcaggatatcctaatattatctcttgatttaattggaatttctgtaaacatgttctttctaaatgtagggaaaggtcaggtg

SEQ ID NO: 237846 - DNA, 931 bp, Homo sapiens
ggatatgtaggagaagataatgatgttacgttataagagacttctagttagtagatttcaaagccagctacttaatgtttccccaaaaagtctgcaaagattaagcctttaagtccctttctcttcccgtgtgtgtgtatgtgtgtgcatgtgcgtgtgcttgtggatgcacatgctaaacaattaaacaaacaaaaagacaaaacatcctttttcccaggtctcctagatattttttccccaggcaattccatgtgcaacctttgcttttgccggttcagggcagcttggcccgggtaagacaatagacatacaagataataacagggcagttgctctgtggcattgtcctttatcaggattaactgttacaccaataagcaaaacagtgtggtggggtttttccatcactggcctttgctgttcctgggtgccagatggcattatatccatgaaaaaaaaaaaagctgcaagttataatgttgaccaggcactgttacttccacttgatcacactgtttggggctctctttgatgtacaaaacactcctaagttaatgaaatgcgttgcagctggctaatggctgggaaagtgcaaaccctgcattgaacccttcccatcagactattcaatggctaggtaatgtcaggcccgagctggagaaggggcaaacaggctcgttgccaggcaggcccgggactcctgggcaaacggctgtggaggggctggtatttttctcctttcaatagaagtggtctgtgcctgcagcaaatgagaaataaatccatcaaggccaagctcaggcttattttgctggctgctagaatttgcataagagccttgtatatacaggtaaacaaagacttcctggaattactaatgtggaggtgatctgagaactgggaacaaagtagggcctcatcttatgca

SEQ ID NO: 237847 - DNA, 507 bp, Homo sapiens
gcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcacc

SEQ ID NO: 237848 - DNA, 358 bp, Homo sapiens
ttctgtaaagggccagacagtaaatatttcaggcttaggggccatatggtctctgtagccaactactcaactgtgctgttgtaacatgaaagcagccatagtcataagtgaatgggcaggactgtgttccaataaagctttattgatggacactgacatttgaatttcctaaaatttttatgtgtcacaaaatactattcttcttttgtttttttctccaatcatgtaaaaaggtaaaaaccatgcttagtgtaaaagttacataaaagctggaagcaggctggatttggcctgcaggtgacagtttgctgactctagttttaccaaaccttcccttcttttggattctacatccagc

SEQ ID NO: 237849 - DNA, 485 bp, Homo sapiens
catctaggagccctggttcctactactggagaatggtattagaagccaagatctaggttctaagtgtgcttattgctactgggtgtgtcattggttcttgccctactgagccaggacaacagggagatatatatgtgtgtatactgtatatatacacatatctatacacatttctgtatataactatattatagaattcatgaaatgtcataaactcctcagagcatactgacgtctccagctctaatccattaccacatagaccacactagcctttatcttctcattccaacagtgagaaacttagctcccactatcagccatccatctacttcgttgttcaatttcggtatgatgtgtggtagttatatttgtcttctagggctgctataataaatgatcacaaacttagtggcttaaaacagaaattattcttttcacagttctagaaactagaattccaaaatcaagaggtaaaaaatatg

SEQ ID NO: 237850 - DNA, 618 bp, Homo sapiens
cgcaggctgtagagcaatgatgcaatctcggctcactgcaacctccacctcccgggtcccagtgattctcctgcctcagcctcctgcgtagctgggattacaggtgcctgccaccatgcctggctaatttttgtatttttagtagagacacggtttcaccatattggccaggctggtcttgaactcctaacctcaagtgatccgcccccatcagcctcccaaagtgctgggattacaggcgtgagccaccgctcctggccaaaatcacattttctttatctgttcactgcaggacatttaggttgtttccatatgttgactatcgtgtaaaatgctgcagtgaacatgggaatgcagagagctctttacaatcctgtaggactgcttgatcatatgttccattctgaattttgggggaaccttcctactttttccataatggttgtataaagttatattcctaacaacagtgaacaagggttctactttctccacatctttgccgacatttgctatcttttatcttttttacaatagtcaccctaaaaggtatgaagtgatatctcattatggttttgacctgcatttacctgataattacagatgtggagcaccttt

SEQ ID NO: 237851 - DNA, 382 bp, Homo sapiens
gatccagttaagaaatcaatgatagaagctataattgtgttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattatgaataataacaaaaagttaacctggaatgattgc

SEQ ID NO: 237852 - DNA, 1034 bp, Homo sapiens
acatccctgctggtgccagccccagccttcctcatcatcttccagaagcactggatgctcctccttggctccgggacagaccccttcctggcgctgtgcacggcccagactccagcagtgacttttcccagctctgaggcatcacccagtgtcctgggcgtgcccttggccccttcatactccacgttccttgaagtgaagcctgtggctccagggccagcctctctctgagcctcgtctactgtggaacatctgagcctggaggaggccttttgtgtggcccctgtgtccagtctcaccccatccttctcaggtttagatgctgtttctactctcattgtgtagatgagaaacgggtgcacagagccaggactgcgccagagcccacggcgggagggcaggaaggccacacacacggagggtcccacctcccatctgccaccctgcttgcttgtcacaggggagctgtccctggctgcatccctccgcggcttagacactggcggcctggattttaaaacatgttttgctatgaaggatgttattggagcagctggcaaaattggaataagatctgccacgtgatgttattgtatcagggtcagtttttttaaccatccatatttgtactgtggttaggtatgagagcgaccttgcttttgttaaatacactctaactggttcagaaaagtgagcgtgcctgtgtgtgtgcgtgtgtgtgtacgtgtgtgtgggtgtgtgtgcctgcgcatgtgtgggcacctgtgtgtatgcatgtgcctgccagtaaggggatgataaagcagttatggcagaatgtgagcccttggggaatctgggtgaaggtggacgggaattccttgttctatttttgcagctgttttgaagtttgaaatttaaaatgaagtacccttgaaagttacacagggccaggcgtggtggctcacaccggtaatcccagtgctttgggaggcctaggtgggaggagtttgaggcagcctggacagcaagacccccatctctatttttaaaaa

SEQ ID NO: 237853 - DNA, 338 bp, Homo sapiens
ggtagaaatttgagaagtttatattgaccaagtttatattgtccctcttgtatgtgagctggttatttaattgaaaaagaattcattaaaggcccagagtatactctacagaaaaaggaggtactgtgcttgtacttatagacctaatgtagagaagccctaactagggaggagagaattcacatcaaaaatggaaaataaggccaagggtggtggctcttgcctgtaatcctagcactttgggaggctgagatgggaggatcccttgtggtgaggccaggagttcaagatcatcctgagcaacatagtgagaccctgtatctaataaaaaagcaaaa

SEQ ID NO: 237854 - DNA, 411 bp, Homo sapiens
agctcatattcccaaagcattttgctcacatctctattagagccccattaccttatattgtaattattgcttacttgtctcttttctactaggctggagctccaggcaagtagctctttttgtttgtttttgaatctctctgaatctagtaagttctgacatgtcttggttgaatgaattttattttacttttatagaaagtcattactaatacaaatacgagaccttttgtttattggaaacatttatctactttaaaaatatatatgtttgtggaaaaacttattgaactgtgctgcttggcttagttattttggcacatgttcacttctctggaaacaaattactgttagtccaagaaactgaagaaatggtacccatgagaataaaattaatctcaatatactgaac

SEQ ID NO: 237855 - DNA, 381 bp, Homo sapiens
aaggcactaggaagagattgctgacaaggcagtgtgttttctaaaggcaaacactggacaaaatctctccctgcgatggcgagactcacagagacaggacagctgggtgagtcagctggcttctccccagaatgagcatcaagacacttgccaccctaaatatgtatcagggttgagatccacatgccagcttctgggacaagcagggtctccctcagctgtgccattggattggttcctcttgttaaaatagttagaaaattaagactcttttaataagctttaataagcttcagatatgctgcaagcatcaaaagcaacacatgtctgttatggcggctgttgtaaacctagaactaaggaagacgcaaatataaaaaa

SEQ ID NO: 237856 - DNA, 1257 bp, Homo sapiens
gttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaacaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattcttttt

SEQ ID NO: 237857 - DNA, 234 bp, Homo sapiens
caatttgtgaaatatggggaagcttatttttgctcttctaatatgctaagtgattagattgcatatttgcaatgattggtgctgatggctttgtatttaattgggggaaaatctggaaacacccccaaaataattccatttgtttcctgcgtattattacatagttctgacttcattttaagtaactaaccatcttaaaaagaaacatttgctcctgaaataaaagaaattcta

SEQ ID NO: 237858 - DNA, 408 bp, Homo sapiens
atttgacatgaaactactgccgtctgtaaaccagttatcctcagaatctgggagaagttggtcttttaaattaggctggctaacatatgaatgtatgtgcaatgacctgctcgcaggaatgatcagttactgggcctgtgggcagaaacagagctggattcaaggtgctacaggtttcaagggttacatctgggttttctaagagtgtggcatggtattaggttaaacttccctccatcatctagaggtatccttttatttctaagactgacttcacctgatgaggggttagaacttctggtagttgacctagggtgacttcagtggctccttccactaaaataccagtggctgggattgcccacgggaaacttggccatcccgaggccactccatccagcttttttg

SEQ ID NO: 237859 - DNA, 476 bp, Homo sapiens
ctaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaa

SEQ ID NO: 237860 - DNA, 390 bp, Homo sapiens
ctacacccccctctgcccacgtccccaggaagccatgtcagggcagaccaggcaccttctcattctgaggagagtgcatctcagcccaaatattgtgttccatttagagaacactgaacagattaacagtgaagcttctccaagaaacggtggacagagagcacctggagagtcccgggctgtggccacagaattgcgccagtgaagctggcggttgacttcaaataccagagcatcttacttggggaaggattggcctcattcatgtgattctaacccaaggtaacattagaaacatgctagggtttatcacatgccaagcatgctgtgggctgtgttgcgtgggagccctcatcacggccctgcagtaaagacgctttatctttgaaa

SEQ ID NO: 237861 - DNA, 1309 bp, Homo sapiens
cctacagaagggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcccctgcgctatgtggacattgacatcccatgcaacaacaagggagctcactcagtgggtttaatgtggtggatgctggctcgggaaattctgcacatgtgtggcaccatttcccatgaacacccatggaggtcatgcctgatctctacttctacagagatcctgaagagattgaaaaagaagagcaggctgttgctgaaaaggctgtgactgaggaggaatttcagggtgaatgtactgctccagctcctgagttcactgctacttagcctgagattgcagactggtctgaaagcgtgcaggtgacctctgtgcctactgaagattggagtgctcagcctgccacggaagaccgctctgcagctcccactgctcaggccactgaatgggtaggagcaaccactgaaaggtcttaagctgttgttcttgcacaggctcttaagcaacatggaaataaataaggttgatggaaaataaacaacagtttcaaaaaaaaaagaaatgttgagcacctttacaaatacctattggtcatttgcgtgtcttccttggagaatatttgtttagttccttcacccattttttaattgggttatttgttattgagtcatagggattccttatacacgcaaatattaacctcttatcagacacggtttgcaaatattttctgccctttcataggttgtgtttttattgtgttgaatgctttctttgctgacagaagatatttggttgaaatcccacttttgtgactttgcttttggggtgaatctgaaaaatcattg

SEQ ID NO: 237862 - DNA, 404 bp, Homo sapiens
gaaagaaacaaagagaaaggaaaacagctctctctctagtgagacagaggagcttctgaaaggaaacgaccagccggtggcagaatttgccagattttataggcaggcttgaggaggtggtgtctgatttacgtagggcccacagattggtttgatcacgtgtgacgtttatatagcacatggggaaggctggccattccaccctaatcttattatgcaaatgggctttccccttggcctgccccattgtctgctgcttaccgtacacattgctgaaaaagagaagggaagatgaagccaccattttgaacatgattggcaccactgctggcatctatgtctgcagctcgattttacaggctgctctttgttagaaagaaaaatcacttggggctgctttttat

SEQ ID NO: 237863 - DNA, 406 bp, Homo sapiens
aggtggatcacctgaggtcaggagttcgaggccagcctggccaacatggcgaaaccctttttctactgaaaatacaaaaattacccaggcatggtggcaggcatctgtaattccagctacttgggaggctgaggcaggagaatcactagaacccgagaggtggaggttgcagtgagctgagattgtgccactgcactccaacctggtgacagagggagactctgcctaaaataaaataaaaataattaaaaaaaaaaaaagagccacaaactaaagtctggttgggttgggttccattgcctttgctcagaatgtaagctgctactatctaggtacatcagctgtacatatgtcttgtagccctttagggtctcagaatttgtctctgaaaataagaggattggat

SEQ ID NO: 237864 - DNA, 775 bp, Homo sapiens
ccatattctgatagaacttgtaaactcctttcaatattattgaacacatcagataattaaatctgttgccctgttttcttcttggaggcctccttcctggagccttctgtccctgctccagtgtggatcatttagctgttctcatcatcaccttgtgagtcccctctccttctaccctctgttggatcccccatcctggccccctggcttcacaattgttaatttacaccactccccagtagtttcttgagaaagtgaacttgggagataaattgctttgagattttgcatttcagaaaatggttttactctactctcactttgattattatttttgttgagtattctaggtagggaaaattttcccttaaaattttccgggcattatttcattatttccaatgtccactattgctgttgagaaatccaaagtcatcctgattattttaagcccttgaatgtgacctgttgtttctttacctgtttatctccagggttctaaaatttcatggatgtgcctccatgtgtatccttttcatttgttgtgctgggctcttgattggtcctttaaatctggaaatctatgtttttcagctctgaaaaatattctttgggaatctcattttctcctttttctttatttattcttctagaactccttctgggcctcatggattgatcttccagttgtctttttttcccccatgaacccccaaagagtttattttctaatagaataaacacattaaaaggaaacattaaaatgttttctctt

SEQ ID NO: 237865 - DNA, 367 bp, Homo sapiens
taagtcatacagctagtcaatgatggagctctagggtccattaaatgatactaggaagaatgttagtgtagctgtaacacttacaaaacacatgaacttggtgacgggtttttggttttgttttttacttgtctgagccgttattttcttctctgtaaagtgggatctcaatttcacaggagcattaagtgagttgtatagtgtctgtacgcagtaggcattcaagaattattatttccaaattaggtaatcaatgctatattttcattatttatcttcagtatatcattagtagtcaattccaacaatttattctataatttatagttaaatttaaataatctttcaataaaagaaattgattctg

SEQ ID NO: 237866 - DNA, 283 bp, Homo sapiens
ggacgcttaggcgacattaaatctacaaagagaatatttttctttcccttggcttactatatcttttttattactattttataaactttttgactcttatgtattaacacttagcttacaacacaaacacattgtacagctatacaaaaatattttctttcttggcaaggcatggtggctcacacctgtaatcccagcactttgagaggcagaggcaggaagatcatttgaggtcaggagttcaagaccagcctgaccaacatggtgaaatcccatgtccact

SEQ ID NO: 237867 - DNA, 603 bp, Homo sapiens
aaaggaggtgggaggatcacttgagcccaggagctctaggctgcctggagctatgatcacgcctgtgaatagccactacactccagcctgggcaacatagcaaaactccatctcaatcaatcaatcaatgagctgaaaaaggttgcctctgaagaaagggaaatgtgaggcaaggagtaggggactgctgtttttcataataagtcttatagaccaatttaactctttaatttatgtgtatgtgtgatttcatataaagataaagctaaaataaataagatcagaacttaatgaaacaaaaaacaaacaatagaaaggataatggtcatgcctgtaatcccagtactttgggaggctgaggtgggcagatcacctgaggtcaagagttcgagaacagcctggccaacatggtgaaaccccgcctctactaaaaatacaaaaattagctgggcatggtggcacatgcctgtagtcccagctactcaggaggctgaggcaggagaatcgcttgaacccgggggtcagaagttgcaatgaaccgagatagcgccattgcactccagcctgggcaacagagcaagactccatctcaaaaaaaaaaaa

SEQ ID NO: 237868 - DNA, 513 bp, Homo sapiens
cttatataaattattaatagtctgccaagcaattgtctcttatattattattcaaacttttcttggctagtcttagccttaaaatctttcatacaatcatttggaacaacttgtcaggtcacacacacatgcaagcacaagcggcacacacacacatgccacacacacacagacatacatgtacacatgcatgcacacacgcagactcatacatattgttgagattgttattaaaattgcacttattactatagattaattggtgatttcgtacaataatttgggagaaattaacattgcatttttatgtctttcgacgtgataaatctcctgatactcaaatgttctgttgtgtacttcaacaagtttaataattttgttcttatttaaaattcatgtaaatctttttctggacttatttcttcatattgtatagctgatgttactatcataaattgcatctttaagacatttatgttttctaataaattgctactattccttgtgaaaact

SEQ ID NO: 237869 - DNA, 554 bp, Homo sapiens
cgggtggatcacctgaggtcaggagttcgagaccagcctggccaacatggcaaaaccccgtctctactaaaaatacaaaattagccaggcgtggtggcgcatgcctataatcccagctactggggaggctgaggcaggagaatcccttgaacctgagaggcggaggttgcagtgagctgagagtgcgctattgcactccagcctgggcaacaagagtgaaactccatctcaaaaacaaaacaaaacaaaagaaaaaagaaaaaaaatagttctttttctagaaggaaaatacaaaatttctaccaaattataagatagaacaataacatttcaaagaaattttgagcttggcagtgaattaactctctctccttagggaccgtttggcaagaaagttaaaaccccctgattaaagttgaaagggcttgtctgggcgcagtggctcacgcctgtaatcccagcactttgggagcccgaggctggcggatcgcctgagctcaggagtttgagaccagcctgggcaacatggtgaaactcttgtctctgaaaaaaaa

SEQ ID NO: 237870 - DNA, 461 bp, Homo sapiens
gtttctccgggattaagcgagagtcgcggcggaaaaggcccagccggaacgagatttacggcgggggagtcctggagcaggaagtgcgcatgcgtagatggagcaaaaccgcctctccacccgtctcccttcaccatcgacccttgggtccagcaaggaagccctaagtgacgtcaacctttgttcccatggtaacgcagaaccttggggcgggagcaggggaggggctggcgcgcgccggaaaaccggctcagttgacgctgcaggtaaaaagacttcctgtttttttggaaaaaaaaaaaaaaaaaaaaaaaaagtgacccaaaaagctacgaatagagacgacttatcgaaggatttaaaacagtatttgaactgatgcaacaacatattagatgaaaggtaacagaaggttgtcagttcaaaaattacaaatacacacttctattggaatctccacg

SEQ ID NO: 237871 - DNA, 463 bp, Homo sapiens
tggtatctgcctttatgtattcttctcccctcaagcttgagtgagacctgtaacttgcttctaaccagactatcgcaaatgtgggaattttgcagatgtcattaaggcccttaactaattgactttaagttaatcaaaagggagattttcctgggtagcaccaggtgatcccttttaagaagggtctggaggtaagacttaaagctgcagacacttctgttggtggctttgaagaagccagcggccatgagttctacaactgccagaaaatgaaacccgcaacaacctgagtgagcttggaagcagatctttccccagtccagcctttgatgagaatgcagctcagctagtgccttgattgtagccttgtgggaccctgagccaaagacctagctaagcctgccccaactcctcacaaatggaaactgtgagataataaatgtattttgcttaagacactaag

SEQ ID NO: 237872 - DNA, 385 bp, Homo sapiens
tctaagaggtgatcaaacgccagctatggagagagatgcagaggaaagcgaagacatatgcactggcatttgtagaagggcctggatgggggtgaggagcacacggaaaatggtctgaggccatctatgcagttcctgaagaagcacctcgggcagctactgacactcccagcccagctctacaggggtgggtacatgggtgggctgggaacagggtgtctgtccaacaggcgggtgttgagggcccagaagatgtcagggtagcaacaggaggaatctggtgcagtatgagcacacggccgtcagctgatagtgggaagccagtcaagtgccgcgaaagcaggaggcggggccgcggccaacgtcattcccgcggccgcacgtc

SEQ ID NO: 237873 - DNA, 510 bp, Homo sapiens
ccaggctaacaatgcagcaaggatagtaaagcattttacccctcccaaaacaaactgagtattctgacttcaggcttatgtccagctttttagctccgaaacccccccactcactgcacagctgtgttcctttcctggaatgcagttttctatcaggtagcactgagggtccgaacagttcacgtcaaaactatcaggaaagaagaatgaaaaggtaaattaagagaaggcgggcttggctgggcggggtggctcacgcctgtaatcccagcactttgggaggccgaggcgggtggatcacctgaggttaggagtttgagaccagcctggccaacatggtgactccccgtctctacaaaaatacgaaaattagccgggcatggtggcaggcgcctgtaatctcagctactcaggaggctgaggtgggagaatcgcttgaacctgggaggcagaggttgtagatagagccactgcactccagcctgggcgacagagcgagactccgtctca

SEQ ID NO: 237874 - DNA, 519 bp, Homo sapiens
gtggtaagcctctttccatgaagccaaaattccaatgctcttacctcacatttatgaaaaagacatactctgtttttcattctttcttaaaatctttcctgtgttgcctcatagtttaccttcttggttgagaagacttggagactgtgaactatttttgcttggagcaacaatgtatttttattagcagattctaaatatagacttacagtttatcctcttgaccattttttttagtgccttcaagagtagctttcactatgggcccagccataccttatagaagggcacagaaaagccaggcggacaacaggtggaccttcaacaggagccgccttctcattttaattcttactctcatggcatttatgatgacaaattttactgattagttccctcttgaggtgttatttcaactaccgatggtttctttctagttagagaataacaaagcactgcagcaaacagtcttgtttctgttgaaagttgccactcatgcagtccactgagtgcctcagc

SEQ ID NO: 237875 - DNA, 900 bp, Homo sapiens
caatgattgggtcctacagcaaagtatgcaagacattttcatttttgatatgcagatttttaataatacatcaattaaaaataagttggataaaaaaatccaactcttgattggccttagagacttgagaaattctgttataggcctcccaagggcaatagaaagctgtcttatttttgtaccttcaaagtaccttatactaccctttacccaaaggatgtacttactatcagcttttcaatgaggttgtccctgactggccaaagttgtctcttaccatctcttaccatcaccttccatctcaatttgtttcctttgaagaaaatatcactatttgaaaactactttgtttctttatgaatttacttgtttattgagctgtgtatgagaaagtatctgttcttagcattgtatccccacatctagaatgtctatggcacacaatagatactcaaatgaatgcctgaatctgtttaactgatttataattagagcaagtcaaacaacaataattaaggttgccattagaataaactggaaatctattctaatggcaactctgttacttaactgtgcaaccttaggcaaaccttttaaacctctctgagcctcaatgttcttatctattagtagaagaaccactattagcactgctttccttataaaaggttaccatgagagttgaatcataaaatgtatatgtgcataaatatcttcatagcctttttggaagttaattgcgaagggaatgaatgaatgaataaaggaaacatttccaggccacataacaacaacaaaaatacaagaaatacatatagggattgagagtaaatttaatcagcacaaatgaatctcagtgggtaaattatcatatttagattaataaaggctgagtacagt

SEQ ID NO: 237876 - DNA, 284 bp, Homo sapiens
cttatcaaaatttgggaaatgcaataaaaaggagtgcaattttgcaattaaatacatatattagaaaagaagaaataactaaaatcaattacttctgccttaggaggccagaaaaagaagagcaaactaaatccaaagtgaggagaagcaaagaaataataacaattagagcagaaatcaataaaattgaaaacatgaaatcaatagagaaaattcttgaagccaaaagatggttttatgaaaaaaaaaatcagtaaaattgatgagtctttcatgagctaact

SEQ ID NO: 237877 - DNA, 1198 bp, Homo sapiens
tgactcggcagagagctgcaccctgagccagacctcagcagctgggtcctggaggcccccaagcggcagctgcacgcacctggcttcatgccaagctcctcccgcctggcagtggctgcatctgcctcccctccaccctgagtgtcccaagtctgcccgctgtgcattccatggggccagcagctcggtggagcctctgctctcgggggctacagctgctcctagatgcctctgccaccgagggtggaccctgcagtgctggctcctagcctccctgctgattgcttcctgaagacctggggccctgggctgcagtggttggggagaggggggtgggagtgagaagctggcactgtccgtctttctggcctcatcctctccatggtctcagcccctggcggcctggactgcaccgttccggagatgctgcctccccaccaagtccctttagcccaactgtggtggcggccgctgcttctcacacgcgggtcctctcactgcctctccccggtcctcccttcctcccagcaccttcaccagctccccactgagtgccctccaatgttggcgaccctgacccttgtccagccaggggtgaagggcggcaagggatgggctggagggtactaggagcaggtggcggtgcccttctgtcggtccacacccggcaagtggcgggaaaggtgtggaatgagtcagccgtggaggggagccctgggcctggaagacccctgtctttggcttgagaatgactttgaagggctcagggggtagggagctggggggagaccgggaggagagcggcaggtctggctctaccccgaggcttcaggctgcggaccatgcgtggccccagctctgtctgggcagcaggtgtcagcgactttgggttgctgtgggaatttgctccgtttatcagaagaaaacgcaccctggcaacacaggcccctctcaggtcaccaggcacatctggtcacatctgagtctcagataaacaaccaatgatgtcctggtgaaagcttgtcccgtgggacactcgggacacacttatattaaaacacgattaacgatctcaaactcagatgttactgggtatcctgcgtttttgttggcagctctgccactctgcccgtctgcctgagtcctctcctgccatcctcctgaccagaggcgtgggcttgagttgagactacgcagt

SEQ ID NO: 237878 - DNA, 539 bp, Homo sapiens
tccaaataagatcacagtctgaggtacggtggttgggcttcaacatataaatttgaagaatcttaattcagaccacaacggggtctcacatgtctcaggtgaatggactgaatctcagcctgcagttcaatgggatcacatccatgtgaatctgaattgcagctgtgggttgacctcagccagttggctttggctctcctctgcccagttatttccaggagtctggaagaatctcaggagagctcagggaacctggaacaaacacctactgctggcccccactgctgccactcctgctccctcctgatggcagggtccctgtctcccccagtcacagacacgcggatgagcccccatctgcctggctgacccactgcctcctgagcccaagtctctttggctgaggccccagtacacaccaacaccattttcaaaatgactccttcacaatttctctttaaggccagacaccaaagtcccccagacctgtctctggaacaaatactcttatcttttgtacttgaactaacctttaaaaa

SEQ ID NO: 237879 - DNA, 432 bp, Homo sapiens
tcttaagggactagcttactaagaggatcctgaaaagtatcctaaggaagaagagcttgtgagagaataagtaatggtaagcaccatgatagaagtatttagtcaccttcttgaaagtacagaggcaaactggaggcagcagccagattgtaatgaataaaagggatgttgaagattatcttgtgagcatcttgtcagagaaagatagttggtagcaagaactgaatgtggagttggaagaggactaccatttttcatttttaaaaaatcctccagcctgggcaacctggcgagacattgtgtctacaaaaaatacaaaaattaggcaggcatggtggtgtgcacctgtagtcccagctactcaggaggctgagatgggaggatctgagcctgggaggtgggttgcagtgagctgagattacaccactgcac

SEQ ID NO: 237880 - DNA, 327 bp, Homo sapiens
tggctggggcactagctgggcctctgataatttcactagccttagtaacaacttcagtaatgacatgggtgccgcttcttctgtgggaaacaaaagaaagaaatgacctgctaggaatggagtgttgattcctgaatctgtagatcagtaccattccatagaactttctgctctgatgggaatgctccttatttgctctgtccaatatgggagcccctggccacaggtagctaatgagtgcttgaaatgtggttagtgcaatttaggagctaaattttacaactgatttagtttgaattcattaaagttaaaatttaaatagccata

SEQ ID NO: 237881 - DNA, 426 bp, Homo sapiens
gagcagcagtttgtcctctctcatctaaaccatgtctgtcagagttggattaaattggaacatggataagtctatgagcgggatctttgaggatcacaagtgactatacactagaattacctgcaagctctaaagagtttctgctcttggctgggcatggtggctcatgcctgtaatcccagcactttgagaggccgaggcgggcggatcacctgaggtcaggagttcgagaccagcctggccaacatggtgacaccccatctctactaaaaatacaaaaaagctgggtgtggtggtgcgcatctgtaaccccagctactcgggaggctgaggcaggagaatcactggaactggggaggtagaggttgcagtgagctgagattgtgccatactccagcctgggcgacagagcaagactccgtctca

SEQ ID NO: 237882 - DNA, 469 bp, Homo sapiens
agggtgttgattgtgtatagatatgaaaggctgaaatcaacctgtgtctctaaccaaaggggagtgttgaatgaattatactagatctatatacaatggaacaatagtgaaatattactgaactgcaggactgtacatgatatattgttacatgagaaaagcaagttgaagaataatgtatataatgtgatactattctttgttcaataagtataagaagaaaatgattaaaaatgtggatgtatgtatgtatatagcacaatattatatatgttaaaatatatatacataatgagggaagatgcacccaattgttaataatggttatctctggtggtacagtattgaagaggaaagagtccggattgttaaccctgtattcacttctgtattgctagatctttaaaattaatatgttatcattttatggttttaaaattctagtaaaaattttttatataaaaataca

SEQ ID NO: 237883 - DNA, 389 bp, Homo sapiens
aaggaaaattgccaggaatagagtggcattacataatggtagaggggtcagttctctaagaagatagaaaaatcgccaggcccagtggctcacacctataatcccagcactttgggaggccgaggtgggtggatcacctgaggtcaggagttcaagaccagcctgaccaacatggtgaaaccccgtctctactaaaaacacaaaaattagccaaatgtggtggcacaggcctgtaatcccagctatttgggaggctgaggcatgagaatcacttggacccaggaggcagaagttgcagtgagcccagatcacgccaccacactccagcttgggtgacacagtgagactcagtctcggaaaaaaaaaaagatacgaaaatcttcaattag

SEQ ID NO: 237884 - DNA, 2007 bp, Homo sapiens
  misc_feature (95)..(95): n is a, c, g, or t
  misc_feature (255)..(255): n is a, c, g, or t
  misc_feature (533)..(533): n is a, c, g, or t
  misc_feature (877)..(877): n is a, c, g, or t
  misc_feature (897)..(897): n is a, c, g, or t
  misc_feature (907)..(907): n is a, c, g, or t
  misc_feature (933)..(933): n is a, c, g, or t
  misc_feature (982)..(982): n is a, c, g, or t
  misc_feature (988)..(988): n is a, c, g, or t
  misc_feature (1003)..(1003): n is a, c, g, or t
  misc_feature (1091)..(1091): n is a, c, g, or t
  misc_feature (1250)..(1250): n is a, c, g, or t
  misc_feature (1625)..(1625): n is a, c, g, or t
ttttttttctatgtatgtgaagtggtaatagtttttctcgtgtatcaggcaactaccaacttattttagaccagaaattcttggaaatggtaccnatccagttggcataaaatgtgcaagcactattctattgattcctcaaaaagatgcaattgctttactcatagagttatcagttatttttctggctatttcacttgaagtagccatgctttgtctttttttctatggagatacgtggccaaaactaagtcntttcaccagctggatgataggaaatttgataaaatttgagcagtataaaaactttcccattgactttatatgattgaatttccactatgtaaaattaaactaattatttcttatgctacccaatatatagtttattatttgaaaactatgtccccatttttcctcaagaacatgattttgtcttttgcatctcagtgcaggggttggacagcataatttcttctcctagaaacacattttctgctgcttgtagctactatttctattttttcatcaanagctacaggagtaagtggagttcctgacatctctgtgtaatcagtggtatgatcacataccccatattgactttttcttttgaagtttatgctgctgtctcttcagtaccttgagcttgacctctagctttaagcagtaaaggtatcaaagaaaatcagttgccagagtcagtctgtttgcttgtgtcctcctaacccactgatggcacctctgactccttgacattgtattatttgtttctcagagaagtaaagcaattttttttttcctctgtcacccaggctggaatgcagtggcgggatctcggctcactgcaaccacctcccgggtttgagtgattctnatgcctcagtttcccgagtngttgggattntaggtgcctgccaccatgcctgactnatttgtgtatttttagtagagacgaggtttcaccatgtgggtcaggctngtctcnaactcctgacctcangtgatctgcccagtttgccctcccaaagtgctggtatcacaggcgtgaaccaccacacccggccaaagcagttttttttacatatagncatttaatatattgactttggttgattcttacctcacttccaagataattgtttctgttaaattacatgtatttttaggcttgagtcatccactatatttatgagttggtcatttctttcatgagttgagcttgtttttaaaagttctacttttaaagnccccttctgtctctcctgcagccactttcactgtaacatttatcatgttattcctggcagccagtcttcttaactctccatcattacttttggcaggttacagcagtatcacttagggttctcttagttcatttttaatgaacatccaaaagatgctcctattgcaataaaaccataagaaaagattaatagaataagggtttattctattaataggcaatttggggctgctacagtggctccatgataccaatggttctgggctctttcttttccgctatccttagtatatggccttcttcctcctgcttgcaaaatggtggcatacagaagcctttcctacatattccagaatatgaagaaagacaagggggnaaagggacgtgccaactggttaaacaacaatcaccatatcaaagacccacccactagatttcttcttcttactggccagaactttgtagcgtgcccaccctctatacacaacaggctgcaaaggaggctggaatatcacgttttagttgggcagtgactatccagtgcaaaatccagattccgttagtaaaggatgttgatggagtggatggatattaaacagagattcaactttcctgttcagaaacgtgttataactccatatattgctttaattctatctatcctagatagacttacaaggctagaataagacctttagaggcactaaccaaccaccaaaaagaggctaatcacctcccatatgtaaatcaaattgtac

SEQ ID NO: 237885 - DNA, 416 bp, Homo sapiens
gaatcattattcagaaacaaagagagctaactgttatcctgactttattctttatgaagaaaaatacagtgattccaagttaccaagttagtgctgctttatttataaatgaagtaacattttacaagttgtgcataagttaaaattcagaaataaaacttcatcctaaaactctgtgtgttgctttaaataatcagagcatctgcctacttaattttttttgtgtgggtgcacaatagatgtttaatgagatcctgtcatctgtctgcttttttattgtaaaacaggaggggttttaatcctggaggaacaactgatgtacctctgaaaaagagagggattagttattaattgaattgagggttgtcttgtcttagtagcttttattctctaggtactatttgattatgattgtg

SEQ ID NO: 237886 - DNA, 425 bp, Homo sapiens
taacattaggagaaatacctaatgtaggtgacgggttgatgggtgcagcaaaccaccatggcatgtgtaaacctatgtaacctgcacattctgcacatgtaccccagaacttaaagtataataataaaaaaaagacattacattttatactactactaataagcaagttttggatttgggttaacatagttttatgtttggaaagcagacaattggaaccattctcatgctggtttagtgtgtcttgcaaccctgtgacatagcactttcttccggttaacagccactttctgtttaaacacagcttcattccctaatgggttttggtctttagggattaaacccatgaggaccattaacctgaggaatgtaactcaattagctgtaaatgatttggaataaaggaatagattttctatttggag

SEQ ID NO: 237887 - DNA, 346 bp, Homo sapiens
ctgaaatgaacattatgtaaccactaaaaatcatgattttggagcctgtgatatgtggggaaaaactgacaagtaaaaaagtgggttattaactgcacctgcttactctaacgtgaacgcatatgtgaaaaatctgaaaggaaaagcacagaaaatggacgttttcattgaaattgtcggtgatcttaattttcctttggtgaatatattgctctcactaagggcgtttaaaaaatagttcacaggttttaattttttagatgaaatggacccacagttttctgtaagagaaaggagagattgttatatttgctacttagaataaaagatttttagccaacgttgt

SEQ ID NO: 237888 - DNA, 484 bp, Homo sapiens
aagggaacaactgagttgctctgggaaacctccctgtggacctcagaattccagatttttggcgctttgaaataaaattttattcttgcttagcgttctttccccgaacaagccggtgagcttccagcatctgtattttctgaatccggcagataagaaatgcttgagccaggaccgattgattagcagcggtttagagatcttatctgtcaaccgcatccgtagaaggagatcgttattgccataattggaataccggtgacggtgtgacaagaggttttacttctggttaagctgaatgtaaagtgtgggatgggatcgttgggtttgatgtataaggtacggtccaccctttgtgaagatcgcctttgccagtttttcctctaggaaatatacagttagtgttttcaagtaccttctttcgtaatttttctactacagagtacaaaaaaattaaagacatctttttctgacgttaaagtaa

SEQ ID NO: 237889 - DNA, 634 bp, Homo sapiens
aagcagtaatagatgactcaaattataagacatgaggagaaaggggctaagaagtgagccctggggaaaactaacaatcaagggccaggcaaagcaagactgagcttctaaggagacagaagtggccagagaagtagagaagaaacaggagaacatggcatcagaaagccaagagaggaaagcatttcaggaaaggaaagtggttcactgtgtcaaaagctgcaaagagatccaataaagtaagttttaaagcattacagttttcaaaaaaataaagtcactgatgtccttgggaacactggattcagatacaatgagctgaagtgaagctgtgttggctgctgatggctttcatttagttctacttcccagtgaaggctaaatgtgccatggtgggcccaggagcccactggttctttaatataaattctcctttccaccatgaaaaatagttcttgcaataaaaaaaaaatcccagactctaaagcaattctgttagtacttcccttaagacattaattatctcctgttaaagttaggtacttgtttcatcatacagcttcagagaatagagaccatgtggcatactaaaacacccaacatagtacgctactgaaaacattaggcaagagag

SEQ ID NO: 237890 - DNA, 597 bp, Homo sapiens
gccacgcagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaagattctccccctcataaagttcttaaaggccaccaccaaagtgtcacttcattactctatccacatggtctctctttgtgggatatctttactgaagaaattttgcataaattctt

SEQ ID NO: 237891 - DNA, 453 bp, Homo sapiens
atttcgtgcttaaagctgttgcccgaggtgtgcgctttagaatacgttccacagaatgttattagatatttcttttaaaaagtttttttggtcatataaatttaggacacactaagttaagtactacccaagggtttctttcttgcaatagttctcagagccttggatataccagtattccagaaggaaggtaacattaggcgttgctcaaaattatttggccaactaaaccatctttgtttttctccagagatctcaacaaactactcttctactacattgtttgcaaagtacagtctcaaggaatatcatttattctactcaacagatatttattgagtacttactgcgtgtcaggcactaggttagatccagagatacaaatgtgtataagacagacaagttctgtgccctcatagatttacattatcttcatgaaagtccaacaacagt

SEQ ID NO: 237892 - DNA, 794 bp, Homo sapiens
tgtcaatcatatttattttccttttgtctatattggaacctcctcataaataataatttaaaacattttttgattccatggttcccctagtgcagagtagtcgaaagttctcttataatcactgcagatccatacaatgattccttccctaaacttttggctccttcacccttcacatttccatgtgattgaaaaagcaaaggccagggatggggcactgtggccacacctgtaaccccagcactttgggaggccaaggcaggaggatgacttgagcccaggagttcaagaccagcctacaaaacatagtaacaacttgtctctacaattttttttttagactgattcttgctctgttgtcaggctagagtgcagtggggtgcaatctcggatcactgcaccctgtgcctctgaggttcaagcgattctcctgcctcagcctcctgagtagctgtgactataggcgcgtgccaccacacccggctacttttttgtattttaggagagacagggtttcatcatgttggccaggaaggtctcgaactcctgacctcgtgatcgcctgcctcagcctcccaaagtgccaggattacaggcatgagccactgtgcccagccaaaataattttttttaatttttaatcagctgggtgtggtggtgtgcacctgtggcccagttacttgggaggctgaggtgggaggatcgcttgagcccaataggtagaagctacaatgagccatgattgcatcaccgcactccagcctgggcaacagagtgagaccctgtcccctcaa

SEQ ID NO: 237893 - DNA, 926 bp, Homo sapiens
  misc_feature (343)..(343): n is a, c, g, or t
caaaaagctcaacgtcttctggtgaggttactaaacagactcaaatttcagcacgaaccagagtggttggactaagaactcattttcaccagaggaaaacccattgtagaaactggtattgttgaattttgcttagggaccttgttgccggtggtgattttagaagtgtaaaacggggaagaatatggtgaatacaagttattggcattattaaaaaaaattccattcaatttcccaccatatttccccaaaattattggcaattgataagatttaaagttccattaaaaaaagagagagagagacaggatctcattatgttacccaggctgagtcctgggcnaaagtaatcctcccaccttagcctctgagtagctggaactacaggcatgcatcaccatgcatggcttctgaagttctttttaacatatcaactgcatcttgaaacaaataccgtttaccaggaaaatcacttcaaagatataatacttgcaggtcaaaaatattgtatgggaactgctttgagatcacaatcaaaaaagaacagaaagtttataccaagacaacccacacaatataaatcagtaaggatgactactgaacaaattactgactgtccaacctcattaaaaataagacaacagggccgggcacggtgcctcacgcctgtaatcccagcactttgggaggtcgaggcgggtggatcacctaaagttaggagttcaagaccagcctgaccaacatggagaaaccctgtctctactaaaaatacaaaaattagctgggtgtggtggcacatgcctgtaacccagctactcgggaggctgaggcaggagaatcgcttgaacccgggaggtggaggttgcggtgagccaagatcacgccattgcactccagcctgggcaacaagagcaaaactctatctc

SEQ ID NO: 237894 - DNA, 236 bp, Homo sapiens
ggcaatggtgctttttctttaagagatagggtcttgttacattgcccaggctggagtgcagtggctactcacaggtgtgatcataccttatttaattcctggactcaagcaatcctccaacctcggccttttaaatagctggaactacaggcatgtgccattgcatctggcttggtaatggtgctttaacatagtgtccttatgtttaggactcagtttccctcctgcgtgccacc

SEQ ID NO: 237895 - DNA, 404 bp, Homo sapiens
ttccatccctttaatcctggagccgtgagtcctggctatgggagaaacagtgccatatatgggatgctgattcagagcatacacagtcttctggagaactttaccccaggtctgcaaagtattgttacctagttggcattgtaattgtgacttcaaaaggccgttccatcattttatcaattcagctgcttcaggatgacagataacatgcagactacctggtcatgtggccacgttctcatggtgatgtcagagggaagagtgccagcagaagtactctgcttagatcacatcttctatcatccccttgtccaaaatgctattcttggttcctgatctggtgttgccatcaacatgctaattgttcctgtacacttgcaaactcattaaacctgagaaagcca

SEQ ID NO: 237896 - DNA, 526 bp, Homo sapiens
ttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctca

SEQ ID NO: 237897 - DNA, 1617 bp, Homo sapiens
  misc_feature (1444)..(1444): n is a, c, g, or t
  misc_feature (1597)..(1597): n is a, c, g, or t
cctgggtggcattttttatctgtccatcctcagtattcaagatggaattactgaagtcaagtctgcaactgaggatacccacctgagtgaagagtaccttgacaactaagtggtcagctgtttcatggctgagatcaactgcagttatagaaaggacacccgttgagaacaagcaggctgcccaagccccttctgcctctactgaatgtgctcttcattctggtatcgaggccaatttgagattgagtccctccatgaaggggttcacatctatacctctgtgcacatgagcagctggaagaatcaaaagccaccccagtccctggcaccctacacctgtggagaaagccataagcaatgtcacccagacatatcaccagtccttcacgggtggctctatttatatccccaagatttaaaatctcttatagggccgggcatggtggctcacacctgtaatcccagcactttgggaggccaaggtgggaggatcgcttgaggccaggagttcaagaccagcctggccaacatggtgaaacctgtctctactaaaaatacaaaaattagccgggcctggtggtgcatgcctgtgatcccaggtacttgaggggctgaggcactagaatcacttgaacttgggaggcaaaggttccgatgagctgagattgcaccactgcactccagcctgggtgacagagtgagacttatctccaaaaaaataattaataaataagataaagtctcctacaggaagaactagaactgaatttatttacaggcagtatgatcttgtatgtagaagacctggaagaatctacaaagaagctaccagaataagtgagtttatcaaggtctcaagatcaatgtataaaaacggttatctttcgttatactgcaaatacacaattggaaaatgaaattttaaaacttctgtttatagtagcacccaaaacttgaattactcaggtttgaattgagtgattcaactattccagaataatattaattaatcaattggagtaatctgagcaagtaattgttctttatttcattccccagtctcactgtgggacatcttttttggtgttaagtcttctgcatgagttatgaagcatacctaaaaggtctcaaactacctttctcagagttttttctcagcatcccgaaggcagttcagactcgttggattatgtcaaggttatttagaaggggttgagagttcaccctgccttaggctcagcatagtgctggcattatacataatacaaaagaaaagtaagaattggtcctgcccttcagccagctttacagtcttctaagaaaacagatggaacaggccgggtgcggtggctcatgcctgtaatcccagcattttgggaggccaaggagggcggatcacaaggtcaggagatccagaccatcctggctaacatggtgagacccngtctctactaaaaatacaaaaaaattagctgggcgtggtggcgggcgtctgtagtcccagctactcgggaggctgaggcaggagaatggcgtgaacccgggagggagagcttgcagtgagcggagattgtgccactgcagtccagcctgggtnacagagcaagactccgcctc

SEQ ID NO: 237898 - DNA, 237 bp, Homo sapiens
cgggtgagggtggggtaagaggcacttactgtgaggccgagctcccgcacgaattagcctcacaacaggacctaggtctcctagggagacgaaactaggccagcgaaatcgcggccagggagcccctggcccccactcgggagacaacccgcccggcgcgaagggtgcgtctcctgagctccacgccgggagctggaaggcaggcagacgcgcgaggcttgggaagggtgggatctt

SEQ ID NO: 237899 - DNA, 494 bp, Homo sapiens
cagtactgtgatgaactgagggacagaggacacccacagctcccagaaaggggcagcctcctggcggcagtgcccctccatggctgacctggacactaggggacaggcatgtctccaaggcccctcggagaccttgaggctgagttggctgccataggaaactaacacctcccggggaggaccgcacccagcctagagtacctccgtggtgctaaatgagaaaagagagccaagcccagacttctggtttcctgagggctgacctatctcttgagggacagacaggactgctgggcccacgggccccatcatctggtgcaatgagaccaagagtcaccccactggagacagatggaggaggtctttggctcctttgaggctggcatgtactcttgcatgttttgtgtgtacacttgcgtgtgcccatctagctgtataaatctaagagtgttcacagcacattgacaaatgggttggtccgcatgtgtacagcc

SEQ ID NO: 237900 - DNA, 349 bp, Homo sapiens
ggtccctttctcctggtgccaatggtagagttggggagaaagttcccgatagagagcataggaggaaatgcgccacgtgtgcttgccttagagacatatgtgagttgagctctctctctcctctctctctctctctctgtgtgtgtgtgtgtgtgtgtgtgtaggtggcgagtggagagggttaaggctgcttctttgctggggggaaaagaaaggcaaaagtgtgaggatacacagagcagggaacgagtggagtcccctctccaccggggcagtgtgagaacggagggcgtgcagtcagggggtcctaggacttgggtgggtgctgcagaagtgaccaggagggctg

SEQ ID NO: 237901 - DNA, 643 bp, Homo sapiens
  misc_feature (643)..(643): n is a, c, g, or t
agtgatacctgccacacctgctggatgagagctggctccgattttggtattttaaactttaagaggcttttggagattatctctactttcactcctattcccagattataattaagatttattttttattttttatctatttattttttaaagatgtccctcttgtgtgttcattttgaagttttagaccaagatgaggttgtgtgtgggctcagcttggaaactgatctgaaattattctaatttatataatgtaatgtaaacagtttcagccttaccatacgtcagggctatcgtttcatgtgcacctttgactaggggctggggcgtacttttccagtttctgactattttaaatgctcttctgagcagaacgttgagattactgtcttccctctcactctgacagagggacatcaaatgtctgcatctgatcttttaacagcttgtgcaacaagagtgaaactcttgtctcagaaaaaaaaaaaaatgtatgcaactagctgggggctgagacgcgtacctgtagtcccagctacttaggaggctgaggtgggaggatcactgatgctcatgagttcgtgaccagactaggcaaaatagcatgacaccatctcaaataacacaaattcactggccggcn

SEQ ID NO: 237902 - DNA, 180 bp, Homo sapiens
aattgattttctacactgccatgcccatctttgagtggtgcctttgctttagcctttctttgcatgcccacaaaccattcagcatgcatgcccctgttctgagcccataaaagcccccacccagccacactgggagagaaaccaccagacttcaggggtggggaaccactacctcctccg

SEQ ID NO: 237903 - DNA, 2475 bp, Homo sapiens
tgttccatgctctctaggtgtgcctctttcaatatttcctgtccttttcgccactgctcataaatggtttctaatcattcttataattgtaccttcttggagccttgagagacaggcacaggttctcttacataggctattattgatattggttgcttttattttccctccaacccccactccagataacaactgttgagtgcgtaccatgtggcaaacaatgggaatgaagagattaatgagccctcaaagaattcatgatttacgtagcacatacttctagctaactgttctagctacaccagccagttctagagaggtacccatggaggttttggatatgtgcttaactccttgaagattcttctggaatgatgcctaaagtaattgtcaagagaagctatgctaatcttcctcttcagaatattcccatttctttcttagttataggtatgaggagtctaaaatatgctttaacatagtaagcttattgttataactggaaccatgcaaaatcttaatttcctataatataatttcttgctcctccaaagtcattcaaatattaaattggacttattctatatgttgcttagtggaaaggtatcacaaataaaaagtgggccacaatgagtaggtcaattaaataaatgcaaaaaatatattgatttattaattacaatataatactgtgctaaatgcttagcttgcattatctcatttaattcttaccaaaactctttgaggtgattattgtatacactcccatttacagatgaaaaactgaggtttaaggaaaagatgtgtatgcccaaatttcttaatgactaaatggcagcagaccaggactgtcttgactccaaagaacatgttctaatactgtacagcttcagactccttcatgagagctgtgatgctcaataatatatgtcaggatatgaatacttagactcatgccagaccatgtcataagccttagacctttttcatttgtgtttatagatagtgaccttttagtgcagtgacaatttcttaccacacagcaatctgcatgcaaggaattgctaatatctgctttgctcagaaggaagcttgtatgtagcattaattatggcaccattaatccattcagttatttattgaaactattatttgttgagtttctgctacatgcttggaagtttcatgtgttatctcctttaaactcactgtaaaaggcatgaggataccaattttctatatctgcagtaattttcccagggttacgtagctcctaactggatgtagtgtcttggattcagacccagctgtttgtctccgaagtctataccaaactaccctggtagtttagagcttatgtttaccagaaatttatgtcccaccagcacgtaatttttaaaccaactctgttgaggtataatttaaataaatgaaatgcacatgttttaagtgtgatacatttggtaagatttgattatgtatatacccttgtagctaccacccccactcaaattatacatttccatcactcagtaaattgctttgtgcccttttgcagtctctcttactccttgccccaggctaccattgatctgatttccatcactgtagactagtttttccaattctagaagttcatataaaaggaatagtacagtatatactcttttttgcctgattttttcacttaatgtaaagttttgtgagattcatacatgttgttgcctattcaatagttcattcttttttattaccaaataatattccattatatcacacatcacatttgtttttccatttgtctcctgatgtgtatatggttgtttctagtatggggtgatgttgaataaagctgctatgagcgttcgtatcccagttttattggctcatccactgttgtccaaaagaatttcttgaactctgcatttgtcctgaaggattctctgattgttcttcatacaagaactctaggaatataacatggaatccagctaatttctgaaactcatgtatttaattatacatttacactaacggccgtgtgcactgagaaaaatcctcctgattaatggcattgcttttagagtcagtgatcttttatttctcatgcaagtcatagtcaccactgtcagtcaggcttctcagttccaagcaactgaaaccaatcctggctcccttaaaaagtagatgaatctggccaggcatagtggctcacgcctgtaatcccagcattttgggaggtcaagccgggcagatcacgaggtcaagagattgagaccagcctgaccaacatggtgaaactctgtctttactaaaaatacaaaaattagttgggtgtggtagtgcgcgcttgtagtcccggctacttgggagactgaggcaggagaatcgcttgaacccgggaagcgtaggttgcagtgagccaagatcgcaccactgcacttcagcctgggtgacagagtgagactccatctc

SEQ ID NO: 237904 - DNA, 118 bp, Homo sapiens
tctactttttttttttctcacaccaactggggaccactttccccagtaaagcctgccagaactttgacactagacatttaccctgaactccttgcttcctccaccccttcgctttagc

SEQ ID NO: 237905 - DNA, 533 bp, Homo sapiens
gattacaggcatgagccactgtacctggccaattatctcttagagtctttcacataactgcaacatgatggtggttggaaaaagagtcatccaaagctcaactagaacgcacgtccgaggtggcttcttcattcatgttgtcttgtgtcttagtagatggaatagctacaaactagccaggaaacaatctctgtcactctccacgcagcctctctacaggactcacttgggcttcctcacactatgatgccttcatgacacttggacctctgacacagggggctgcattcccccagaacacccatttcaagagcaagtattccaagaggttggaaacagaagctgtcagtccttctaaagtctggaactaccacaaggttacttttgctgcattctattgggtaagcagacactgggccacacagattcaaagggaggggaaataaactctatggggagaatgataaagatttttgcagccattttaaattcattacaatgactatgaaacatttcctaggtatattaagtgg

SEQ ID NO: 237906 - DNA, 382 bp, Homo sapiens
tattgtgttctaggagtttggcacaaacaggagaggaatgaggtggaattttttgaggacaatcaaatcatgttgttgttggttaagccctctctctggtgctagcaggaggtaaggtggaccagatggccctgatgatgctggttctctatggccacatacctttggtggctctgtggtcatcttgatgctgacctgcaagattgagatagggaagtctgggtgggggatggagctgagccagaggcggaaggatggatgaggatcctccacctgcagctgctccaccagcttgtccagattaggcatccaagacagtgacaggtggcagtttgccaggaacacccagtgtccctgagtcacacccttctgtcgtcttctc

SEQ ID NO: 237907 - DNA, 526 bp, Homo sapiens
tgaaattgcagaaagcactctcatgatgtttttaaaaaaaaaggtgtattggtctgggcatggtggctcacacctgtaatcctagcactttgggaggccaaggcaagaccagcatgggcaacacagtgagacctcatctctgtttaagaaaaaaaagtgtattcataatttggtgtttagattagtttaattttaatgtagaaatcaggccaggaaaatctaaactccacttgacttcagcctccaaagaagtccacatgaacatagcaacataaacaacttaaaagggggaaaaaaacaatgctaagtggatatataatggttttgcttttctccccagggcaaagattatagtggaatgagaaaaagaacagaaattaatatagtttagatcttgctaacttactgctccagtaaaactgtcatctttcaataatcagaagcataaaatcttctagggttaccaattttttcctcatctgtttctgttccatgatgacactttaacacttaagagagaaagaag

SEQ ID NO: 237908 - DNA, 490 bp, Homo sapiens
tagggaccctcggtgaggagcagagctgagcctggtgcgtcgccctgagcaccctgcctgcctcagcctcaggagcctttgactcatcggccagcacctgcgtgacctgcactgtgtggtcaccaccctcggggactgaggccccacgaggtgatgcccccagcttagccttgtctcatgggtgctcacacctttcacaccagcagggggtctcctggctggtccccaggacctccctcaacaggttctcgacacagacatcgaggagcacctggcagtgggtatggtagcctccagctctcccacctgctccacttctgtgtattttggaaggctggagactcctaaaggtttcattcactgctcgcttcttcatgcatccaacaaggtctcccggcttccagctcaagatggcggattgaacatgggcatttgcttcacctttgccttgaactcactaaaacagcagtgaagccattttttaaaggca

SEQ ID NO: 237909 - DNA, 453 bp, Homo sapiens
caggtgttgacccaaagtattttctctcatgcctggccactctgccctggaccctcaacccagccgaatatgacacatctccagaaacccagcaggcgcaagccgcagggttggccttaaaatcctgcttaaacaggagaccctggaggcctgcttcagtgccaccagcctaaccgccagggctcatcaaagacgctgcccagatgcattgaacgtaagcaagatcagcaaaggtttatctcaacttcagactcactcccagaaactcactcttgggagctctctgtggaattgggccccccttcttctggtattatgttttcaaaactgacagggatatgaaagaaaaacttatccaggaaagaaaattgggttgaacatttaacatctcatttaagtcttgcaataatggctatatgtatttttgctaaataaatcttctattaatctttt

SEQ ID NO: 237910 - DNA, 484 bp, Homo sapiens
tttattgagatataaatcccatactataaaattcaccctttaaaagtgtataattcagtggtttttagtatatttgtgcaaccatcacccatatctgattccagaacatcatcatcctcaaaccctggaagaagcattatttttacaacttaattttacatctatgtagattggcattctctccctaaaattaacctcaatcctgattttatagtaagtacttcttacagttttatcacccagatgtacatttccggacaccattatccctgtggccccctcttcctctacacttttgagtctgtctttataagtgccccttcctcttcctaacagtttatttgttggagaacctgtaggattttccactttgggaatttcatgattctgtattcatgctataatttaagaaaagtatttttcaatatagaaaagtaatcaggattctactttaaatacccaaaataaaacttgtttctgttaa

SEQ ID NO: 237911 - DNA, 701 bp, Homo sapiens
  misc_feature (295)..(295): n is a, c, g, or t
  misc_feature (431)..(431): n is a, c, g, or t
  misc_feature (496)..(496): n is a, c, g, or t
  misc_feature (633)..(633): n is a, c, g, or t
  misc_feature (690)..(690): n is a, c, g, or t
gtgataaacagccattccagccagggattttaagaagctggcggaccaaatccatttctcaacccacttcaacctaaaccactcaaagtgttcatgcagatgggagggagggattattgagcgctgagcaaaggaagctagcatgtactcatcattttccaaggagcccagtggcagagctttcttttacttgcatgtcatggggagcaggaagtgggacccaaagggaacagcatgggcaggagtggtggtgagaactgtggatgcaggtgcagtcccaccaggtacacacagnctgccccgtctccaggtgtctcaggctgccggcactaggaaggagaagctttgttctcagatggactaagtgcctcttcctgctccctaaagctttatgcctccacatcaggctttccataagatgcctcagctanaagctccatccctggggaccacccttgaggtctgcagtccatttcactgcttcctttccaaaggntacatatttgcttctgtgctcaggttagttagaagcctgatgaatcgggatggttccttaagaaactaagtagttagttttaaatcacagagaaatgaaaccaaactgacacgaatttcagtttcacaacctggganaactgtcgccttgctcgatgtattcccaagggttcacctggccctgggattcaggcntgccaagtggg

SEQ ID NO: 237912 - DNA, 422 bp, Homo sapiens
tacctctaaagagtgtttcatcttgaagaattctacatgaacatgaaagataacttaggtaaaatccaaacataactacattgacccaataaaatgacattaacttggaatgtttcaacaagagatattaatgcataaacacacttttcagctttctctttaccaagattgtttatagtttgtttgcttgttttttaaattgagaaacaaacaagacacacatttaaaaattagcactagcctcagtcaaagtcttctgtaatttgtgagccttatggatgatagtaaatcaggaagggttgttgatttaatgtcacaacaagggctagttttagtctgcttgactgcataataatcaacaatattcaaacaagcaaatattgagtgtgttatgaaaccctggtggtgagggaaagaataac

SEQ ID NO: 237913 - DNA, 450 bp, Homo sapiens
ctggccggtcggcccgatggcgatcgccaagagcgataagaggccttatctttggccaccaggcccggccgggttggagaacagcgcgggggcgccgcgactggggcgagtgggggcttggaacggcccgggttggggccggggagccggcgtccctgcgctggtctgtctgggggagttttctccccaaacacacttaattgccaagaagttgatcctcccctgtggccggtggtacagtccgtcaaaatgaaagaaaactggctttgccccggccaggagggggaagggggaggacaccccgccccgagtcctcgtagatggtgcgagaccgctagaggtgggtttgtcacctccagagggagagagggtgttttccccttgaatcatgctggtgttgctggtagttcctagcaagaaccaagtgtacactgcttggagttttcttga

SEQ ID NO: 237914 - DNA, 408 bp, Homo sapiens
attttatagtttcgctctatttgaggaacacctacaggtgttcagttcaggcatggaggaaatggggcaggcaagttagagggcaagcaagggaggaatggagcaataggaatactagaactgtcaaatgtgggcccttcaagggaccctaaagactacatgttagcccagtgcatttatttcccagaagatgaaatggctgaagtgtgaagattttagtgctctaatgagaaatacatgctctatttttacttattttaatgctgttctcattaattaaatacattgatacatatatacacacatatatatgctgagtgtagcaaaaaacagcaacagtaaatattattctacagtaagatatttttgtgtctatttttatgtctcttcaaaattgtgatattaact

SEQ ID NO: 237915 - DNA, 501 bp, Homo sapiens
gaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttgtcaa

SEQ ID NO: 237916 - DNA, 849 bp, Homo sapiens
aggaaatcagtatgggggcccaaaagaaatgaatgtaataaaaatggaaatcagggtctaacaatgattcaaatgaaatttttacccctaaccaactaattaagcctacaagtcgagctcagatttctcaacaggtccttgactgtgaactaagaaatcaaatatttgttaatgcagcccttccaaaaatgaaagcaagatttgtaaagcttgcctatatagtgaaaagaaaaggtaagaagttaagagtcaacctgaattatacagggggaaatactcttttttaaaaaatgaagacagagtgactttgagaagagtgaaagagaacccgcatttcaccaagaacagaatgcccagggatccctgctctagcgctccttcacgctccacatcaaccctgctaactataacagaagccttgaaactcaactacagaactgcgatcctctttgtcaactaagacttggggaaagtattttaagatatgcacataaataaaaactgacagtgtgcaaagacaaatcagtgtttctaatggtgtgagtctgtaaacattgttttggaagagaaagatatgaatgttctttttgatcaaaagggtgattttttagaagccttggattggtagggctgtacccaaggagtattccatggactctttttgtcatctgtggaaggagagataactctcatctgacagtggtgattcttcctttctgtcatcatctacctccgcctttcatttccttcctcccatgaattcactgtctcctcatgacttgtaattggcctcagtgcctcccacatcttgtttaatctctttggaattctgtacctaataaaaaagga

SEQ ID NO: 237917 - DNA, 471 bp, Homo sapiens
ttaacttcactggttatttctcagtctcctctgtggacccttcttttctccccaacttcttaattttgcatcactttagagttcaatcattggccttcatttgtatccacacttactccctagtaatcacatctgttcccatggctttaaaatcaatctgcttgccaatgactaatacatttatattactattaaaactcttttccaaactcaagacatatgtatccaatagcctgtttgatatctcttggattccacccaatagccatctcaaactcattatgtctcagatcaaactccttatccaccctctccacccagcctacttcacctgtagtctttctcaattaagttgatggcaactccaccttttcacctattcaaataaaaactcttggaattattcttaagtatcttttcccctcccactttacatccaatccattatgacattctgctcattctggttgg

SEQ ID NO: 237918 - DNA, 676 bp, Homo sapiens
cctcacttccactccagccacactggtgtctctctatcgggcataccaagatcaacccagaccttggcaggattgcctcattttcatcacttaagctttaattcaaatgtcaagccctcagagaggtcttctctgactgtcccaaactgaaaaagacaccccctcccatgcaagcactgtgtccggtcccagctctttatccttagtgcgtgactttcaccctgcctccaggctccatatgtcagtccagaaggaaaaggaaaacagagcttcccagaactgcccagtatactttctcctctgttgcactcgcccaaaatgcctacccctacctacaaggaactaggaactccggctttttagccagccatttgtttctccaaacaaaatcatagaaagagggaagaatagatactaggtaagcaaacagctgttgctgcctgccgcatgtgtagtttcattcaatttcatatttgtttggtgtcgttccagagtttcctcttagttaattcatgagacatgattatggattcttatgaaacagtaatagaaattactcattaaatacctaggtaatatatataaagttgtcatcttactttgaaacaatatgaaatttaacgaggtcatcactatcaaattgctgcagccaaattcactaacctttagccacagc

SEQ ID NO: 237919 - DNA, 935 bp, Homo sapiens
ggcacttccttcatttgggaggcgacgggggcctgtgccccatcatggagctgctagcctccaggagcactgtaaaatgtgtgatccgagaacgggaggccccacattaggaaattgtttaaagctgatgacctgggagactgtgtgggtccaagacaacaagcgctattcaccagtctgagaaggataagctgcctcttattagaagtgcaacctgaatctatcgcccccacccctaccccagagggttaggaggaatgatgtgtaaaatctcggatctatggaaatgaagaccagaccttcatgcagtgttacagatggccaccggccagatgcagacagggttgagtcctaggaatccaaaacttgtgcgtttatcatagcctgggccagtgttttcttcggcatgattgctgttttaaaagaggtttgtcttcagtcattacttcaggaagttttcccctattatttttatcccaactgatttctccctttcgttgcattttggtaacatttcatagacagttttgaatgcattatagattggtttttattttctttcacatgtgtctgtcttggttctcataataaacttgtataataggggggaaaagcatgatttgtcaggcagattaataagattatgaagggactgtttatccagtctaagaaagtaactaccttcattccgtctttacagacgtacaatttccttgaaaatcattgaatttcagatcttcttacctggttgctgaagggactttggccacactactaacctagtttaggtttgtgtgtatccttgtaagttacttagggatgtcaactgaatagtttgtaatagctcaccactccctatctctccaggctaaatagataccttcttttttgaataatgaggtccagacaagatgaataaaaagtacatgatcaaa

SEQ ID NO: 237920 - DNA, 1846 bp, Homo sapiens
  misc_feature (191)..(191): n is a, c, g, or t
  misc_feature (219)..(219): n is a, c, g, or t
  misc_feature (596)..(596): n is a, c, g, or t
  misc_feature (991)..(991): n is a, c, g, or t
  misc_feature (1498)..(1498): n is a, c, g, or t
tgtttgtttgtctgttttttagagacagggtctcactctgtggcccaggctggagcatggtgacacaatcatagctcactgtaacctccaactcctgggctgtagcaatccttggagacatattttaaaaccaccacctacttcctattatttcttgaaatatattaaacagattttccttatgttctgtncatgatgattttatcagtcttctggggntgaattcattgttacttctgcagtttttgtttgatgttgtggtaagttcgtgttcttggaaatttatctttgaggccaggttttaaaatacagtcctctagataggatttgtatttgcttctgccaggctacaagatggttggctttcagaccaacaagataggtatgattctggcccccaaactccctgagaatgggcctagaattaagaattctcagtggagatcactgtcttttacccagacccaaggctaagacaggcaaatttcctatagaactggctccttacttctttacccatcaaaggtgtgacttctgggggatcctgtctttacgctttgttctctagggtgtttttatgtaatcctgctcttcanctcattttcctgtgtttgccccattaaaaccaatgcttaattccagtagggataggcaggctccccagttcaggtactgccttcagcttgcttagctctcagggtctgtgctatcttatcagtttccattattgactcaagatctgccttatgttcttgcctactcatctatttctgttacacacagataaatgcatgtatgtgcatatatacatgcattatttttacatagcatttttatgtgtttttatgccagagttttgttttccatgatttatttttctctatggtatcagacaccaaactacccaggaagctctttagaaatacgaatttgctggcccaacccagagttaggaaattagcaaattagaatcttctgagatgggtaccangtacctatatgattttttaaaacctccccagaggatgctgatgcctgtcactgttaaagataattattataatgaagacatggtccagaagcagtggaagctcagcaagagagctaaatttggccgacacaaccgaggaaggctttatagaggaggaaattgcatttcgcctttttaaaacatttcctctcatcctttgactgctacagttagctggacagtatgtaagccccttagcgccatgccatgcgtttgaagaccccagggggatgtccagaggcagccattgtctcactgtgtgtgtagcaaggtcgtgggacttagccactttgcaggataagattctgtagcacttatcagtgcccatccacttatctgcccattgcctaggctcagagccactatggaccagcttacagagcaggaacttgccagcattgttcttgggtgctattgggggtatgaattgggctgtctgggctggcggtgtaatgtaaatatcagatnaattgcctaggctcagagccactatggaccagcttacagagcaagaacttacctacattgtttttgggtgctattgggggtgtgaattgggctgtctgggctggcggtgtaatgtaaatatcagataaattgcctaggcccagagccactatggaccagcttacagagcaggaacttacctgcattgttcttgggtgctattgggggtatgaattgggctgtctgggctggcagtgcaatgtaaatatcagataaatgtagcagggaggattctatagaggcgataactctcagaaggttggataccattatttcacaacccagagctgtgccaaaccctgcaatgtc

SEQ ID NO: 237921 - DNA, 167 bp, Homo sapiens
caggatcacagctcactgcaactttgaacacttggcctcaagtgatcctcctgctcagcttcccaaagtgccatgattacaggcatgagccaccatgcctggcctgtttgttctattttaagattcattaaagaaagtttagaaaataccagaaaatagaagagtta

SEQ ID NO: 237922 - DNA, 345 bp, Homo sapiens
ccagtaaacaccgatgactcccagatctacagctccaggctgttcccttctccgtgtctcatatcagctttgccaactgtttattggacatcaccgcctgagtatccctgagggacacgattatcctgtttggagtgtattgaacttcttggatacatcgattagtgtctttcctcaagtttgagtaatttgcagtcatttttcctttgaagtgtgctctgttcatttttcacattacttttatttttctgctcctcggactgaataatctcaattgacctattttaagttcactgattcttttgcctgcccaaacctactgttgtacccctctagtgactttta

SEQ ID NO: 237923 - DNA, 481 bp, Homo sapiens
taggggaggacaaagcattgaagaacaattgctcgtctttgcagcatttcacattccatacaagagacaaaaggcccaacccccactaccctctgagaagcagaaaggggaacggaacaggactgtgtctcctgggtgtcggcagccacgagtgctgctgcaggtcagctactgagactccaaacaccctggggcccatggctgctcacctgtctctcatcaagtaatttcccttctgggctgatgtttcctcatctatattgtagaagaaaggccttcagtcttatttaccacgtaagtggaggtgcccagggggtcaaagaattaatgtttataaagtgttctgctccccagggagacagtggtaaagcatagggtgtggttatggctcattcaggacctcatttctgagggtggctggtgagagcttcccatgaccaggtgctgccagcaacttgaactccaagtctaacgaggtaag

SEQ ID NO: 237924 - DNA, 522 bp, Homo sapiens
tgtgcttgaaagaaatcctccaatgccctcttcctgctgcccctcgaacaaggtgatttaaaagccatgctctcaggaggtactgtaaaagttgggtgctttatgtgtgataaatactacttacctctcaggaagaatttgggagttgggatttccttcccagtgtaaggttctgtgctcagggtaaggttagtacacaatgtatctctgtttttcctacttatttttatgtgcacattttctcagtcatccaatggtaggaatctttcaactggattccggttttctcttggaaagattgatgtgtatgtagatatacattcagtgttgtctgtggactagtattatcttaatagcacactgtattatttaggcctggaaatggacaaagtgttgtatttctgctcagtgtctttttgagttgtgttctgtgcttctccactcatctgctaggaattttattcatttatgtcatgggttgaagttcaaagacttaattaattttccattacttttttcctt

SEQ ID NO: 237925 - DNA, 379 bp, Homo sapiens
acataatcaacatatttacaaacactgacttcactgtttataaagaagaaatttcccctcctatttcccattactgaaaagtcaagtcatttttattgatacatgaaaattaatttttttgtaaatgactacgtatagtcatttttctcctttggaaaaggtaaatagcttattaactaatcctgtcttgttcttcacaaaaataatagtccatccgtgttttgactcaaataacctaaatacacattttgtaaaaattttgtaccctatattacttatttttaaaacagtacagtgttagactaaacaggaaaactcaaagttataaaatctcttcagatcctctagtttattaaatctattttcatgttgatgtttt

SEQ ID NO: 237926 - DNA, 671 bp, Homo sapiens
acagggtctcactctgtcacccaggctggtgtgcagtggcatgatcacaactcgctgtgaagccttgacctcccgggctcaagtgatcctccagcctcagcctcctgagtagctgggactacagacacgtgccaccatgccccaccatgcctggctaattttcaactgctttgtagagagaaggtctcactatgttacccaggctggacaagggtactattaaaaagaaatatttgaagaataaaaagagctctttcaaattaaaagcaaaacagcagaagtgaaaaattcaacagaagggttaaatgattaagttaaagaaatctcccagaagaagatatgaaaaataggagagaaaagtaataaaccaggtaagtctaggagatccatcatccaaaaagcaaagttgtataatgagaaaacagaaaaaatagaaggcaggaaattatcaacaaaataagttttccaggacatttgctgatagattaaagtgactaaagtacccagtataatgaatgaaatatatatgtatagaaaggtacatcactgcaaaatttagaacccaggaacaaagagaagatactacaagttttaagaaagaaaaataaaattttaggattcagaacaatttcggacttttcaatagcaacagaggaagcaagatgaggata

SEQ ID NO: 237927 - DNA, 617 bp, Homo sapiens
acagggtctcactctgtcacccaggctggtgtgcagtggcatgatcacaactcgctgtgaagccttgacctcccgggctcaagtgatcctccagcctcagcctcctgacaactgctttgtagagagaaggtctcactatgttacccaggctggacaagggtactattaaaaagaaatatttgaagaataaaaagagctctttcaaattaaaagcaaaacagcagaagtgaaaaattcaacagaagggttaaatgattaagttaaagaaatctcccagaagaagatatgaaaaataggagagaaaagtaataaaccaggtaagtctaggagatccatcatccaaaaagcaaagttgtataatgagaaaacagaaaaaatagaaggcaggaaattatcaacaaaataagttttccaggacatttgctgatagattaaagtgactaaagtacccagtataatgaatgaaatatatatgtatagaaaggtacatcactgcaaaatttagaacccaggaacaaagagaagatactacaagttttaagaaagaaaaataaaattttaggattcagaacaatttcggacttttcaatagcaacagaggaagcaagatgaggata

SEQ ID NO: 237928 - DNA, 375 bp, Homo sapiens
cagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctcagtgcccgggctattttgaacccaggaatccttgggggtggtgggaggagcggacaataaaggtgtaaacacaggtacctg

SEQ ID NO: 237929 - DNA, 301 bp, Homo sapiens
gtctctgctgctggtctaaggtacaccttctaaggttctagaacagtggctgtccaatccagcaacatcagggaacttgtcggaaaggtacattttcaggctgtaccccagacctactgaatcagaaacttgaggggggacccagccacctgtggctttgcatgccctccagctgattttgatgtgtgctcaggggtgagaaccgcccttccagaattgttctcaatgccagctgcaagttagaatcacctggggactcacttaaacttccagcctgggcgacagagcaagactcatcaaa

SEQ ID NO: 237930 - DNA, 560 bp, Homo sapiens
gttcccttactttctaagtctttttccattttcaagccatgtgtgttatgtgctgattttggaatggtctggaatgctctcttcttaacctcaacctctctgagaccttaccaatccgcagagtccactggagtctcacctccaagataacttccccaacctctctgagaccttacccatccgcagagtccactggagtctcacctccaagataacttccccagccacctaaaccaagccccagcatccccagcatcactctagtgcttagttattattcggggatgaggtgaggggttgctagatccacatgaaaactctacatgctgtgaagtgcagtacagatgtgagagggcaacactgttttccttgcattattatttttgttttacctgttatgtgtttgtcctgtcatccccttcccccacattatgaccctcctagaggtcaaaagctttatgtttcttaacccatccccaagtgcaaaaaataaaaaaaaatcaaagcagtatagagctggaatgaatgagtgagtgaacagaatgatgctctctctgctc

SEQ ID NO: 237931 - DNA, 243 bp, Homo sapiens
ttcctcctttaacaaattcaaataggatacaagccactctgtcccatctcctgcccttgccttctcttctttcattcttttattaactgatttttctcttgagaaatcaccactgggtcaggtgtggtggtggctcatgcctgcaattccagcagtttgagaggctgaggcaggaggatcacttgaggccagaagttcgagaccagcctgggcaacatagggagaccctgtctctataaaaca

SEQ ID NO: 237932 - DNA, 1063 bp, Homo sapiens
cggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagcctcaataaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaagccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatag

SEQ ID NO: 237933 - DNA, 671 bp, Homo sapiens
atggaaagagatattcctactgtgatcaaaagagagcaggggtggctctactaacatcaggcaaaatagacattaaatcaaaaagtttacaagaaacaaaaaggacattatatgttaatacaagtttcaatagagcaagaagacataacaattacagatattagttcacctaataacagaccatcaaaatgcatgaagcaaaactgacagaattaaagtgagaaacagacctataataatagctgaagaatcaaatatcctactcctaataatgggtgaaacaaccagacaggagataaggaaagaaatagagaacacaaaaaagctgtatataacagacatatacagtacagtctacccaacaacagcagtatatacattcttcttaaatgcacatgagacattttccaggagagtccatttgttaggccacaaattaagtgtcttaaatgattttaaaagatagatatcaggccaggcatggtggctcatgcctgtaatcctggcactttgagaggcctaggtgggtggatcacctgaggtcaggagttccagatcagcctggaacatggtgaaaacccatctctactaaaatacaatgaggtgggagaatcacttgaacccaggagacagaggttgcagtaagccaagaccgtgccattgcactctag

SEQ ID NO: 237934 - DNA, 318 bp, Homo sapiens
ttcttttcattctatatattgaagcaatgttgactgatgcatatttgtggatatttataatgtaactacatattttattcttttcattataaaatgttaattataaagccattaagaatcctttttaatatatttgccctgaattcagcagtgtctgattttattactcaattgtagctttcagtttatttgtgtttgtctgatgtattttttcaactttaggctttttgcttagttggattctttttgtatcaattatatttaatacggaattttaatctttctatgttcattgcaataaatgatatatttgctcct

SEQ ID NO: 237935 - DNA, 2695 bp, Homo sapiens
gagctcgccctgtggctgctcggtggtgggtgaggtatcagctttctccgctagttcccaccctggtagtccttagcccctggaatgcgtgagggagatgcttagggagttctcgaagtggggcgtagaggcatcgcctggcaaggcctgggagcgaaaaagatctctacttcgtggagccgttggacgctaccggggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaagcggcggcttcaagcccgggccctggcagaggcagacagtaccaagaaggaggaggaaaccaactcacagcttcctagtttggagtttttgtctagtacttcccgtggcacccaaccttcgttggcatctgctgagacatcaggccactggggcaaaggggaatggaaaggctctgctgctccctcacctactgtccgtcctccagatgagccaccaatgtctagtggggctgacactacacagcctggcatggaggttgacgcaccacatctgcgggcacctcatccaccagtggctgatgtctctcttgccagccctagtagctccactgagaccattcctacaaactacttctcttctggcatctcagcagtttcattggagccactgccatctcttgatgtgggtcctgagagtctgagggtggtggaaccaaaggatcctggaggaccactgcaaggcttctatcccccagcctcagccccaacgtcagccccagcccctgtctcagctccagttccatcccaggctccagccccagctgaagctgagctggtccaggtgaaagttgaagctattgtgatctctgatgaagagactgatgtgtcagatgaacagcctcagggtcctgagagagctttcccatctggaggagcagtgtatggggcacagccctcccagccagaggcttttgaagacccaggggcagcaggactggaggaggtggggccaagtgaccacttcctgccaacagaccctcatctaccctaccatctgctgccaggtgcagggcagtatcatcgaggactggtgacctcacctctgcctgcacccgcatccctgcatgagccactttacctgtcttctgagtacgaagcagctccaggaagctttggggtttttactgaggatgttcccacctgcaagacatgtgggaagaccttctcatgctcttacacactacggcgacatgccacggtgcacacacgtgagcgaccctatgagtgccgctactgcctgcggagctacacgcagtcaggggacctctaccgccacatccgcaaggctcacaatgaggacctggccaaacgcagcaaaccagatccagaagtgggaccccttctaggggtgcagcctctccctggctccccaacagcagacagacagagcagcagtggtggagggccacctaaagattttgtattggccccaaaaactaacatctaagggagcatgagctgatgctaggctgctcttaccatccttagatggcagctcagaaggttggtggcaccttatcacccctgctgggtgacaagaataaaggctctgcccaggctgaaagttcctacccttttttttttttaatcttttatttttttgagacagagtctcactctgtcacccagactggagtgcagtggcgcgatcttggcccaccacgcccgcctaattttttgtattttttagtagagacggggtttcaccgtgttagtcaggatggtctcgatctcctgacctcgtgatccacccgcctcagcctcccgagtagctgggactacaggcgcctatcaccatgcctggctaattttttttgatttttagtagagacagggtttcaccgtgttagccaggatggtctcgatcttctgacagatctgacctcgtgatccgcccatctccacctcccgcagtgctgggattacaggcatgagccaccgcgcccagctgccttttttttttttgagtcttgctctgtcactgaggctggagtgcagtgagccgagatcacgccattgcactccaaccctgggtgacagtgcgagactccatctcaaaaaagaaaaaaagaaaagggggaaaatgacaagtaaatattcttctctctttttgagtctgtgtcatattcagcactgtgaacccttaccagcaagtgactatttttgagttacaggaaggaaaggtgagcagccatgtggctaaagaaagctccttaactaggacatatgggaagcaaaagatggttaacatttttctgctgaatgaattctacattctttcacattctttgtgttgaaataaacttctagcttatctttc

SEQ ID NO: 237936 - DNA, 320 bp, Homo sapiens
ctttaaattaattcactttttcccaaaaagaaataagaaggaaattttgtatcatggcaaatggaaaaccagcttacttgctgtaaatacaagaatgccatttaaaaatatatggtaaaaacaaaataatgtttttgaattctggccaaatactgatgtttgccaacactctgattctgacacctgttgctatttgtctaaaaagagaaaatgtgaaaggaggagaatggcaagtatcaaaagtgtcaaagtcacactatcaccaaatgcggcgctctccctgagcagaagggaaaaaaagtaaaaatccaatgtttctt

SEQ ID NO: 237937 - DNA, 574 bp, Homo sapiens
aggacccctgcaagaaaaagtcaggaatggattcctggaacaaagaatgtccacagggctcttgatgctgctgcctctacccctatattttatatagttctggaagtactcactgcagagacaaatggaaatgagtccactctaggaagaagaataactggaagcttgagctgtgtaaatgtgacttggaaatgtgacttcaggagaaagaaccaggtagaaaaccctgatggtgaaagcaagttttaactgaaatgagaagaaactgaaagttacattaccatggcttttatgagtcaaagaagagacattatgggtatgtgaactaaaataatgacatttggcatggggaaagtgatagatacagtaatttcaattttctgcaagatagagaacacacagagaagtagtgattgatatacagtatgagaatccatcccctatgatgtgtgcaaaggaaattaatatgactggctagaccctggaaacgtttaatactataaatcaccggtgtgaaaaaaaaggtgggtatgaaaattggaataattggataataaatactaaacaatgaaac

SEQ ID NO: 237938 - DNA, 2476 bp, Homo sapiens
  misc_feature (997)..(997): n is a, c, g, or t
  misc_feature (1546)..(1546): n is a, c, g, or t
cgtaacattacaacctcaaacgcaggttaaagaaaataagacccaaccgccagtagcttatcaatactggccgccggctgaacttcagtatctgccacccccagaaagtcagtatggatatccaggaatgcccccagcactacagggcagggcgccatatcctcagccgcccactgtgagacttaatcctacagcatcacgtagtggacaaggtggtacactgcacgcagtcattgatgaagccagaaaacagggagatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaagtttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcnatgctaatggctcaagcaatgagggggctcactctaggaggacaagttagaacatttgggaaaaaatgttataattgtggtcaaatcggtcatctgaaaaggagttgcccagtcttaaataaacagaatataataaatcaagctattacagcaaaaaataaaaagccatctggcctgtgtccaaaatgtggaaaaggaaaacattgggccaatcaatgtcattctaaatttgataaagatgggcaaccattgtcgggaaacaggaagaggggccagcctcaggccccccaacaaactggggcattcccagttcaactgtttgttcctcagggttttcaaggacaacaacccctacagaaaataccaccacttcagggagtcagccaattacaacaatccaacagctgtcccgcgccacagcaggcagcgccacagtagatttatgttccacccaaatggtctctttactccctggagagcccccacaaaagattcctagaggggtatatggcccgctgccagaagggagggtaggccttattttagggngatcaagtctaaatttgaagggagtccaaattcatactggggtaatttattcagattataaagggggaattcagttagtgatcagctccactgttccctggagtgccaatccaggtgatagaattgctcaattactgcttttgccttatgttaaaattggggaaaacaaaacggaaagaacaggagggtttggaagtaccaaccctgcaggaaaagccacttattgggctaatcaggtctcagaggatagacccgtgtgtacagtcactattcagggaaagagtttgaaggattagtggatacccaggctgatgtttctatcattggcataggcaccgcctcagaagtgtatcaaagtgccatgattttacattgtctaggatctgataatcaagaaagtacggttcagcctatgatcacttctattccaatcaatttatggggccgagacttgttacaacaatggcatgcagagattactatcccagcctccctatacagccccaggaatcaaaaaatcatgactaaaatgggatagctccctaaaaagggactaggaaagaatgaagatggcattaaagtcccaactgaggctgaaaaaaatcaaaaaaagaaaaggaatagggcatcctttttagaagcggtcactgtagagcctccaaaacccattccattaatttggggggaaaaaaaaaaactgtatggtaaatcagtagccgcttccaaaacaaaaactggaggctttacacttattagcaaagaaacagttagaaaaaggacatattgagccttcattttcgccttggaattctcctgtttgtaattcagaatcaacccatgggggctctcccatcccggttgccctctccagccatggtcccctttaattataattgatctgaaggattgcttttttaccattcctctggc

SEQ ID NO: 237939 - DNA, 722 bp, Homo sapiens
tcttgctctgtcgcccaggctggagaacagtggcatgatcttggctcactgcaagctctgcctcccgggttcacaccattctctggcctcagcctcctgagtagctgggactacaggcgcctgctgccacgcccggctaatttttttgtatttttagtagagacggggtttcaccatgttagccaggatggtctcgatctcctgacctcatgatccacccgcctcggcttcccaaagtgttgggattacaggcgtgagccaccgcgcccggcaggaccatacctcttgagcaggcttctctgcaggtgcttggtagctggctcgatgggtcagatcataagcctttcatgtcacagaagtggccctgatccatgatcccacaagcacacagactcagagcctacagagaagatgactctggagatctggttccctttactgtccatctatgattcatcatacaaaggtaagcacattccacatttccttttttgaaataagactgctgattttaaaaaaatggtaattacatctgctatactgcaaactgcagaagttcaagcttaaggaaagaccttttacatccttccctcttccttataccttaaaattaaagtctaacatcaaacagggggattcattatttaatttgtaagataagaaacatatctgcatgtgtaagttttttaaaaagaagggagaggaaacaaacaactgtttcc

SEQ ID NO: 237940 - DNA, 667 bp, Homo sapiens
tcttgctctgtcgcccaggctggagaacagtggcatgatcttggctcactgcaagctctgcctcccgggttcacaccattctctggcctcagcctcctgagtagctgggactacaggcgcctgctgccacgcccggctaatttttttgtatttttagtagagacggggtttcaccatgttagccaggatggtctcgatctcctgacctcatgatccacccgcctcggcttcccaaagtgttgggattacaggcgtgagccaccgcgcccggcaggaccatacctcttgagcaggcttctctgcaggtgcttggtagctggctcgatgggtcagatcataagcctttcatgtcacagaagtggccctgatccatgatcccacaagcacacagactcagagcctacagagaagatgactctggagatctggttcctttttgaaataagactgctgattttaaaaaaatggtaattacatctgctatactgcaaactgcagaagttcaagcttaaggaaagaccttttacatccttccctcttccttataccttaaaattaaagtctaacatcaaacagggggattcattatttaatttgtaagataagaaacatatctgcatgtgtaagttttttaaaaagaagggagaggaaacaaacaactgtttcc

SEQ ID NO: 237941 - DNA, 732 bp, Homo sapiens
gtttgagtggaaaagattgcacgtgacctttgattttaaggatggattgactttggataaaatatctaggtgtagagtatccactggaaaatcttaagtgtaagggaacgtagtcagattagtgtgggaaataatgttagagtgaggaagttagaagactcttgggaattagagtttgaaggtctgggttgtagtccagcctttgccattagctggttgtatgatttggggtaagttatttaacctgtctagaccttgttctctaacactataaaatgactggtatgttatcagcattctttagaaacatcctggtaagacagagtagtaagagaaagctttcatcaggaaggaggtcatctgcatcttgaaaggtagacagcctctagataggagaagaggaaaagggaaagccattagaacaggaatgccgaattaaagaaggcataactggaggtaaagacctatactatcacagggaggagtgcatgttggaaagtaatgagaagttaaggttatcaattctgtgctccagaagtaggctctatatagttatgtttgctgtttagagatgatgcagttggaaaatggccctcttatttaaataaaggttggtgagacacctgctggagtataactagattcaccttgccttgggctcccgaagtgctgggattacaggcgtgagccaccatgcccggccgattagatgtttcaagaagcaggaactgg

SEQ ID NO: 237942 - DNA, 447 bp, Homo sapiens
caggagagctgccaggtaggacggcgggcaaagcgcttcttcaagttcctgcgctggagtcaccacccgagaggcatcgccgtctggcgttggtgtctgagcagaagccgcaggaaccagcgggagcagcaggaggagctgcgggactcgtttgccgagtcacgtaatgatcgggtatcagaaaaagacgtcagcatcctagtccctcaaggaacaaattaactattctgtgctgtcctcttggatgataagatccggagtcatcgacttctcataaacacctttcactcatacaatccaatttttaagaagtccaattgttttgatggttttcaatttcacccatttcccaaggacagcctcaccaatcggagctctggtctctggaattaagcatcatcaagctctcctattaataaatttaatttagatctcctaaaaaaaaaa

SEQ ID NO: 237943 - DNA, 421 bp, Homo sapiens
atccgaacatggtttttggagagccctctttgtcaacatctgcctgcctgttgcctttaagtacagaatattttgttgcactgttgcgctccgatttttattcatgaaatgacttcctttttttttttctcagtcacgtaatgatcgggtatcagaaaaagacgtcagcatcctagtccctcaaggaacaaattaactattctgtgctgtcctcttggatgataagatccggagtcatcgacttctcataaacacctttcactcatacaatccaatttttaagaagtccaattgttttgatggttttcaatttcacccatttcccaaggacagcctcaccaatcggagctctggtctctggaattaagcatcatcaagctctcctattaataaatttaatttagatctcctaaaaaaaaaa

SEQ ID NO: 237944 - DNA, 385 bp, Homo sapiens
cgcacttgagcctgggcgatagggctagactgtgtctcaaaaaaaaaaaaaagaccacatggtgtttatgtgattatagtttaagccaacttcaatttaatgctttttgggcaccagacattatattgagaatttaattttcacaacagtgttctgagatcattgtcacaatgtcctcgcttttcagataaggaactaaattagaaggattatgctgggctcaatggctcactacaaaaaatttaaaaataaactgatcatggtggcatgcacctgtggtcccagctacatgaaaggattgtttgagtctggaaggtcaaggctgcatgagctgtgatcacaccactgcactccagtctgactgaatgagaccctgtctcaaaaa

SEQ ID NO: 237945 - DNA, 814 bp, Homo sapiens
agtaaagaacaggtttttgtaatgcaaacactgtgtgggccaaaattagcaatgatgggtcaactaatagcataagttaatttttttaaaagactacattcaatgtagtgattgccaaactgtatccataaacatgagaatccccagtaggaggttgctgggagaaaataaattatggctccagaagtcaagtgactcaacgtcagcttcatcgcctgtgaaacttaccccaagcccaacaacgaccatgtgattcctgagcctgaaaaaactctaaatggttcctcagtcaccaaggttttgaacactgttggcctccagattagctttgggattgaaaaagtctggttaaagttctcgctctgctgctacagggctgtgggaactctgaacaatttagggatttagcttacacctaaaatattctgagcaaaacttgtgggtgttcactgacatggccacaataaaatctatggaacaagaaatatttttgtgattgaactcacctactagaaatgttaatcttaatggtccacctgctgagactctaggtaaggctcagagtccccagcttttgagactagtacacatagttcttagtgcaagaattacattaccacagtcaaaagttgctctctacagagaacaattctggtaaatggacacttcacaaagtaatattagttccagtcatttccaggttcagaggaaagtagctctgagaagatgatgcccttcccccaccttcccttatgtataattcaaaattaaaacatatatgtgacactacaaaatatgtgtacaaaagtcctcc

SEQ ID NO: 237946 - DNA, 428 bp, Homo sapiens
agctttccctaataagaaggcagagctcctcttcacccagacttcagacctatagaggcagcctggggtcccgggatgcccttgcactcagagatgtccccagagtcctagggaaatggaggataactaggaggaagctgttcatggctggcgatgaggtctataccttcttgtccgtctcagtgctgtctgctattgaatttttgtgcagatcacattaacttaaagccagttctcaagaagctccccctgccgccggcatatccaccagttgctcccctttcctgccattaatcagggtctgctagttagagaacaaattcctatttgtccaaacagttgccaacacccccaccccaaggtagttaaatgaggatgaatgggtcattcttattaaaaaatgacttaaatttctcaaattctattta

SEQ ID NO: 237947 - DNA, 393 bp, Homo sapiens
agaagttttccctgctctgtggcgccctctgtacctttccttcatggcgtttatcatagacagcactcaattcttgttcattatctttctctcagtaaactaaaagcttcataagggtaaggaccatttttatttatttaccactgccgagtttccaacagtgccaaatttggtgccttaatgtgtgttgaataaatgaattactgttaagataagaattgatactgctgctcccagccgaatatattaagctattcagatgcttcagtgttaaacagacatgtgctcatgctccattgttccttgttctgtgaggtcgtgtacatttcagggcatagatttcaactgttatggatgataatgggtagatttacccatttttcattgagcagg

SEQ ID NO: 237948 - DNA, 407 bp, Homo sapiens
aaaaaatttatatatatttttacagtatttacataactaatatttatggataaaataacatgcgccagggcctagggatccagaaaggaagaagacacagccattgcccttggccctgtgcagacctgcaggtggggctctgtctccatttggtccccttcctacctcacgtccacaagtatgcagggagtatgcaaatcagagaagacttcttcgcagaggagtagaagtagtgtagaagaagaaagactgaaaacttgataatgatgcctccgctttaagattttacagcttgtacacaggaatggcaactcccagagagtgagcaggccaggaataatcccaccccacagatcaccagaagtatggtgtcaggaaagaatatcgatgactctgttttgccatta

SEQ ID NO: 237949 - DNA, 467 bp, Homo sapiens
aaaggacaaaattatgtcctttgcagaaacatggatacagctggaggccactatcctaagtgaattattgtaggagcaggaaactgaatagtatatactctcacttataagtaggagctaaacactgggtactcatggacataaagatggcaacaatagacactggagactactagaggggggaataagagaaaagagcaagggtctgaaaaactacctatgggtaccatgctcacaagctgggtcatgggattaatcatactctaaacctcagcgttatgcaatatactcatgtaacaaaactgcacatgtgcccccgaatctaaaataaaagtggaaattatttttaaaaaaagtccagcagaaaaaggtgagttatagatgaaacaattatatgcatctgtatgatgcatatttaaaaatttttctttactattgtgtagttttgcaaattttaaataaaaagt

SEQ ID NO: 237950 - DNA, 156 bp, Homo sapiens
gtcttgggtgctgcagcttgctccaaagttatagcagtcgagtcagagtagacttggttaattttcttatcccatcaccttctgaaagctgttcaaatctacagagtgtgaccatcacctcctctttcccttgtgtctccttctatcctcacctta

SEQ ID NO: 237951 - DNA, 487 bp, Homo sapiens
gggaatgggaaatgactatgactgctcattgatttggggtttcttttggagatgatggaaatgttctggaagtagatagtggtgatggtttcacaaccttgtgaatatactaaaaactaccaaattgaatttgatggtatgtgaattatatctcaataaaatttttatttacataatatgctgtgtaggcaagttggggtagcagaaagaatgtgacagaactttagtattgggtcctgttcagagtccttgctttgggagagtttttaaactatctgagctttagtctccacttctaaaattaaggcagtaatatcagtcttacatacttttatgtatattaaatgaaaagtgtatgtaagctgttttgaactgggtctggtggtgtgcccctatagtctcagctacttgagaggctgggataggagaattacttgagcttaggagtttgagtctagcctgagcaacatattgagacccccatctc

SEQ ID NO: 237952 - DNA, 448 bp, Homo sapiens
cccctcacattgtggcagctggcttccatcagtttgataagtcagggtgcaaaagagagtgagcaagattgaagccagtctttttctaacctcaccttggaaatgacatatcatcacttttgctgtatctcattcactgaagtaagccactctctatagcccacactcctgaacagtagaggcaggagccatcttcttagaagctgccaccataccaaatacttcctgctaatatttgctgcctctctgagccatatagcagagagggctgggaaggcagccctaagaagtgtgtgttttgttctacagctattcggccccacctttcctttggagaaaacactcttcccacaaggaaggggaagcaagaattagtggcagcaaggacaatttaagcccttgaaagaagcaatcatcacattgattaataaatacttaaaatttcttt

SEQ ID NO: 237953 - DNA, 489 bp, Homo sapiens
taatcggtaatgggtggcttgaggggtatacagcataattagaacttaaaactcagagtaatccagggcagatggtggcctgagtatgtattttcgatcccctcattgtcacactgcctaaataactttgaacaaccgtgggagcctttgtacctggtgttagaggggagcacatatgcagctgagactctgggtcttgggcagaagttgtgctgtatagatggggttgggggagtgatcttatctgtattccttgtggtgatggagagaagagtccaggacctagaatctggagagtcttagctctcccatagacctggggcagtgtcttgaaaacttatcagacccagtaatcctcttatataaaaagtgttttgcaacgtaccctttattatactgaagtgaaaatcttgaataatataatctatgcacacacataattaacaaatcaattagcacagtgctctgaatgtgattaatataaggaaa

SEQ ID NO: 237954 - DNA, 375 bp, Homo sapiens
gagaatttcctaatagtcgataaatataaatatttgctcaaactcaccaatgaacagaaaaatccaaattcgaacagcaatgtaataaactagttctcctactccaaaattaacaagtacaatagtttgttttaaactcaaggatttagaagattctaagggaatagactctctcatattattaggattttgagttatggcagtgtagtagtatctattaaaactcaaaatacaattgtcacacgcttgatgaaagcaacaaaaatcccattctaaacatccatcttaaagaacaatcgtacatgagcccaaggagacataaaattggtcgtttgttgagccacagtttggaataacaaaaacatttccagattc

SEQ ID NO: 237955 - DNA, 498 bp, Homo sapiens
gagctatttagacttcatcctgaggtcgctgggagccactggaaaggttctgttaggttttttcctcctaaccactagaccgccagagatgaagttttctaaaagatgtttttaaaggtttttttttcaagtgaagcaggcggagtagggaaggattttttaaattctttaaaaactggttgtgatttgttgtaaaagatcctttaagaaagaagtagcatcatatttgcattttaggacgatatcttagcggatggagaagagattggaaaaatgacagtcactgccttaacgtgaaactccattgttgctagagtcacagctctgttctgcaaggtggctcctattttgagtcaactaactatgactgtaaatgttttcttcaaacttgtggaagctgctctttagcctaattgtattctttttccctggctgaggatccttttgtttgccaaggtttgtttgtttgtttgtttgttttttgagacagagtctcgc

SEQ ID NO: 237956 - DNA, 505 bp, Homo sapiens
tgacagctgggccaggtctgtacagccactgctgggtttccagggctcaggacagctcctggctcacagcaggcctccataaatacttgttcaataatttaaaatctggagggtagggagaaagccccacgtatccagcaatacaggattaatcaagtatagtttgacagtatactggagtccagtacagtcatctaaactgacaaggtagatgtatatttatttaacatagaaaactgatcagaagatattgctgggaggtaaaagcaaatgatcaagtcatatccattgtgtgacccagtttttataaaaagtcatctatgcttatactgtacttataccatgtattggtgaattttaaaagtctgggaggataaactccaagaatgtaaaaagcagttttcctgagcagtagattccagtgcttttaatttctctttgagttttatgtactttccaatttttctacaatgaacaggtattaaatgcataatttttttcatac

SEQ ID NO: 237957 - DNA, 308 bp, Homo sapiens
gatatgattcccatacatttgtttgcagatatggcaagtttccttaacccaggaaacctgaacacttcaaagcacagaggaagcatttcatccagggcttattgtttctctctaattagggtgttcaaattggtgtctggcctgatactccaggacttctctcctatttcagccttcttaaaaataactagaaacagtattatctctaaaagcttaacaatgatccaacaattctttctaacaactgaaaccctctactttttcttagagtgttcaggagaaaaataaaccctttgggacaaaagaaa

SEQ ID NO: 237958 - DNA, 1551 bp, Homo sapiens
  misc_feature (945)..(945): n is a, c, g, or t
aacaaaatatgcacaagatttatgtgagaaaaactataaaactctgctgaaagaaatcaaataactaaataaaatggagatatattccatagtcattcataggaagatccgatattgtcaatatattggttcttgctaacttgatctataatttcaatgcaatcccaatggtataagttggatgtttgtctcctttaaatctcatgctaaaatactattcccagtgttggaggtggggcctgggaggtgattggattgtgggggcggatgtctcaagaatgttttatcactttcccattggtgagaattgaattcttgctcaagatctggttgcttaaaaatctaggccctcccccactggctcacttgctgttactctagtcatgttacatgcctgctcccacttcgccttatgccatgattgtaagcttcctgaagtcctcaccagaagccaagcagatgttggtgccatgcttttatagcctgcagaactgtgagccaattaaacctcttttcttcataaattactcagtctgaggtattcctttacaccaaagcaagaatggccaagtacacccaaccaatatcccagcaagttattttctgcatattgccaaactgattctaaaatttatatggagaggcaagagacaggatagccaacacaatattgaaggaggagaacatagttggaagactgacattacccaacttcaagactaattattaaagctacactaatcaagacagtatggtattggtgaaagaatagacaaatatgtcaatggaacagaatagagcccagaaatagagccaaataaatacagtcaactgacctttgacaaagcgacaaagcaatacaatgaagcaaagatattgttttcaacaaattgcgctgaagaactggccaaacacttgaaaaaacatctaggcaaagatcttacntgtttcacaaaaattaactcaaaatggattataggcccaaatgtaaaatgcaaaatcatagaactcctagaagacaacaagagaaaatctgtgtgacattgggtattgggtattagttatggtgaagacttttttacatgaaacaccaaaggcacaacccatgaaataaataattgataagctgggattcattaaaattttaaaagttctgttctgtgaaagaccctgttaacagaatgagaagacaagccaaggatgcaagaaaatatctgcaaaagacatagttgataaactgttgttatccaaaatatacaaagaactcgtaaggctgggtgcggtggctcacgcctataatcccagcacttcaggaggctgaggcgggcagatcacaggtcaggagagcaagaccatcctggccaacacagttaaaccccacctctactaaaaatacaaaaaattaggtaggcatggtggcgggcgcttgtagtcccagctactctggaggctgaggcaggagaatggcatgaaccctggaggcggaggttgcagtgagccaagattgcgccactgcactccagcctgggcgacagagcaagactctgtctc

SEQ ID NO: 237959 - DNA, 302 bp, Homo sapiens
ctttcctattactgcacctaatgcaatgtctccctctcaggaatatcttagtaactcaggtggtgagagaatgaatataatctgagtttgctgcttgaacttgatcctgcatgaagacatttgtttacgagccatctattctcatttttacacttctgcacatatgatgtcttaatatgccagaaagacatggagaaataacatacatcaaaatagcatgttttagaacgttggacagttcttctcaaacctgaaaatacctgcatataaaagtgacctttgatgtgaaattgaaaaatatt

SEQ ID NO: 237960 - DNA, 334 bp, Homo sapiens
caggtttaggagggagaaatacatttgccagcagggtttaccatgggcagggggaaggggatggtgttagtagctgcttgtctagccttgtgatttcgtctggttattctcaataggagacttcttcatcagttgccgtatttcacaaggaaagatgacaccaataagaaagaaaacgtatttgctcttgagtataatactgtgatttatcatctctaagaagtctgtgtgaataaaatgttatttgaggtctttgggctcaccgattgggggaaccagaaaccaccttcaaaagttaaagtacccattggtcttacagacaagcatcaggaac

SEQ ID NO: 237961 - DNA, 240 bp, Homo sapiens
attcacaaacaggctatgctctaggctctgaataatgaaatgccgaagtaccacaaccatattcctagtccaggacttaaggtttttggcaaagcagagtgtgctggaatgtatattcaatgtgttgaattcaaacacctacaatgggtaaatcgtagtcttttaaagcattcaaaaaccatgtgtccagtatccagtaaaacaggagaattttagttctgggaattttgtttgtttttt

SEQ ID NO: 237962 - DNA, 205 bp, Homo sapiens
tgccgaggacggccaggtgagcagcagaggacgatgacaggaattctgagtccgcctcagtgaacaaagcggcgtgtggcacacggtcatgccacgagcctgagagcagattgcaaagcaaagcgtgtagtgcaatccaacttttggaaagaaaaataaatcctttatatatgacggtgtaataaagaattgaaccttgcccaga

SEQ ID NO: 237963 - DNA, 410 bp, Homo sapiens
caccagccacacgtatgtctgctgctgacaaatgtgcgcacgccttggagggcggggccaggcaggacagagccgcccatgacagggggacacctcctggacagcagccagattacctccaactccagaccaccacattcaacaccacagtgaacatctctttctagaattcttggactgattatccatcttgacaaaggaggccttgaatcaaatttaatctggtttagtgcacttatcaaagagacatcggagagatcccttgtgccttctgccatgtgagttatagtgagaagacagccatctactaggaatcagaccgtcatcagacaccaaatctgccagcaccttgatcttagatttcccagactccagaactgttagaaataaatttctgttgtttataagcc

SEQ ID NO: 237964 - DNA, 348 bp, Homo sapiens
caccagccacacgtatgtctgctgctgacaaatgtgcgcacgccttggagggcggggccaggcaggacagagccgcccatgacagggggacacctcctgttctagaattcttggactgattatccatcttgacaaaggaggccttgaatcaaatttaatctggtttagtgcacttatcaaagagacatcggagagatcccttgtgccttctgccatgtgagttatagtgagaagacagccatctactaggaatcagaccgtcatcagacaccaaatctgccagcaccttgatcttagatttcccagactccagaactgttagaaataaatttctgttgtttataagcc

SEQ ID NO: 237965 - DNA, 504 bp, Homo sapiens
gtagggccagatgtcttagaatttggagttttccagattttataaaatattatgactcagacaccaatatggtttggggcaacacctataatcaagtatattaacatttctgtagcaaaatgagtattaaagtaggataaagaaagactacatatgtacataaaaccttgccggggaagtcaggctcagctaccaggtgagttttgttgccaaaatgctaggaaaatctttaacttttcagagatttttggtcatggaattgtagcaacaaaaccttttgtagaagagtaaccaaaatcatgtatgcatttagttccaactagttaatgtcacatctctattcctgtcacccttccctgtgatctagtcccttttgtaagagaaatatggtagttgaattataaaatctaaaattaattttgtggtccaaagaaaagcaaaatagatctttagaatgtaaagccattctttactttgcccaataaaaattttgttattccctga

SEQ ID NO: 237966 - DNA, 471 bp, Homo sapiens
cttgcagtggcctttccttgtcatcagagtaaagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctttgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaagtttgcctctga

SEQ ID NO: 237967 - DNA, 354 bp, Homo sapiens
agtatgtttttcagaccagattttgaataagggttggcagccttaaaaataaaggtttggctgggcgcggcggctcacgcctgtaatcccagcactttttgggaggccaaggtgggtggatcacctgaggtcgggagttcgagaccagcctgaccaacatggaggaaccctgtctctaccaaaaatacaaaattagccaggcgtggtggcacatgcctgtaatcccagctacttgggaggctgaggcagaagaattgcttgaacccagtaggcggaggttgtggtgagccaagattgcaccattgcactccagcctgggcaacaagagcgaaactcttatgtcaaaaaaaaaaa

SEQ ID NO: 237968 - DNA, 368 bp, Homo sapiens
agtgagccaagaccgcaccactgcacttcagctctgggtgatggagtgagactcttgtctcactccaaaaaaaaaaaagaaagatcttggccgggcgtggtggctcacgcctgtaatctcagcactttgggaggccaaggcaggtggatcacaaggtcaggagttcaagaccagactggccaagatggtgaaaccccgtctctactaaaaaatacaaaaatttgctgggcgtggtggcaggagcctataatcccagctacttgggaggctgaggcagagaaccacccaaacccgggagctggaggttgcagtgagctgagattgcaccactggcactccagcctgggctacagagcaagagtccatct

SEQ ID NO: 237969 - DNA, 394 bp, Homo sapiens
cgatctcggctcactgcaagcttggcctcctgggttcacaccattctcctgcctcagccccccaagtagctgggatgacaggcgactgccaccacacctggctaatttttttgtatttttagtagagacagggtttcaccatgttagctaggatggtctcaatctcctgacctcgtgatccacctgcctcagcctcccaaaatgctgggattacaggcgtgagccaccacgcctggcagtttatcatgttttttcacaatgagagcctcccagcgcccctgcttctagtcagccatcttggcctggtcccccagaatttttcatgcagaagtgggaataatggcctctacattctttacatggtagaccagaaactgaaggtctctgattttat

SEQ ID NO: 237970 - DNA, 335 bp, Homo sapiens
ccccattaccattgggactagtactttctaattcccatgcatgtgacatttgatattttgacttctaaatcgatataacacttcactacacatggcatcattagattccttttattttaaataaaaataatgttttatttttgaatataaaaaggtagtttttcccttaacttaccaaaccacatactgttcaaataattttatttccagctccttctcctggaaattgaattaattgaagcactgttctttttaatgtatgataggcttgaaggaatggctacaactttactgcagctggggaaaaaatctgtaaatgaatcattgacagcttc

SEQ ID NO: 237971 - DNA, 1251 bp, Homo sapiens
tttaagtttctgtatggtaaacttaatgatacttccagttcttttgctgaccctacaggcagaggactcagaggcagttccgcttctttcctaataatgctgtcttgcttaagccactgtcacaatatttacaggtagccactcacaaatagttacactttaaaaattcatgtaagtctgagttttggaatttgaaatacacttcccactgggaaaaaaatgtataaataaataaataaatatgtttctaggcaaccctttacaggcttattaaaccttaatctataatgtagctgaaatactatacatttatgatgaaaaaattaggaaaatcatatttcagatgcatattagttccactatatgacatttaagtaggattttatatggaatagtttggctcctttaacaccattgttggtggtgagaagggtaagtagtggtgtcacgaggttctagagagaagacattgagaatggtcctcgagaaagcccatcccatctcctgtgtggcatggaccagccatctgcatgtgagacagtcttaagtcacatacttgtatatcaggagtattgtatgatcttactagttgcaaaatgtgaaaaaattcatttagaataatcttgagtgagggagtgaaaagtatatatattttgaaatttcctaagcagatattgttggaaaaatgcctttttcatgcatttacagataatatattcatatatttagtgaccatttttagttgtgttttccttcttttgtctttaaaaaaaatggttttattaattattggtgctacttagttttaaatgtaaaggacttaattcatttaaaaagaaaaaaaggtaccataaagttaatagtttaaacatttaattctataattgttctagagttttaatgttttagttctttaccaggcacaattatttcaagagattttcattatgttgaagctaactttttaccattagttaacttatattcttatgaggacagtataattcctgacaaagcagtattttggaaagttatagaatgtagaagagtgtgtgctttggattctaggagggagatgtgagttcttattcaagtctagatacatttctcagcttctgtttctttacctacaaaaggaggctgatgaaacccacttgcctcccagggttgctaaaattgcataagattgattgagaatgtatgtcagcccatactactataggaatgggctgtccatggaacaggtaggga

SEQ ID NO: 237972 - DNA, 286 bp, Homo sapiens
agacaggaggagacagcaggagacatggaaaggattatataaagactgtttcttcctggactcatggaccaatggggagaaaagctagttacattctgtaacaagcaaaaaaccggaggaaaaaactccttcagagcagaagtttggacacctccgtccccatgctgagcccctccagctaaaccagtgttcttggagccccgtttttgctttactattagctccatgaaggccaagactgtctttttcactttgatcatagctattcagtcatagcttgttgaaa

SEQ ID NO: 237973 - DNA, 457 bp, Homo sapiens
ctgtgtctacaggagtgccccgaaaacaggcccaaactgcaaagacaaagacagtgttggctgtgtctacaggagtgccccgaaaacaggcccaaactgcaaagacaaagacagtgttggctgtgtttacaggagtgccccgaaaacaggcccaaactgcaaagacaaagacagtgttggctgtgtttacaggagtgccccgaaaacaggcccaaactgcaaagacaaagacagtgtgattatttttcttgtctttttatttttcccctctttcttttcttttctttttttctttcttttcttttcctcctggtgttcaaggagaaaatctctctcaaatttgtcaaaacatcagattaatgcaagctaaagaaatagattccactattgccttataatcctttgtatttctgtgatacaaataaacagtagaagacctagagaaaacaaatagaaa

SEQ ID NO: 237974 - DNA, 516 bp, Homo sapiens
attgtaacaggttcggaggctccaggagagagagttccagtaagagaaattgaagtgcatacctggtatgtttgaacatactggaacatacatagataactgaggaagagtttaggtgtgaataaatgatgtttacatagaaagctaagaaaacaggcaaaaagaacagttactaactccagagagaagaaaggaagaaaaagcaatcattgttacttactggcttagcagttttcataattataaaaatgtaaattctaaattctggaataactaaaattatgatacaagtacgctgggtcatggaggtgaggaaatgaaaaccaaattctcatcttccaaagtgagatgacaatacataatgcccaaaactgaaaagcatgttgtgacagattctgtcatagggaattcatgttatttagagaaatggcaacaaagaagaaataggtgggaggtttgaaagtggttgttgtagaaagtgggatttggggatggatggagccagatgggggactc

SEQ ID NO: 237975 - DNA, 482 bp, Homo sapiens
ggcagggcatcatggtcaccagatggctcccagcacaggagaggtacagagccatccctccagggtcagcctccctgggcaagcaggctgagtctaccttgtccgggaggggaggaggcgcatcctgagggcttagggggcgtgagcggaggggagctcagggtccctcggtggatgatggaggagccacatatgggttacagggacagacagaaagatggagaggaagagacagggaggcagacccaaggtccactgacagggtctgaaggaggaggggctgggggcctggactcctgggtctgacaggtacagagaggaacagacacacgctgaaagagacacaaagagagaggggacaggcatagtgattcacgcctgtaatcccaacactttgggaggccaagcggggaggatcacttgagcccaggagttcgagaccagtctgggcaacaaagtgagatccccgccccatctctaca

SEQ ID NO: 237976 - DNA, 450 bp, Homo sapiens
ttagattagggattccctgaaggttggcactgctcttgcaggatgtcttcagctaatgaaattacatatgataaataacccagaatcatttgctccctggccaatgtcacataagctatataaatctctggagtatatacaggagatgtttcttaatttacattcttcgttacatgttggatgaggtaatctggcaaaattgcatttagagaccacatctgttatcctccggagaatgcatgactgatgtggaaggaatgacccggggatccatataggatgactaattaagaggatgtttgtgcctcttgtctgtatccttgaaattacaaatagagcttgatactggatgagatctctgactcagttgaggctgattggtcaatctgatcctgtgtgttagtgctacattatacttccattaaaaagcagcatgtgtaatgctcctct

SEQ ID NO: 237977 - DNA, 660 bp, Homo sapiens
tttttgactatacagtcatcttagtgtgaagtggtatctcactggagttttgatctgcatttcctgatgaatgatgatattgagtatctttttgtatgcctgttggccatgttaggagttttaatgtattgtatttacatccaaaaatcgtgatttttaaatgtcatgctacaacatgaaaggatacaattgagatttgctttaaaatatgaagcaaaaaaataagtaaatttattattatcattactattactattacttggaaatagagtctcactctgtcgcccaggctggaatgcagtggcacaatttcggctcactgcaacctccacctcctgggctcaagcaattctcctgcctcagcctcctgagtagctgggattacaggtgcataccaccacacccggctaatttttatattttagtagagacggggcttcaccatgttggccaggctggtcttgaactcctgacctcaggtgatccacctgcctcagcctcccaaagtgctgggattacaggcgtgggccaccacacccagccagtaaattttttaaaaggaaaaaaaagaggatagaagaaaggaatgtggcaaaatcttaaccactgaagctggatgatggatataatggggtgtctgtatcattctctctacttttc

SEQ ID NO: 237978 - DNA, 606 bp, Homo sapiens
tttttgactatacagtcatcttagtgtgaagtggtatctcactggagttttgatctgcatttcctgatgaatgatgatattgagtatctttttgtatgcctgttggccatgttaggagttttaatgtattgtatttacatccaaaaatcgtgatttttaaatgtcatgctacaacatgaaaggatacaattgagatttgctttaaaatatgaagcaaaaaaataagtaaatttattattatcattactattactattacttggaaatagagtctcactctgtcgcccaggctggaatgcagtggcacaatttcggctcactgcaacctccacctcctgggctcaagcaattctcctgcctctatattttagtagagacggggcttcaccatgttggccaggctggtcttgaactcctgacctcaggtgatccacctgcctcagcctcccaaagtgctgggattacaggcgtgggccaccacacccagccagtaaattttttaaaaggaaaaaaaagaggatagaagaaaggaatgtggcaaaatcttaaccactgaagctggatgatggatataatggggtgtctgtatcattctctctacttttc

SEQ ID NO: 237979 - DNA, 391 bp, Homo sapiens
ataaaaacagtttgtttctaattgtagctctgatggctattcaaaaaatgccgtgagctgatgtgtttctatggacatgtttaatgaaagagctgagtcttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctca

SEQ ID NO: 237980 - DNA, 2261 bp, Homo sapiens
  misc_feature (216)..(216): n is a, c, g, or t
  misc_feature (355)..(355): n is a, c, g, or t
  misc_feature (397)..(397): n is a, c, g, or t
  misc_feature (440)..(440): n is a, c, g, or t
  misc_feature (470)..(471): n is a, c, g, or t
  misc_feature (473)..(473): n is a, c, g, or t
  misc_feature (480)..(480): n is a, c, g, or t
  misc_feature (484)..(484): n is a, c, g, or t
  misc_feature (486)..(486): n is a, c, g, or t
  misc_feature (490)..(490): n is a, c, g, or t
  misc_feature (492)..(493): n is a, c, g, or t
  misc_feature (517)..(517): n is a, c, g, or t
  misc_feature (1035)..(1035): n is a, c, g, or t
  misc_feature (1243)..(1243): n is a, c, g, or t
  misc_feature (1394)..(1394): n is a, c, g, or t
  misc_feature (1752)..(1752): n is a, c, g, or t
  misc_feature (1932)..(1932): n is a, c, g, or t
  misc_feature (2195)..(2195): n is a, c, g, or t
  misc_feature (2258)..(2259): n is a, c, g, or t
tacagtgatgctgaggcattttttcatttgtttgttttatttgttgttttaaagagaaaagggagtatacttgttgcttcagggcaaaacaaagaccagtgggaagaaagttatcaaaggttgatttcagctcctcacaaagagctttctaaggacaggctatttgtgaagggactaaatgtgtttaagtagagctgggcggtcacatgagaccantgtcctgaggaagctcacccaaaaaccccgatggccaggatgttgactgatggctcaccctggagagttgacatctggagcctccgctgacaagcagcatggtccgctggcaggtgaataggggccatggttctgcggnctctctccaggggtggctgaggctggcactccacagtgctgntaagcacatgggtcacagctgcaagaatgctggggtatgctgnctaggcaggtgtgcggaggtcacgatgcanntncatcttnaaancnggangnntttctcggagctgtagtctcacanactctagagagatttgagaggagactgtcagagagacacagaggcctgggtgtgtgtggatgaggtgatttctaaccggttgataataaggtagtaagctttatgtttctatcatatttatttcccccctcagatcaggttgtctgagccagaaccacatatcccagagcaggcatgttagtgatctgggatagagagaaggacgttctaaacaatgtctggaaacataaggggctgagatgcatttagccatttgaaaagataatggaaatttctttcaactaattcctttgaggtttaactgtatagtattgcctttttcatcctttcacaaaacagaccctggaaggactcaaattggtaagtgagaagccagttactaccaactactgggcagcttcttggcaggaggtgagagctttctgcttcctttttaggacaattccacccttccttgagtgggaggagttggtgaggtggctgaatgtcatgagggtttggagaggaggtggctgtantcgcacaggcactggcattgaagagaccccgggaagggaagtacctctggctccatggcaggatctggagggaggaagggaagattcatagcatagcaggtctagcgtaccgcacttgaaaagactatggtatttattggttcattgaactcaactaaacccaaaatactgggtacctcatgtgtgcagttcttagtgccaggaatgntgggctgtgtaaggaagaatccagtaactccctcaactaacttagaatatttatttcctaactaaaagaaacataagtaagagtcaacaatattgtttgttttgctttttatgtagtgtcaggcacagaaatatgctcagtaaacacttgntggttaatggccactgcaggtccctgaatttgcgttgagttgaaagaaatgccaccaacctgcccctccactgccaggagttcaagtcaggagagcagccagcctgactatagaagaactacacagtgcctaaagttccaggaaaccttccagttgcaaggagagagagcagtgctattttaataaatagtacatgatagttttgctgtataccaggcctacacagtgctagacactggaggcaaagacagacaaacagacaaaataattaaaatgtggttaagatcatatccaaatgtaaattaggtccaccactgtggaaaacagtgtggcagttcctcaaagacctaaaaacagnactaacatttgacccagcaatcccattgctggatatacacccaaaggaatataaattgttctattataaagacacatgcacatgtgtattcgttgctattcaaaatagcaaagacatggaatcaacctaaaggatcatcaatggtagacgagataaagaaaatgtggtacatatgcaccntggaatactatgcaaccatacaaaagaatgcgatcatgtcctttgcagaaacatggacagagctggaggacattatccttagcaaactaacacaggaagagaaaaccgaatattgaatgttctcacgtacaagtgggagctaaatgttgcaaacacatggacacatactggggcctatcggagggtggagggtgggaagagggagaagatcaggaaaaataactaatgggtactaggcttaatacctgggtgacaatataatntgaataccaaacccccatgacacaagtttccctatatgacaaacttgcatatgtacccctganntt

SEQ ID NO: 237981 - DNA, 291 bp, Homo sapiens
tagtagagacggggtttcaccgtgttagccaggatggtctcgatctcctgacctcgtaatctgcccgcctcagcctcccaaagtgctgggattacaggcgtgagccactgcgcctggccaattttcaggctttttattggtagatactttataatgtttctttagttggtttgcaaaaatggtcatagcttcatggttgtggcgtctgattttcctcatgtcaagtgtagcatcttccttgagttctaaccttctgttcacattattatgggaaagttattgaagagttga

SEQ ID NO: 237982 - DNA, 678 bp, Homo sapiens
tggtttcgaacacctgagctcaagcagcccacccacttggttcccaaagtgctgggattacaggtgtgcaattaatgacaaattctttcagtgtttatctaggaatgtcttaatttcctcttcatttttgaaggagagttttgctggatgtagaattcttggctaacagtctttttctttcaacactttgaacatgtcatcccatttgtcttcttacgtccatggttttctgatgacaagttagccattaatcttattgaggatctcatcatgtatgtgaaaagtcgtttttcttttgctgctataaatgttatctctttaagttttgtcaatttgattatgatgtatctaggtgtggatcttcttgactttattctacctgttgtttattgagttacaattagaattcattatgtaaactaatatttttcataatattttatttatttttggtcatcattcaaatatttttcctgccctttttctctcatcttctgggactctcatttatgtgtatgttgctatacttgatggtgtcccacaggtctctggagctctgttcaattttcttcatttatatatggattctaggtattaatgccaattaatttgctgatttttttttaattttgcaagtttttatattctgtagtgacctttacattttctgttattata

SEQ ID NO: 237983 - DNA, 425 bp, Homo sapiens
gctaagtgtttgctaggggcagcttctggccctgactgcttgtggggtccaaggaaaagcactggcagctcttctgctcagtggctttgtcccctgaagatccacttcaccaattctttaatgcgtgatctctgacttaatggcaaagaaaagtaaaagaacacggcttagtggcaggctgtgatgatcccagaagaggcattaacattcggcttcaggaatgaagcctcattcccggcccaccgtgcggtctcagagtctgagaaccacgagatcaacagcggcgccccctcccggcgcacagtcccgcggacggccgcgcgggggcagcacgcggcccggcccccgagcgcccgcggttgactttgcaaaaaattgggggattttccacactcgcttccctcgtcgttcgtccggcggccgct

SEQ ID NO: 237984 - DNA, 446 bp, Homo sapiens
ggctctggagccagcctgcctggagagttgctggctcctgcctcatggggcagttgtggggattgattataagtgcagttagccctctgtatctgcaggttcctcatttgtggattcagctgacaacagaacgaaaatatttgaaaaaaaaattaacaatacaatagaatacaaataagatgcaatatagcagctgtttacacaatatttacattgtattagttatgaataatctagagatgatctaaagtatacaggaagatgtatgttggttataggcaaatactatataccatgctatataagggacttgagcataaggagtttggtttctgagggaggtcctggaacaaattccccgtagatactgggattagatactgaaggacgactgtgcctgggacatagtaagtgctcagtgaatgctataattatattttaataaa

SEQ ID NO: 237985 - DNA, 860 bp, Homo sapiens
gacagataaattttgaaatgcaaatgatcaccttctgttatttaagtatagtttctgccaacttagtgatcctagattttaaaaagtcataattatttcaacaatgtatactcccaaggatgcccaagattcacaagtttctataacaaaactgagaacttttaaaaaagttgccacttttttatattaaagaaaacaaatccaacaacaaaaagacaaaaaccatggagctttctctggctacatctgtgaaaaagccagcgcataaatggctgcagctgcagacccatcaagagggtcttgagaatacgaattcactgatcaaacccagccctgttttcaaagtagaagccattccttttaggttcactttgtatccttagattatctaggatgattctctagaaaggttttattttaaataaacatcattcatggtaaatgggttcctttcataccacagaaacacagaatggagttcaggaagagaaaaggcaaaagaaatagtccacaaagtaggaacagattgtatagcatgacaatataaatataacactgtctggtttccacattaggagacttgtagatactttattaggatacttttacacaggttcttctgctttttttgttgtgagggattagagaataaaaactggagtaaattggttatttttctctggaggactttcttctggttactctgattttatatctgtttttacacacatacacacaaaagttttagccaaaagattttatgtgctttatcatttgatttattaacttatgataataaagaataaacctttgtttatagtgttttaagtataaaggaaaaataaaatgtcaaagtactt

SEQ ID NO: 237986 - DNA, 284 bp, Homo sapiens
ccaggaacatgtatctcagtgatccaccattgacttggttaggaaatttggggtagaggagggcttctcgaaaatgaaattgccttcaggtcttgccagttgatgcaaaatgcatcgaggaattataacattggaaggaaagggggctttcctttctccatcatttatcatcagggagtcagtggaaccaacgttctttctttgaaaggtgggtctttaagagtgaaatattgaatctttctttcctttttctttcttttcttaatagtccacgactttttcta

SEQ ID NO: 237987 - DNA, 573 bp, Homo sapiens
actatttcaacaagctttttcatgtaactaatctgcggaaggtagaaaggggaaaactgttgggtgctaaaatgacaactggttcaaggtacaatggcgaatatttttatttctgcaacttttcttagaggttggaaactggactgggcaggaagattcctttttgtaagattagtctccagttttcatcaagcagtttagtggggtattttaggcccagttccctctccacagtccccaaaggtcttctgttaactttaaatccgcaaagagagagatctctgccaagcagcaactgcaagagcatgtgggtcaatgttaccagcagacactcaaagccccttccctttacttcaacaccgctttataaattatcttagagacgttgtcaggttggtattagaggtgagtggtcatgacttcacgatttctcatctttctgaatgcatagtggctgggagtggtggctcatgcctgtaatcccagcagtttgggaggccgaggtgggcagattgtttgaccacaggagttcgagaccagccggggtaacatggcaagaccccaatctctacc

SEQ ID NO: 237988 - DNA, 572 bp, Homo sapiens
atggaggaaagtgaatggattcaagaaatatttgaaaggtagagctgatgggattcggtaaatgatgcaacctggggagcaagggacaaggtaggaaaaaacggagaaatcaaggaaaacatccaagttttctactttgggcattggacagcatggtgctgtgacttcaccaagctctcggcagtacagaaatggaaaatgagcagtctccagtcgtgcggtttgaaactaaggcgctgcgcctccccggataagtatcaaggtaacacagtggtgtagggcggcggctcactcagttggaggaaaccacaccttcaagcaacatcctctcctcggaacgagctttaaagtgaactgttgatggaatccctccagccatctttgagctctttctttgtccggagaagaggctgatccctccagggctgatctacatctccaggataacctctgctccagaggggctgacgggagcccagctttttattctctcgaggttcttcccaagaaaagcccaatcttataaactgttacttcccctaacaaagaaatacagattatccaagaatcta

SEQ ID NO: 237989 - DNA, 283 bp, Homo sapiens
aatcctcctgcctcagcctcccaaatagctgggattataagcacatgccaccaggcccagctttctaatgctttatttaaaatgtatacaatgctatgtatcaattgatggagcaccctaagattttagaggtcagaaatgtaaaacaatgaatgtttaccagactacctaacaatgtaattacttttgtatagccagatttctatattatctataatatattctaaaataatatagtcattaaaatgacgtttatgacatcagatgttggctgagcaatgtt

SEQ ID NO: 237990 - DNA, 808 bp, Homo sapiens
ctaatatgggaatgacagccttgacctacattttggggtgaggaggagaaacaacataacaatcgttgccaagtccgttgcagatgtcaagcaccatctaagagcttcagtataacacagacatgcttcccatcaagctgtcattttcttttctcctcctttcctggtgcctgggtggcttttcagccacatgctgcaaatttgccattcagttcctatgatttctactgccccataaccttaattttaccttcctgtttgaagtgtacccccaccccttccatccctgcttctgggcctgtcagacttagcttaaaccttcccaaaccttccctctgctttcccacccaaccaagatgcacttcctccaccaggtctccaacagcacttgagtctgtagcgtgcagggtagcacttgctgccctactgccttaaataagtcttgcatggtttctggagtattcatcttaccaggaaaactagattgtaagctcttcaagggcagggactagatcttacagatctctagtctcccttaaaagggctcaaaagttccccagcagctttgcaagttgggcctctctctcttcctctgcatttctttcaggtttcatggcctgtctctccgatcatctatttgtttttttgtctgcctttcaggcaggcattataacttcttctgtcagcttctccatctggcctctgttgctattccctgcagtccagctacctgcttgtagcttgctgtccctctgtctggtcttctgtctatcagttgcttaggcatctctcctattacccaaatcaa

SEQ ID NO: 237991 - DNA, 478 bp, Homo sapiens
ttccttccactcattccacaattcccaaagttactatatgatatgacatgcctattagaagggatttttatatgctataaatattcatttcctcccatgggctacctgatgattcttttgaatactactgtaccatgtgttatttctcttttccttagacactgctatcaacacatgatatgcaaactaaaaaaactgagctttttatgaggtgcttttaattacaccatctcacttccaaaaaatcatctttggtacacatggataaagggaataattgaaatttaaagcctttaacacatacaaattacagtttgggctacagtttaagagttgtgttgagtgactttttattcctataagtaaaaataaacatttgtctgcatcttaaacagctctgaatgtctccagggcagcaaattcagtggttgctaataatgtagaaatttaataataatatttgatacctacacttcta

SEQ ID NO: 237992 - DNA, 602 bp, Homo sapiens
atgaattttgtaaactgtttttgagagcatctaaatgtagttttatgagtagcattgttaccattgtcgctgttctatttgctgaatcttgtttaatttggaagctccctaattcacagtgatttgtatagtggggtcatcactctgtaggagctctaaatggagactctgtccatgatttccaaaaggtcatccaccccagagtcacatgagactggaaagcaaatctttttcattaattggcttcaagtactttcagcttcaaatggaggtctctaagggtccttggctggcacatcaagggggcatttcaaagaaagtggcaaaatcttgactaaacttcagagcaaacacgcactcttttctttgctactctctttctaaaaagaaaaacaaattatactggtctgggttgtgtgagcatgtgtgtatcagcttgttctaattctcttttcccaaccccttctttgcttgtcccattttcaagataggataacacccaggtttttatattaccttctgtgttaggactttcttaggattcctaaaaattttggctaagtagcattaggcctgctctatttcacaggtaggcataaaaa

SEQ ID NO: 237993 - DNA, 311 bp, Homo sapiens
taaccattgccctgagtgacaggcagagagagccaagagccttgaagctaaaatggataagtgaatgtgatctccaatcacatactcagccaaagaggattcctcataggttcattctaatgttttctacatcagtggccaatggatgtgtgcgatttgcacggatgcattatcaggcatagtagatacatgatagggacatagtagctatgaggtgatggcaaatttagtggcctaacttatttcattgttatatcaaaatagcaatgaaaagtctaacagtaataaataatctacttaattaatacagt

SEQ ID NO: 237994 - DNA, 313 bp, Homo sapiens
atttggaatgtgtaagccgacattataaacatccacctacaggtttttgtgtgaacttggtcttcatttatcttgactaaacaccgcatgggattgctgggtcgtgtgacaagtgcatgtttaactaactagtaagaaattacaaaccgcctttccaatgtggctgtaaattttgcattcccaccacaaatatatgagtgtcctaattgctccacattcttgccagctcttcatattgttggtgtttttttattttagtcattcttttgtagatggactattctgtgtgcattaaatttcctttgcatcttta

SEQ ID NO: 237995 - DNA, 572 bp, Homo sapiens
gtaaatggaacctccatacatctaattgtgcaggccagaaacctagggtccatccctgattcttccctgtccttcacatccaatcagttctcccatctttaaaatgcatctggaattgatgttttttctacctccactcctagccttttagtcaaagtcaccaccatttcttgcctatattactgtgatagcctcccagctgctcttcctctttttccccctctggagtcttgctctgtctcgcccaggctggaatgcatgagttgagatcgctccactgcactccagcctgggcaacagagcaagattcttgtctcaaaaaaaaaaaaaaaaaactcaaggggggacccaatacccaattcaccctatagtaagtcatattacaattcactgaccatcattttacaacatcataactggcaaaaccctagcattacccaacttaatccccttactacacatccccctttcaccaactaacataatagcgaagaagcccacaccaatcacccttcccaacagttacacagccttaatggcgaatggcaaattataaaccttaatattttatt

SEQ ID NO: 237996 - DNA, 523 bp, Homo sapiens
ctgatttacttggagttgaaaatattttcaagtacctgggctcatgaaggaagcctgttggagcattgtaatacaagggttgcaagcctctgggaaagtctatcttgcattcccatgcagaatatttaacagtagtaggatccacagcaaagaagtatgcctattcctgcaattatcatcaaggtcacaagtaactttttccaccaggatggtcctgacctgaatcagagtgcaaatcattgatctagtggaaatgtagggtcagacgtgatgtgaatttgtttatgcatattatttagggctaatgagatatttcccaagttgtctagaatgtattatataacacttggttttaatgtaggcaaaggtgcccccttgaacagccattagaatatctagtgccagctgggcacggtggctcatacctgtaatcccagcactttgggaggctgaggcgggtggatcacctgaggtcaggagttcgagaccagcctcgccaacatggtgaaatcccatatctgct

SEQ ID NO: 237997 - DNA, 396 bp, Homo sapiens
taatgggagaagaagaagcactcccatctagattgctgtatcagaatggactgttatgattgcaaatggcagaaacctaactcaatgcaactataacaatgagggaaatgtcttggcagctcttgaaatccatggaagaacaaaatgatccaggtgctggagggacagcaacagagctggacctcaggtgctgctggagccagaggctcaattttcactagtcttccttccagcttcatctctgtctctatcagtgtattgatattcttctctctcaatacagcctggttctttccacatagtcccagcgcagcatttatcactctgtattaacttatttatttgttttcttgcttactttcagtctctcagtacaataaaatatgttgaaggcaa

SEQ ID NO: 237998 - DNA, 460 bp, Homo sapiens
agtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctggg

SEQ ID NO: 237999 - DNA, 665 bp, Homo sapiens
caaatagaatccacacgactttctctccaaggttggcaggaaaggggggcttgaatgctgcttttctctggtttctccaaatctcagtccttggctgtcctcacctgatttccagcaccatgtctttccatgtcagtttactctcattcagaatttaaattcgtttactctgtaatggagtttaagatagtttttcagaactgatggatgatgaacagttgcagcgtccaggaaccacttcctagtgtcctgggagacaatcctcccagtgaatgaaaatgacaaaaacatccttcccacagaagtcaccctgtgtactggttggttatttccaacctggtttgaaaagtaaagaagttgcactgaggggtaagtagaactgattgaaatctaggtgcctgtgctgtcctgctcttcccttatgacgtttagaacatttggtccatttttgtaatccctgtttatgctctaagtgaggaattgtaattttgatgttaactgtatgccttttttttttttttttggtaaaaaatgtatcttgatatccccagttcagaatcaaaacaaattactgtgcctgttaccgtgtgaaatttgaagattgcaaatatctctcttaatgttattacttgactccattaaaaatagattgtgaatattccatg

SEQ ID NO: 238000 - DNA, 376 bp, Homo sapiens
ttcaatacaatagccactacccatgtgtaattcttttttttaattcagtttttttcctgacaatagtttgttgtttgaccagtgaacatacattttaagtgcatattcctgtgcttagaatttcatgagacagccaagcatggtggctcatgcctctaatccaaacactttcggaggccaaggcaggaggattgcttgaggccaagaattcaagaccagtctgggcaacacagtgagacccatctcaaggaaaaaaaatttggctgggtatggtggcttatgcctgtaatcactgcactttgggaggctgaggtgggcagattgcttgagctcaggagttcgagatctaggcaacatggcaaaaccccatctctac

SEQ ID NO: 238001 - DNA, 684 bp, Homo sapiens
ccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctga

SEQ ID NO: 238002 - DNA, 888 bp, Homo sapiens
ccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccgccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctga

SEQ ID NO: 238003 - DNA, 2815 bp, Homo sapiens
tagtacattgaaattcaaagtcatgcttgttactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctacgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggccggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagaacttaattcatctaatccctcctgtttgtctcaaattataggataactttgaaactttctgaattaacgttatttaaaaggaaatgtagatgttattttagtctctatcttcaggttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaacgg

SEQ ID NO: 238004 - DNA, 710 bp, Homo sapiens
  misc_feature (675)..(675): n is a, c, g, or t
  misc_feature (683)..(683): n is a, c, g, or t
  misc_feature (689)..(689): n is a, c, g, or t
tagtacattgaaattcaaagtcatgcttgttactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaacacctaacttttcaacatgcacaggacaagtacgancatgtggnccaccntctcaaatcttcaatgtgaaa

SEQ ID NO: 238005 - DNA, 131 bp, Homo sapiens
aatcacagcaccaggataaaggagctgcttgggcatggcctggatagaggggaggcagcggacatgtttgcacaacagaaagtgttcaacttgaaggccaaggctcatggtaggtggtctgtgaaaggcac

SEQ ID NO: 238006 - DNA, 1316 bp, Homo sapiens
  misc_feature (703)..(703): n is a, c, g, or t
aacaaatgattgatacccacaataacctggacgaatctccacagaattatggtgagtggacgaagggtaatcccaaaggttacatgtagaattccatttaagtaacattcttgaaatgaataaattataagagtggggaatagattagtagttgccaggggttaaggagggaaggaggagcagcactgaatagaaggggtcataactataaaaaggcaacatgatgaatcccggtgttgacggaaatgttctgtaccttgcttgtataaatgtcaatctcctggtactgtggcatttgcaatatttgcaaattttatttatttattcattcattcatttttctgagacggagtcttcctctgtcgcccagactggagtgcagtggcgcgatcttggctcactgcaacctccgtctcctgggttcgcaccattctcctgcctcagcctcctgagtagctgggactagaggtgcccaccaccatacccagctaattttttatatttttagtagagacggggtttcactgtgttagccaggatggtctcgatctcctgacctcatgatccacccactttgggaggctgaggcaggcagatcgcgaagtcaggagttcaagaccatcctggccaacatgctgaaacccccgtctctactgaaaatacaaaaattagctgggcgtggtggcgcatgcctgtagtcccngctactcgggaggctgaggcaggagaatcgcttgaacctgggaggcggaggtagtggtgagccgagattgcaccattgcactccagcctgggcaacaagggcgaaaccccttctcaaaaaaataaaaaataaataaatataaggttttatgtttttggatgaaacaatatggtaaatagtaggctgggcacggtggcccacgcctgtaaccccagctctttgggaggccgaggcgggcggatcacttgaggtcagcagtttgagaccagcctggccaaaatggtgaaaccctgtctttactaataatacaaactaaagaaaaagtaagaatggccgggcgcggtggctcactcctgtaatcacagcactttgggaggccgaggcgggtggatcacctgaggttgggagttcgagaccagcctgagcaacgtggagaaaccctgtctctactaaaaatacaaaattagccggacgtggtggcgcatgcctgtaatcccagctactcaggaggctgacgcaggagaatcgcttgaacccaggaggcagaggttgtggtgagctgagatcgcaccattgcactccagcctgggcaataagaggaagctccatctcg

SEQ ID NO: 238007 - DNA, 349 bp, Homo sapiens
ccagctacttgggagactgagctgggaggatcacttgaggccaggagttggaggctgcagtgagctttgatcatgccactgcactccagcctgggtgacagagcaagatctcatctcttaaaaaaaaaaaaaaaaagataaaaacaaatattcaaactgtgaaggtgaagttctccagccaattgaagatttaatgttggtggagatttactttagaatgatgatggattggcttcttttgtggtaatagctgaagagtttgggaagctgaggcaggtggatcactggagctcaggagttggacaccagactgggccatgtggcgagatcccatctctacaaaaaatac

SEQ ID NO: 238008 - DNA, 2192 bp, Homo sapiens
ataaaagaggaaaccgaagctcagaaagattaagtgctcgttggggtgagctgagaccttcaccgggtctcctgtcatctctctcccctcgcatctgctctcttttctgaggacagggcctgatcttagtcatctttgaacccccttctggtagtatgcacggtgctttgcagcagtcaaagctcaacgcataatggctgaataaatgattgcctggaattgagcgtccaccgagctctttctaggtcagggagtgggaatggggctaaggaggagaggtcaggtggggatggcgggtggcgtggcagccctttgccgtgtctgtgaactgtcacggtctcctcagccacgcggaaagcagcacactggtggtgtccggttgggtcaagctgcaccaggtaattaagatgccttcctgctcagtgaaggaggaaaaaaaaatcattgatgctgggattgttccaaaatctccattattagattttatctggatgagtttgcatttgaatgaaaaactgtccactttgctaaaagcacagttggaaggtccatcaagtcatctgttttgatcaattacacttattccttagcaaagattggctgtgtttcccacaggcaatgctcttgccgcccatgctggtaacatttttatatgtctctttaacttaagggaagagcctgaagatttcaccctagtgccaagttccaaatgcccttggtggaggctacccaactggccccagctgcttcagagctggctgcaatcctgtctccccccagacccacatctgtcaccctccccggggtgcccagtacactaggcttttcccagggagtgatttttatttctgtgagtcgtcgcctgtctcccttaggacactctagcacatagggcaccttgatgcacgttagaaatcggcgctgcccctgggaattgcaaaagatgctcccctctgggtggaccaatgataacaagagtcaccttcctcaggactacagacgtgagctggggcacgtgtctggcactcacggctttggctagtgatgcctgggctagatttcaggtgccattccagccccctctgcagggcaagctcctgtggcacactgcacagctacatgttcgggttctgcctctgtctccaaagcctcctcggtgaggaagtgagtggggggtggacttgtacttggttacatgcatgcacacataaatgcatagcagcacatgtatatacatggtacacctgccacatacatgcatgcacacatatacacacacacctgcacacgtatacacatggtacactgtcacatgcatgcacacacacgcacagcagcacatgtatatacgtgacacactgccacatacatgcatgcacacacacacacctgcacatgtaaacacatggcatactgtcacatacatacatgcacacattcacaccttcacatgtacatacatgcacacacacctgcatatgtacatgtgcacagtgccacataaatgcatgcacacacatacctgcacacctgcacacgtatgtacatggcacactgtcacatacatgcatgcacacacatgcacacctacacgtatacacatggcacagtgccacatacatgcatgcacacacatacacacctgcacacgtatatacatggcacactgccacatacatgcatacacagacacctgcacatgtacatacatgtgcacactgccacatacatgtgtgcacacacaatctaggagaaagagccctcaagcatacagggaggcattagagtggagcgattaagggaaggcgttttcgcactgtgggaaacagctcattgaaattagtgcagttggcaacagaagcacccgggcggtcttccttggccacccttgtcctttgttgcttcatttttctctacagcattccccaaattaccaccgtggatgctgcaattttgcatgtgggtcttattcactgtctccctccagtcaaacgcaagctccaggcaggcaggggtttttctctctcaagatgagtgcattggacacggcgagtattattctgtttttggactccgtttcggttctatgcggacgcgtatgtgtacactgggagctgatgtagaatgtatttcttgctgtgagatgaacaaaaaggtttgaaaacacggaattaaaccatgtttttgaagct

SEQ ID NO: 238009 - DNA, 1253 bp, Homo sapiens
ggaggggcggctcagccagagatggccctggcccgtcctaactgggctggggtgcccccattccctcattcacggggaggagagggaagtcttagtcttactactttatatggtcgacctccctacctgcctggtctgggaatggcttctcaagagcactcgggctcattcttagcagaggaagctcttctggctagcctggcgcccgtgtgtgtgtgtgtgtgtgtgtgtgtgtgtgtgtgtgtgtgtgtgtgtgtgtgtgtgtgcgcgcgcgcgcgcgtgcgcgctgaggtggagggagggtgatctggattccaaattgcagtttccaacattaaagttatgctgtaatgcttctgattcataaaatgagctcatagtctcacagtatcctgaatgttgcttcgaatgcaaatgcaggtcccttagtaagaattggggatttcagcctactacaccctagccccggcccagcatgcaatttttcagtcccagagtcaagagttctcatgtgcagaaagaagcaattcctccaacagaatgcggccactggctctgcttcctgccacctgcagtgagtcagggaagaatggagccccaggctgcttctgtactgatgcatgcacgcctgcacacacacaggaagggtgccaatctgggctgaccaaaggaagtgcccaggctagcagatccctagggagatggctccacaactctttcaccctgaggtccccttagggtcaggatgaccgacacatgcactccacaaggccagctacagggcagtgccaggaaactgggttcaccagccccagaatcacccacggtggactgacatttttgaaaccagtgatgcaatctgaggaggttccaggagcagggactcactgggcccaacacatgacaagtacacaatttttttgatggagatctttcactaatttgttcaactaacatgcactaagaccaggtgaggtagttcaagactgtaatcccagcactttgggaggccaaagtgggtggatttcttgagcccaagagttcaagaccagcctgggcaacatggcaaaaccccatatctacaaaaatagaaaaattagccaggtgtggtgatgtgtacccgtagtcccagctacttgggaggctgaggtgggaagattgcttgagcccaggaggctgagattgcagcgacctgagatcgcactactgcactccagcctgggcgacagagaaagaccctatctctaacaacc

SEQ ID NO: 238010 - DNA, 522 bp, Homo sapiens
gctgcgtgagcattttaggcgggtccttacatcattcatcacattaaactgtaacatactgtcagaattcactgggcattagagtagctgtctggcttttgtgtagacaaaatactttctcaactccaccgcttgggcaaaggcaaggctgtgctgacccaatttccattccttctaagcaagcatttttctcatttatttgttcaactgtttatacttcatgctaaagccattttttaaatgagctatacatagattcatatgcaaaactatcaacaataaatgatatgtaattactaaactatgtttaatattatactaaattcagctcaagatttgaaatttaattaaagattttttttaaatatgaagctgtggtgacttatttaaaaacgaacatcctggacgggtgcggtggctcatgcctgtaatcccagcactttgggaggccaaggcaggtagatcacttgaggtcaggagttcaagaccagcctgggcagcatggtgaaaccatgtctctac

SEQ ID NO: 238011 - DNA, 575 bp, Homo sapiens
atcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctc

SEQ ID NO: 238012 - DNA, 453 bp, Homo sapiens
agtagccgggactacaggcacatgccaccatgccaggcaatttttgtatttcttttgtagagatggcattctgccatgttatccaggctggtctgaaacttttgagctcaagcgatccaactaccttggcctcccaaagtgctgggtatagtgtgaaccactgtgcccagcctacaattaatttttgttttattaaatattacttgcttaattccaacaaaggctaagtgtttgtgtgtgtgtttgtgtttaaatacctgtatatttgatcttgtttggttactaagctaatgttaaattctttcttaatgacacagaggaagtcccaaggcaattcttatgtatagacccacccatctatcaggcctctgttaaatatagacaatgtctttgatgtggaattgcttgtatttttgcagtaaatgcccataaaataaaagtgaattgacaatg

SEQ ID NO: 238013 - DNA, 184 bp, Homo sapiens
gattacaattcttagaactttcttctttctttctctctcttcctccttcccaccctctctttcttcctctctccctccctcccttccttcctttcattctccatctttctctttttttccttccttcttttctctttctttcatcagttattgtttcatttagcaatgtgctactgaaataaaa

SEQ ID NO: 238014 - DNA, 420 bp, Homo sapiens
cacccagcctgtttctttttttagtaagtttttcacggaccgtaaaattcatcccttcataatatagaattctatggttatttatttattaatgaatgaatgaatgaatgaatgaaatggagtctcactctgttgcccaagctggagtgcagtggcacaatcttggctcactgcaaccccctgggttcaagcgatgtttttatttttattttattttttcagaccgggtctcactctgttgcccaggctggggtgtgtaatggcacaatcttgtctcactgtaacctccgcctcccaagctcaagccatccttccgcctcagccccccaaatagcttgggactacaggcgcacaccaccacacccagcctgggcaacagagggagactccgtctcactaaaaaaaaagagaaaaaagaaa

SEQ ID NO: 238015 - DNA, 502 bp, Homo sapiens
acttgttgctaatatgtgtccattttaaaaaggaaaaagtggtatctaatgagttaatcattaaggagtatgcgcagtgccggccatttcaggacatgaaagtttctgtggagctgcttgaaacaggaaggagcgacttgacatcaagtatttaaactttttgatttatgttttgatagatgacattgataggtataaattataaataagtttgagtaaccagtttaatatgtaaactggtatttcatctacagaaagttctctgtcattgtttggagctctttaaaataactcagctggggtgtttaagaataaaaacactagcagtgagttaggacatctaatgcttttaaagatagatgtatatgtcgcaacgatagtgtaagaatcagctgaagctaccggtgaggttttggttattttctttcagtcatctgagtccatttccaataaaggttgtttttttgtttcgttttttgtttttttttaatggggacaatga

SEQ ID NO: 238016 - DNA, 730 bp, Homo sapiens
cactgtaaatttcataaaatataactgtaggcatatttcagagaggttacatcatagtgatacttaatctccttttaaggacacatggcatttttccatttattgcattttatactgatgtttttcagtataaactttttgcataataatcattttttatccttcttgagacttttttggacttcaagaaaattagttttaaaattagtggccaggcacggtggctcgcgcctataatcccaacactttaggaggtcaatgcatgcagatagcctgagttcaggagttcaagatcaccctgacgagcatggagaaaccccatctctactaaaaacacaaaattagccaggcgtggtggcagaggcctgtaatctcagctactcaggaggctgaggcaggagaatcgcttgaacctgggaggtggaggttgcagtgagccaagatcccaagatcgtgccattgcacttcagcccaggcagcaagagtgaaactttgtctcaaaaaaaaaaaaagaaagaaaataaattagtccagcctgggcaacatggcaaaccttgtctatacaaaaacttacctggtcatggtgatgtgcgcctgtagacccagctactcaggagactgaggtggaaggatctgttgagcctaggagttcaaggctgcagtgagccaagatcccaagatcgtgccattgcacttcagcccaggcagcaagagtgaaactttgtctcaa

SEQ ID NO: 238017 - DNA, 352 bp, Homo sapiens
tgagtagcatggggcagagttaggtcctcatttttaatggtctcatataagatttctgaactacagaggacattactatatctgggtaggaggaaataaatctttaaatttgaaataataatatacaattttaaatatcattttccaaatttaatttcattttcacctttaatatttcctaaggattcaagaatcagatgcagggattctgtttctctccatttttattgttattgttgttgttgttttacatttaggatttcaatgtggaatctcagatttcttttgtgaactcctttactgtcagacaattaaccagaaataccaaataaatgaagatgggaaaacacta

SEQ ID NO: 238018 - DNA, 906 bp, Homo sapiens
cagcctacttcattttcaagttatattattttattaatgtagtttggtgatcttacagcagagctggaagctgtatcttcaaaatatgtctgtttgactcaaaacaatcaaggtattcaacaggagttattatgtatgaaaaaatacaacaggaatgtaaaaatcttgaggaggctaaaaagatgttggaaaaagtaatattaaatcttaaaaaacgtatggaaagtacacattggtgaagacacattggtgaagtacaaaaatataaattggatctagaagaaagggcaatgcaggcaatggaaaaattagtacaaatccctttacagtaatgattctcagtgtggagtcatttgattattaagacccattgacatgagattacatcctctgcctataaaaatcctggaagaaaacctaggaaatattcacctggacattgcacttggcaatgaatttatggatagaaaatgcagttgaaagatatttcataaaggaagaaaaagtaagaatacaggtgagagatattactgagattttctttcagtgcaattctggtcttttctgactagcaatatttttatgtgcagaagtagtagaaaagataaatattttgtacagtagaaaaacgcatcatttctgtgccatggaagagagaactcacaaagatgacagcttctggctatgttggatactaaccagtactgtaagtacccagcgatctgacgttaacattggctgtaaagctcctttaatgttccttgcaatgatttgaacctgttactggaaccctcatcgcttattgagttgaaaaacattgttgatatgtgtttatcttatatttgcagtagagtcataattttacttcttagaaaattatacattaaacaaaaaagacacatgaaa

SEQ ID NO: 238019 - DNA, 704 bp, Homo sapiens
  misc_feature (499)..(500): n is a, c, g, or t
gtgatgagaggatatattaaaggctaaagaagggcatgtacaaagacagggtataaacatctcataagtgtctttttacatgtagttgattcaatcctaatacttgtagagggccagtggtgaagaggagggagcctacgcagtattcttagtctgcaggagagataaacttcttgagaaatctcttactgtacacattcttgccacttgatattcaaagatcaggaaccaggctgatttggacaacttgttatctacgccttactctctgaactcggaacctcataaatttggatagtgaggaatacattattcctcgtgccgaattcggcacgagatctgcctccactcggcctcagttcctcatcactggtcctgtgctcacagtcatcaattatagaccccacaacatgcgccctgaagacagaatgttccatatcagagctgtgatcttgagagccctctcccttgctttcctgctgagtctccgaggagctgnngccatcaaggcggaccatgtgtcaacttatgccgcgtttgtacagacgcatagaccaacaagggagcttatgcttgaatttgatgaagatgagatggtctatgtggatctggacaagaaggagaccgtctggcatttggaggagcttggccaagccctttcccttgaggctcaagggcggcttgcctaacactgctatattgat

SEQ ID NO: 238020 - DNA, 599 bp, Homo sapiens
agatgtcaggcttttttaatcttactcaactctgaagaagctgagtggcctatagatgaccaaaatgctctgatggcttcttgcagggagtgtgcatgtgtgagtgagtgtggcgtgcatgtataaagaaaagcttttctctgaaaagagcagagaagggcatggtgacctcgatgaaagtgaatgatgcatcttttccctgcccactcccagccccatctcacatgttatttattatattgaagggttagaatctggggcaccctggtatcttcctgtatcctatgctcttgctgcctaccgtttttggggttcactgacaaatccttgctgactggagtcggggtgtgtggagtggatcacttcaattcatgccaggagaagaatcattagattctaaatgcattcagaagacagggggcagagagacagactcggaggatcacagaggctcctcaaagctggttttgcaaagctgtgacagaaagcctcagaaaagcactggaaggctggcttctgcttcaatctatcatgagaagccatcaagatgttgcctttcttgtactgccattaaaaatgcaacatctggctttaaaata

SEQ ID NO: 238021 - DNA, 2069 bp, Homo sapiens
  misc_feature (117)..(117): n is a, c, g, or t
  misc_feature (699)..(699): n is a, c, g, or t
  misc_feature (1267)..(1267): n is a, c, g, or t
  misc_feature (1560)..(1560): n is a, c, g, or t
  misc_feature (1580)..(1580): n is a, c, g, or t
tgtatttttagtagagacaaggtttcaccatgttaaccaggatggtctcgatctcctgacctcgtgatccgcccacctcggcctcccaaagcgctgggattacaggcgtgagccacngcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcatacacttgttctttgtcctttggccgtgcaccaaagtatgacatcatctgcctttaaaaatgggtgagggtagtgttaaattttcaaaaagaagttctgatactctcattttaggaattaactctgttttgtggcttgattcctaactgcttttaatctgatttctttttcatgtagtagcatctaccgtgtgtttttgcacaggtgggaaagagcaaggttcgtttatacaccatttctccctccaccttacctttaaactttttttttttttttttttgagncggagtctcgctcagtttcccagagtgcagtggcacgatcttggctcactgcaacctctgcctgctgggttcaagcaattctcctgcgtcagcctcccaagtagctgggactacaggcatgcaccaccacgccgggctaattttttgtatttttagtagagacggggtttcaccatgctggccaggctggtctcaaactcctgaccttgtgatccacctgcttcagcctcccaaacctttaaactttaaacctgccttgcaactatctcgttgacatctgtcaccattgtcaggttcatttccattatatgttgcattctgccttaaaaccatgatagctactatttgtttatttactttatttatttggatgctctgcctccttccagagatgattgaaggtaactcatagtcatcactctatgtctgcattcagacacagaggagcagataggttagataatagacattttctgttctataatattttgtttggtcaccaaacagtgctgcccatgttatcaaactgatcaccgactccctgactttaggttcaaatgtttgaacntttttctctatttggaatccttctcacctctttaaaaaggaaactgagctccttgtgggcaaggatcctggcttcctggacactgccaaatgtgacttcgttttgaagcctaaaagatgagtcttcccccgttgtttctgctgagacaaggctttgcagaagaaattctttggcagctcagccctttctgtaaccagttaataagttacattttctagaaatgttctaactttttgagggagttactgcatgtcttagctttcttctagatcatgtttccaaaagttgcctgntcatgtgaatcgagtagagnaccagttcctaaccttctccaggagataattctgggaatctgtattttaacaagccccttgacattcatatgatcagacaagtttggtatatactgttttggatgagtagtgactcttccccttctgttttgctgacgtaaggattaaaaaaccaaactgagcaatctggagtctcttgtgatttgtatcaagctcattttctcatattcagaatagtagcagccattctcctaaattaaacactacctgaggacatggattatgtcctatttatttttgtgtccttagcatcttgtaccatctctggcacatggtaaattctcgtgactgaaccctagtacagcattgtgaaggacttaactttgcagaagagagattttattttgttatctaaataatttttccttgtgtgtctttcatcagaatggttcacgctgtactatagttattactactctgtttcttctaaaattccagcaagggttgat

SEQ ID NO: 238022 - DNA, 169 bp, Homo sapiens
gcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgctt

SEQ ID NO: 238023 - DNA, 361 bp, Homo sapiens
ctctggttctatgtagttatccaggtgataccaggtatgcttatgttaatctttaaaagagtatcagaatggaagcatgaaatgaaaaataatttagaaaaactgcttcttggcttaactggccagttttaggaaatattctcttctccaggttcaacttggataccagttcttctgggaagccttctgtaatttaaaggcttaaaagcatacctattgtatttgtcagggttctccagagaaacagaacatattagtttagacatatatgcacacatatacatatacatacatatatatacatatataaaatgtatacacatatatacatatgtaaatatatatgtatatatatgtgcac

SEQ ID NO: 238024 - DNA, 849 bp, Homo sapiens
aggggttttcccttaaaaaacccctaaggaaattggtaaggggcattttaaaaagctgtactttaaaaaataataattcttacattcatttgaaggttttttgtttgtttgtttgtttgtttgtttttgagctgaaggcttgctcttgcactccagcctgggggacagtgagactccatctcaaaaaaaaagaatggactaacccttgtttaggtgttacaaaatccaggccagaccagtctaaactttaatctcatacccagttcctagatgagtcccttctccagctcaggttcggcctaagcctcagggttccttacttggtgggcaccacctgctcccttccccgcctttgttcctctttttcctctgctggctcctccggggttgggtgtgttcagaggcagagacaggctaaaggtctttggcttttaggttctgttgatgggtgagttccagatactagctttctcttgtaggatatttcatttatttatctattaaaaatatttatttagaacacaccattcatgtgccagaccctgttccaggcactggggatagggtgataaatgagatcaacaaaaatacctgcccacattaagctcctgttctagggaagacaaaaaagaaagaaaatacacgtgtccttagtacattagaaggttccaagtactgtagagaaaaataaagtaggttggactcggtggctcatgcctgtaatcccagcactttgggaggctgaggtgggaggattacttgagctcaggaatttgagaccagcctgggcaacatcgtgaaaccccatctctaccaaaaattaggtagatatagaagagtgcacttttg

SEQ ID NO: 238025 - DNA, 866 bp, Homo sapiens
aggggttttcccttaaaaaacccctaaggaaattggtaaggggcattttaaaaagctgtactttaaaaaataataattcttacattcatttgaaggttttttgtttgtttgtttgtttgtttgtttttgagctgaaggcttgctcttgcactccagcctgggggacagtgagactccatctcaaaaaaaaaaaaaaaacacaaaaaaagaatggactaacccttgtttaggtgttacaaaatccaggccagaccagtctaaactttaatctcatacccagttcctagatgagtcccttctccagctcaggttcggcctaagcctcagggttccttacttggtgggcaccacctgctcccttccccgcctttgttcctctttttcctctgctggctcctccggggttgggtgtgttcagaggcagagacaggctaaaggtctttggcttttaggttctgttgatgggtgagttccagatactagctttctcttgtaggatatttcatttatttatctattaaaaatatttatttagaacacaccattcatgtgccagaccctgttccaggcactggggatagggtgataaatgagatcaacaaaaatacctgcccacattaagctcctgttctagggaagacaaaaaagaaagaaaatacacgtgtccttagtacattagaaggttccaagtactgtagagaaaaataaagtaggttggactcggtggctcatgcctgtaatcccagcactttgggaggctgaggtgggaggattacttgagctcaggaatttgagaccagcctgggcaacatcgtgaaaccccatctctaccaaaaattaggtagatatagaagagtgcacttttg

SEQ ID NO: 238026 - DNA, 1803 bp, Homo sapiens
  misc_feature (1366)..(1366): n is a, c, g, or t
tttttataaaaaccctagaagaaaacccaggaaatactattctggacataggccttggcaaagatttcctgacacagactccaaaagcagttgcaatgaaaacaaaaattgacaagtgggatctaattaaattaaagagcctctgcatagcaaaagaaacaatcaacagtataagcagacagcctacagaaagagtgaaaatattcagaaactatgcatctgacaaagatctaatatccagaatctataaggaacttaaacagatcaacaagcaacaaacaaccccattaaaaaatgggcaaaggacatgaacagatacttctcaaagaagacatacactttgccaacaattgtatgaaaaagtgctcaacatcactaatcattagagaaatgcaaatcaaaaccacaatgaaataccgtctcacaccagtcagaatgactacaattaaaaagtcaataaataaggctgggcatggtggctcatacctgtaatcccagcactttgagaggtcaaggcaggtacatcacctgaggtcaggagtttgagaccagcctggccaaaatggtgaaaccctgtctctacttaaaatacaaaaaagtacccggatgtggtggtgggtgcctgtaattccagctacttgggaggctgaggcacaagaatcgcttgaacccaggagttggaggttgacctgagatcacaccactgcactccagcttgggcaacagagtgagactccgtctccaaaaaaaataaataaaaataacaaatctacaaacctttagcttgactgacaaagaaaaaaagaagaaatgtgaataactagaatcagcaatagaagtggagacattactatcaaccttacagaaatgaaatgtaagagaagaaatgaaatgtaagagaaaaaacgatgaacaccaacaaattagataacctagatgaaagacaacttcctagaaacacacaaattatcaaaactgactcaagatgaaatagaaaatacgaacaagcctataatatgtaaatagattaaatcagtaatttaaaacctcccagcaaaaaaaacatctcaaactacaggactttcttattgaagtctacaaaacgcttaaagaataatgaacactggccaggcacggtggcttatgcctgtaatcccagcactttgggaggcggaggcaggcggatcacctgaggttgtgagtttgagaccagcctgaccaacatggagaaaccctatctctactaaaaatacaaaaaaaattagccaggcatggtggcgcatgcttgtaatcccagctcctgggaggctaaggcaggagaattgcttgaatccgggaggcggaggttgcagtgagctgagatcgngccattgcactccaggctgggcaacaagagcaaaactctgtctaaaaaaaaatgaaaagaataatgaacaccaaacctcctttttaaaaaagttttcttccctaaaaaggaacactttttaactcattctatggagcaattattacatgtataccaaagctacctaaagacaccacaagaaaaaaaaaaagcaatatttccatatgactgtaaatgtaaaaaattctcaataaaataatggcaaactcaatgtaacagaatattaaaagtattatacagtatgacaaagcaagatttattacaggaatgcaagggtagttcaacataagaaaatcagtgtaatacaccgcattaacagaatgaagagaaagaaaaccacatgattatttcagctgatataagaaaagtatttgacaaaatctaactcttttatgatt

SEQ ID NO: 238027 - DNA, 682 bp, Homo sapiens
aaatagacaaaactatgatgtaaaaatgcttaaaaacaattattcctctctgctaattttaatgcaaaataaatgatgctagcatttaatatgtttatatgatcttgtttttaggattgaaattttaatacaatggccttttgtaactatttttactattatagctcaggtgtttgaattctctctaccccacctatcacccctatcccctaacaaagagtctggcttcataaatactgttgaatgaaaattggttctctaaatggttaacaagatgaatccacataaatcataattcagtactgaggaaccgaatttatacccaacatctaggcaaaatatattataatgattttctgcatgtgcattttggagaacatgatgccatatttcctggagaagtacaatatatttaatctgaataataatgagctgcattatcaggtatttcagcattctggctgataacattttattttgtaatgaatgaatgattaaatcatattatttaatacaaatatgaaaatcactacattgaagagtaaatcttatgtcttcctaaagatgacagtcataaacacaaaaataagcaagcagatgaaagcactcataacaaacatgataacagtataacaaatttcctttgtggctcaccaaatagcaaagttgaaatgtttccatg

SEQ ID NO: 238028 - DNA, 542 bp, Homo sapiens
atattgtaacatgaaatacatttatatccagaatttcctccaaatagcttatactaaaggaaatactgacttcctccgcaccgttttatataagaaacaagctgcaagttcacttctagtactatttacattttaaaagaaaataaatacatagtatttaagtgatttttcaagatctacaaagaggaatttaattctaccacatctttaaaaaaataaacagctttatgaagattcgtgaagacagataaaaaggaagtgaatatattcctgagggtctgaacaattttccttacctgatgtattatggaaaaattcagaatttaccagtcttccttcagtcagctacattttacactgacctgccctttggactgaaagggaaaaaaaaaagattaacttgccattgaaaaatttaaaataataatcagaaaccggacaaactgaaggtaaaaatatacaatggctacaataaagataaatatttatttaatcacagtagaggttgtgtttggactgtaggaatgtttcatccttccctt

SEQ ID NO: 238029 - DNA, 497 bp, Homo sapiens
caacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaa

SEQ ID NO: 238030 - DNA, 2690 bp, Homo sapiens
gaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcaggataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgag

SEQ ID NO: 238031 - DNA, 927 bp, Homo sapiens
agcgggggcgcgctcggccaggccggcctccctaaccgcctccctaccgccctctttaactcagggtttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgttgtgtacagcaagacagtgggtcattgtgtatgtacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacaaagaaagactgagagtaaatggggcttaaattgttgccagagagtttattcctctttgacggagacgattattgatacttgcgtaaggccaccaaagaacaagaggtggctcctgtgggacccgccgggggtgggcaggccagccctgtgtttatcccatccttgcagcaacacgcattttgggtctgcggtataggccccgcagagccgagggtattccgggaccacggggcccggccccttgcgcttttagtttgaccttcccattttggtgcgcctccaggggaagggcggttccccgcgcctgtaggttcc

SEQ ID NO: 238032 - DNA, 974 bp, Homo sapiens
gaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgttgtgtacagcaagacagtgggtcattgtgtatgtacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgaaagctcccagtgaggaactggtcttctggagaatcacttggactccagaggtggaggttgcagtaagctgagatcatgccactgcaccctagcttgggtggcagagcaagactctatcaaaaaaataagtaataaatttgttcaaaagtcctgca

SEQ ID NO: 238033 - DNA, 2795 bp, Homo sapiens
gaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgttgtgtacagcaagacagtgggtcattgtgtatgtacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcaggataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgag

SEQ ID NO: 238034 - DNA, 417 bp, Homo sapiens
ggagaacctgtacttccatttacagcccctgagtaagtccaggacaaagtctccaggctctgtattccagaacaccgcctctccagtagggaagactccgggagcatcctgccttcccaggcgggaatggaggccaggaggctttgcccagaccttgactgtgctattgccaagtgaccagctctggggcctggctcctctgccacttgggagaggactcggcagatgggcttcccttcaccccagtccctgctccccagccagagaccctgagttccagcccagggtaatgaggggaagtaacagatacacctacttttaatccaaataaaggaaaaatgtttgccaccatggagtttataaaaataacaatgcattattcgggtattaataacaataaagatgtcaaactgtcag

SEQ ID NO: 238035 - DNA, 2603 bp, Homo sapiens
  misc_feature (550)..(550): n is a, c, g, or t
  misc_feature (1843)..(1843): n is a, c, g, or t
  misc_feature (1895)..(1895): n is a, c, g, or t
tcttcgattcttcgagccttttggcctactgaggtggtccaagtactccaagatgttgggtgagagaagctcatgccaggtaaagtcactaactaggtgagacagccaggaagagtttgggattcacaacggcagcacctacgacagagatactgcccttcatcaaaccactggggcaagatgattcattgaaatgttaccctgtgctcatttggtttacatttgctcctcccctggctctttcaagcagagagtgagtcccttggtgtttccttgccttgggtatttctggtggtcagagcataaaagctatcggaagttggtgggtctttctgtcttttgcaataatcttgacctaaatttttttttaaatttcttaattatttttagagacagggtctcactctgccacccaggctggagtgcaatggtgtgatcatagctcactgaagcctccaactcctgagctcaggtgatcctcccgcctaagcctccagagtagctgagactacaagtgctcaccaccatgcccggctaatttttctttttngtagagacagagatctcgctatgttgcccaggcttgtctcgaactcctggcctcaggtgatcttcccttctcagcctctcaaagtattaggattataggtgtgagccactgcacccagccttcgttgactctttatagagactctgtaaggtgtcctggaaagagaagaaagaaagggtgggcctatgattttttgttttttgagatagagtcttgctccgtcgcccaggctggagtatggtgacatgatcagggctcactgcaacctccatctcctgggctcgggtgatccttccacctcagcctctggagtagctggaactataggtgcatgccaccatgcctggccaatgttttgtatttttagtagagatggggtttcaccatgttgcccaggctggtctcaaactcctagtgctgggattacagatgtgagtcactgcaccaggccaagggtgggcctttgagagcaggaagaagggagaggaaaagatttttaccccagaagggaaaggggcagagtgtgactagggctgggggtagggaggaaaggtctcaaaccttgactctaggcagtgtccaaaggtgacaaggccttagaggacatggctgcctggtacactcagggagagtggatctgagcacagagctttcgcccctccctcacaattcccacattccaagggtgactccaaatcagcagagccaccaagcctgaggtgccacaaggctgggatgatggatgttctgcatttgctagtgtgaccagtggagccagcctgacgcctcagcactgcctaagaccctgggaccttggcaaaatcttgagaatgggggagggagactcaacgatatgcctgagattgaatttcttgccagctcagtgggatagtggcttagagtcagatttaaattgaattagaaaaaatcaagaaacaggccaaaccactccagccttgcaatccctcgggctatccctagccacaccccttactctcatgctcaccaacaagcagtgcctaccaccactggatgccccatgtgacccatagctgaggatctttatacaccctctccccaggagtgggcatccacttgtgtttccctggacagggagcttccaatcttccatcctgaggtcctgctagaatgggctgttagaatattccctcactagatagaggggtggggaagcaggagtccagtttcagaagcagggaagggactacagtcatagcgagtggtggacacgtggcggagggtgggacaccctttcacaaagtggcccatcanaccacaacacagtatgggacagggctggcttctcttcagctctgcatggccngggagggtacctacctggggtccagctgcccccccgagcctgtctatcagccattgtacaccaggccagtccatgatggggttcacccaggatgagacctggacagcagttgagccatgcagaagcaagtgggtggttaagaggcagatggtccagttggtgttttcaggcaaagtgccagctcctcatcatggctcatgaggatgcttagatccagcccctgatgaccccctatttcacctctagccatttcctagcacagcgcctcctctgtcctagctccagcctcactgagctgctttcagtcccttgaaggagttgcactctccttcctctcggctcttccacaggctgctccagacgcttgaccactcctttctttcatgtacctaattcctactcatccctcaggacccaatgtggctgtcttctctaggaagccatctgaacttataagttgagttaggagtctgttctggacctcccacagcaccctgattctcctgtcttggcccctgtcataccttgtgaagtcttgtttaatcatctatctcatacatgtcagtatgcttctgggggaaggaaatgtgtccatcttgtttaaaacagtatctttagggcttgatgtctagtgagggaggaagggaaggggaaggaaacgataagggcatgggaaggaaggatggaaggaaggagggaaggaagaag

SEQ ID NO: 238036 - DNA, 874 bp, Homo sapiens
ttttattaagaaatatcacatataaaaaaggtttataaagaatagtaaaataatactcctgtatctaccactgaagttaagaaacattatcagcaggatgatcattaactcacaatctaaattggaacacttgagaaagaaatgtagtgctattaaaaattgtatcagtatactaagcatgaactggaaatcagaacctttatttaccagtggctttacaagtaacttggttaccccctgaagttcacatcccctcttcctactctcaagaggtaaccaataaaaccaaatatatttatctattctactgttaatgaacatttttttgttgttgttattgtggaacatccctgtacaaatctcctggtacacaagtaaagattttctctacagtacttacctaggagttgaaattctcagttgtagaataaatgtgtgttcaattttaatacacaatgtggcagtaggttaatcattcacctatattttcttttaattttttccttttatttatataacctacacctctgtaatctgttttgattttaatatattggtgacaatctaatgttttccccctcaaataactaattttcgtaattctatatgttgaataatcaattcttttccagttggtttggcatgtttcccctaaaatcaagttcttatacaaattataatttgctttagccctacctattgtgttcaattaggttgctagtattaactatatattatgatgacattaccaatcaatctagtacaagataatatacagcaattaagtgaccagaaggtttgtgtccctgaatttactgtcttaatatctcctggccaaaggctgtgacaacttaagtctccttttcctttatca

SEQ ID NO: 238037 - DNA, 705 bp, Homo sapiens
  misc_feature (332)..(332): n is a, c, g, or t
  misc_feature (354)..(354): n is a, c, g, or t
  misc_feature (463)..(463): n is a, c, g, or t
  misc_feature (564)..(564): n is a, c, g, or t
  misc_feature (699)..(700): n is a, c, g, or t
atcaggtaaggctatttttacatcttttgtggatcttcagttacttcaggccatctggatgtatacgtgcaagtcataggggatgccatggcttggcttgggctcagaggcctgacaatagggactttacataggattaggatggattagaacagaagttctagaagcaggtgagaaggagtggagggtagggataaggaaggaagggatttaagaagacattgagaaggaaaggaccacaagactgagaggaatggatgaggagagagggaagaaggccgccacaaggagagggaagacaagcaacacccggccaaagccgcgccggcggngaaacagagacgacacgcacancacaacagaagcccacaagcagcgaaccacaaacggacccccgacaaagccagacgcccgaaggacaccacggaggcacacaccaccgacgacggacccaaggaagacncgccacccccacggagaccccggcccgccgaggaccccccacgcccgggcaaccgccaaagccccgagcgaacccaacccccccacaaagcgcgccacggnccaacaaacacgggccccgggcgcacaaccggccggcccccccacacaaccggacaagccccccacccgagggcgcgccccgcacacaccccccccacacccaacaacacccggggccgccgccggacccccgcnnccccg

SEQ ID NO: 238038 - DNA, 493 bp, Homo sapiens
ctaaacactcctcaacttggggcaacaaaagtagaaaaatattaatcaaatgctctcccgaaagggtggaagggaggaggagaggagatgtcccattcacagtggttgacagccaggagtggagctctgccacttggaaaagggaaagtccctcatgggtgggcagtgcctggagagaagcgggtatttgggatgtgcgcagcggcgcaccacccttcttgcttggagatattttggcttcccatcctatagactgtggccccttgatgcgcagttggctgataggttgactggctactacttaattttcctccgaaagaaaagcccacctgtgccaggcctgagaggtgtcctgagctccacccactcctgggggagtgtgtttcacagttccctcgagtaagccctccctccgccctcttttcttcacactgacggaagcttattagagtgcaggggagtgagggtgtgattagagagcaacattgagcct

SEQ ID NO: 238039 - DNA, 382 bp, Homo sapiens
atggcttaccccaggagcagcacttccagagcagttgccgttcccatctgtgagccaacagtctcccctctccctaggcaccaagcccacagctgtcccatcaccacctcatttgatgctcccagctatcctgtgatcaggtaagggaacacaggctgcataccaaggctccaggtcccagggctgaaagcccttttcctgggtgggcagcgctgcctggaagcacgtggccaaccacctgctccttcactggagggtctggagtaagctatccaatgtggcagccattggccacatgtggctttctggtacttgacatgtggctagtccaattgagatgtgctatgtgtaagatacacaccagatatcatagattaatacc

SEQ ID NO: 238040 - DNA, 483 bp, Homo sapiens
tcttggggccatcggattgctagagactagccggcttctcacagccacccctaagacacctgccttaaccccaaggatggaacaattaggtctcaaaggatctattgcctcggtcagcttggcacaggctgagagggagatgctgctgctgccgccttttctgcactctctccagcagacacagccaggacccaatgctgatgatgaagaaatacaactattaaagaagagagaaagaaggaaacttctgcagctatttgatctgctcaacatccaagaaccgatctggcatggattttatggctttattttgttttgctttgctttgtttttccttgaattcatgagttgttctgatgttatggagacagtgtcagtaatagttccaacctcttgcctcctgggggaggtaagaaacaactacgtgcaatctatgaatttccaccttggttattaaaggaattatttttgtaaccattaagt

SEQ ID NO: 238041 - DNA, 1799 bp, Homo sapiens
  misc_feature (165)..(165): n is a, c, g, or t
  misc_feature (260)..(260): n is a, c, g, or t
  misc_feature (389)..(389): n is a, c, g, or t
  misc_feature (890)..(890): n is a, c, g, or t
acagtttatgtccttactgaacagaagtttgtatgtctactttccaagtatcttggaagcattactgtagattaacaatccaataagtgatcattggcaaaggagtagtacatgtgaggattaaatactgaatagctccagtgtatcacactcttgaattctcanaaagagaaccaaataaattggaaagaaaccaacactagacatatggaaatttttcaaataaaatatgttttcctctggctcagtccttacagctnttgtacaacagcccaactttagctgtcatgccagtgcctctaaaaacttccatttcctggcagagctttactggcagtgtttctatctctggtcgaaatcacagtgatacaatacatttacacggtacnttagtctcaccagctcctcccacttttgcaaatagttccgtaagtgaacgtttgacacttggaaagacaacaaatgtttttgcttactatgtgtcactgtaacattagttgaagtcattttctatattaataaatgatgcaagtgcctttaaaaatatctaatggaccataacctaggacataacagtctcttattgaatctagccagtattcttagcaaatatctcagtatttccataaagccactggcaagtgatagcagcccgtttttgcagttaagaaaattgcagtagcaacttagatgtatcatctaaagcctccttgtccaataatatttttcttatatatgctgtttccaaaataatatgcctcaaaataaaataagcatattcacatgtcagataacaagtttatatagtcccttggttacagatgcagttgcaaaaggaggtggaaggcatccaaaacacaataatttttataaaatgagataaaggactnggaaacagtccaagatgtgtctagacaataatagcctcccctaattggagtgatagtattcattagatttattaatatccactgaaatacaaaatgaaataagaaacacattttataccttggcttagtaagtggcagaaaaacagtatttgtctgcatttgttccgttaataactttataccagtagtaaccagaagaaactcctagataggctgtacaagtggttttctagcttcttttaaaaaggaactactgggttgatatctaagatatattaaatttattaaataacttcttaatgtcagaaattcaagtataaattgtttttgacattaagaccaactcctgttcattacaagcacctgaccaactgtcttaatagaaagtactctagactcagtagcttataaacaacagaaatttatttctcacggttctggtggctaagaagtctgagatcaaggccccaataaattaggcctctgatgagggcctgtttcgtgattcgtagatggtaccatcttgctatgttctcacataatggaaagggaaaggcagctctctggggcctctttttattagtgcacgaatcccattaatgaggaccccacccttatgacctaatcactccccagccacgcctcccaatacgatcacattggtaattaggtttcaacatatgaattttgtggagagacaagcattcggaccataacaacaacattcttaaaactaccattgtaggccaggggcagtggctcacaactgtaatcccagcactttgggagcctgaggtgagagaattgcttgagcccaggagttcaagacctgcctgggcaacatagtgagacctcatctctacaaaaaatttaaaaattggctggggtggtagagcaagatgttgtctc

SEQ ID NO: 238042 - DNA, 895 bp, Homo sapiens
cgcgtccccatgcagccctggcagtgcctccggcgctttgccctggcctggtgggagaggacggcggagggcagagcccgctctcccagggaggaggctggaccgagggaccctgggggccgaggggagccagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggttggcggctggaccgtggaccccgtatgcctcctcagctccctctgctcccacctccatggcgactccgccccctccggggctggccagccggcccagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggtactgcccgcccagtccaccctccctccccacacaggctcctccctctgctcttcactccctggagccccctcctcccctacagcacgccagctcgcctcaagctctgctctctttcccacagccccttctccccaagcaaccccagctctctccatctctctc

SEQ ID NO: 238043 - DNA, 429 bp, Homo sapiens
ttcccgcagggacccccttgggggatgggcagccccaggccgggcgcgccgtgacccagccgtgcccctctcacctctcgcagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggtgagtgggctcccggctgcggctgcggctgcggccgcggccag

SEQ ID NO: 238044 - DNA, 758 bp, Homo sapiens
aaacctgccacttaattaatgtctggaactaatgccccaatttgctcaacgattctgctgctcacctcggtgacaaatttgtgttgttcttcggaagcctgaaatagcagccgtgcccatggctcccactcacatggcctcttgtctggcttcccagggtgcctgggtcctttgcccattccttacctgccgggtgtcccagggaggccaaggccagcagagactggggaactctcttgtggccatgccaggagtctgtaatctgtgtgggagtctgtaatctgtgtgggtgtcgctggctggcaggaccttcccaggcctggatatgggcagtgacaagcaaaggggggggggggtgctcatccttggttcctctcaccctgcccggcccctgcagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggtactgcccgcccagtccaccctccctccccacacaggctcctccctctgctcttcactccctggagccccctcctcccctacagcacgccagctcgcctcaagctctgctctctttcccacagccccttctccccaagcaaccccagctctctccatctctctc

SEQ ID NO: 238045 - DNA, 675 bp, Homo sapiens
cgcgtccccatgcagccctggcagtgcctccggcgctttgccctggcctggtgggagaggacggcggagggcagagcccgctctcccagggaggaggctggaccgagggaccctgggggccgaggggagccagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagacccgcagctcacgccacactcagggagcccaggcggcgtctccttcgcaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctgg

SEQ ID NO: 238046 - DNA, 773 bp, Homo sapiens
gcctgggtgacagagctagattctgtctccaaaaagaaaaaacccatcccagtttactgttgaaacctcatccccagccaagtccccacttgttctacatgcttctgttcggccacctttccctgaatgctacagcagcacccctgcgtgtaacgctgttgagcctggaatgcccttcctctgtttttctgttaagggccacctcaaattccctacccccacccccaactttttcatcagagtcagttcttcctcctctattcctgttacacctaccacataactagtataacaataggcatgctacactgttgtttgcttatgtggccttctggcattaaaagctgctagttcctggaggtcagggacatgcactatttactatttatccacaagatcaggcattcaagaaatgttcgttggatagaattgaggtgtttggacaggctgggcttataagtgccagtttgtttcagggaagacattttctcaaaggttttctgatttaaagtttatactgtcatttcctgagtattccagtggattattaattacctttactttgccccttggctacaacctacttggcaataaaaataccaagccttttacttttcaacatttaggacttggtagaagacttgattaggcatagggaactgttggctaaaaggaagttgatgaattgcttaaagatttcatttgttatgattttctcttataagggattaactgaggaatactgtaaagttgttatttatcttctggtggtg

SEQ ID NO: 238047 - DNA, 515 bp, Homo sapiens
gcggtatgatgaatttgaggcatctgtaagacctgaagtgctggcattcagaaggcttaaaatgtatgggtgtggagctcggaagtggggtttgggtaagattagggagtttttcataaagatggtgtttggagaaagaggaaatgactcccctggaaaggacttttaaactgttaagaagagggcctggaaaagaggtgggagtctatgagttagggtctggagggtgggaagagaatctgaaagtgctttattaatcccagcactttgagacgccaaggtgggtggatcatgaggttagatcgagaccatcgtggctaacatggtgaaaccctgtctctactaaaaatacaaaaaagtagccaggcgtggtggcacgagcctgtagtcccagctacttgggaggctgaggcaggagaatcgattgacatgggaggcggagggtgcagtgagccgagaccatgccactgcaccgcagcctgggcgacagagcgagactccctgtcaaaaaaaaa

SEQ ID NO: 238048 - DNA, 133 bp, Homo sapiens
agcggtaatttaatcaccataaaaagtgaaaactactaaaattctgaaaaatctgccctcaccattgccctttatgaattacaagctctttattttagccacagatgactctacacccttccaggaacactcc

SEQ ID NO: 238049 - DNA, 713 bp, Homo sapiens
gtttaacctaatccaactagatggaactagaaaaagaatatagaaaatttagggggaagaggtggctacttgtcagatgtagccaatttcctagtgctttaatagagttatgacttccagaaacaggcagggtatggtggctcacatctgtaatcccagcactttaggaggctgtggtgggcagatcactttgagctcaggagtttgagaccaacctggacaacaatcccctctctctacaaaaaaatacaaaaaaatttagctgggcatggtggctcatgcctgtagtcccagctactcacgaggctgaggctggaggattgcttgagcctgggaactggaggttgcagtgagccaagatcatgaccctgaatgccagcctgggcacagagtgagatagtgtctcaaaaaaattaattaaagacttccaaagacagcaatacttatttttctttaccttttatgtattagaagaggattccaaattttccaaagtccctcctaacaccaaatatgtaacttgttctatcaaaccaagtcttaaaatacaacttcaaaagaaaatatgtgcttggcattcaacaggccttccataagtgttcactgaaggttccaaatctcccaatcatagccaagaaatatatttctccccaatacatgttttctcctaaactcaatagaactgtatattaagatactaaatacatgaatca

SEQ ID NO: 238050 - DNA, 354 bp, Homo sapiens
tggggaggcagcagggaggaaaacctgcagtcactcaccccagttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctaca

SEQ ID NO: 238051 - DNA, 473 bp, Homo sapiens
ggacctggtgggaggtaactgaatcgtgagggcggtttccccatgctgttctggtggaagtgaataagtctcacaagagctgatggttttctaaggggaaaccccttttgcttgttctctcattctctgtcttgctgccgccatgtaagacgtgccttgcgccttccaccgtgacggtgaggcctccccagccacgtggaactgtgagttcattcaacctctttttctttataaattacccagtctcgggtatgtatgtgtcagcagtgtgaaaactgactaatacacctagtttgacttgaatcagataaacagcaaataatttttcgcatatgtatgcttcatgcgatacttggaacatacttacactgaaagtatttctagtttatgtgaaattgaaatttaattgaaagtattgtgcttttgtttaatgtatttctagtttatgtgaaattgaaatttaattgaaagta

SEQ ID NO: 238052 - DNA, 484 bp, Homo sapiens
ctgacactggattgggaccagactagagaatgtgggcccagaggaatgatgtatgagatgtgaaagagttttcctaaattcatctcatattttcttgtctgatagttttcaatgtggaatgaacatagctataagccatttcttgccacaagcctttcctcctatttcatgttagtttttaaaattatatataacgaactggccaggcgcagtggctcacgcctgtaatcccagcactttgggaggccgaggtgggcggatcacgaggtcaggagatcgagaccatcttggctaacacagtgaaaacctgtctctactaaaaatacaaacaattagctgggcgtggtggcgagcgcctgtagtcccagctactcggcaggctgaggcaggagaatggcgtgaacccaggaagtggagcttgcagtgagccgagattgcgccactgcactccagcctgggcgacagagtgggactccgtctcaaa

SEQ ID NO: 238053 - DNA, 361 bp, Homo sapiens
cgaaagaaggaaaacaggaaatggattaagagcagggggagcatctgactgagagcacaaactgcagattcatgggttcaaatccagactctagctgtgtgatcttggtcaccgttctgtgccttggctttctcatctataaaatgaagacaataatagaacatgcctcataggattgttgtgaggatgtatataaaatacttaaagcctggcacatagtaagcactcaagaaatctttgctgttatcgtcattctaaaagccgagtgttcaagtctccacctgaacattcagaggcaaagcagagcctggaagctcacaacagtctatagtttctggcctgtcatagaacaggattactt

SEQ ID NO: 238054 - DNA, 596 bp, Homo sapiens
cttgaggtctctctttggaaattgactataaactctagccctgccctgattggaatccaaggagtttggtcatggatgtttacagtgtgcctttggtgggataattctttatcctggtggatggcttaatgtctaagtgtccaacctgtgaccagatgtccctttcacaggaaacctgtttatattggcagatgcccttgtggttctcctctgacttgtgtccagtttattcttactctggtagccactctctaggagagctctgactgggaaagaagtcaggttcaggtgtgttggtcaggtgagacagaggaagcagcacaaaaaaaaacatagggagtaacagaagcagtgtgttccttacagatccatgaaagaagagggatgctgatgaaagacaagcagaagattgcagagggagggacaggaggagactggaggtgggggtgcttgggggagaggccaggcatcatcatgctcaaccagcaggtagcaagtgagagagaaagagagagagagacagacagagagacagagagagagacagggccctgtgaggagttctaattggtgggtttagagaaagtggacctgag

SEQ ID NO: 238055 - DNA, 1860 bp, Homo sapiens
tttataataaaatacctacatgttactttagaaaaaaataagccagtgaattctgatataggcaggtgagacttaatgaagtatgtgggttatcaactggaccttgaagtacggctaattatttggctaagtatagggaaactggaaaaacatttcagaccagagacccaggatttaaggcacagaggtgagaatgggcatgtttgttgatacagcagcaaagagattgaccttaggaaaccagtggtgcattaggggattaatgatgtagataaagactgagagtcaaggctgattttggagtgtcttaacagtctgaaacagaagtttagatttgatttctggttaaaaaaaatcagaagaatttgaaatctgttctttctacctccctttattcatttttttcctctttctcttctgtgtatttcccttcctaggaaaatacttcatacaaataaaacggaaagattaattttaccaccaaatacaagacaaattacaagtttactttttaaattttggctttctgcattcttttaaaactagaagctgttttccattaacagtgacagacagcagtgtaaccatgtgtgtttgctagaactaaagagacgtccctatctcagattgctgtggcataacccgtggcatttattcagagtgaggctgttttaagagaatgagcattaactgcaatgtagtcctacagagataactgaacagtctttttgctattgttcttacaggtgtcctacgcattattccttaccttctctggagaaattgattcaccagatttgtcagatttttaaatgtaatattttgttttatttgaaatcaaagctaaagaaatatgttctttgctctaagaacatattttagctatgtttagctaaatagctaaacacagtttaatcttttaatttaatggctactgacttgtgcttacataatctgaaagttcacattgtcaggctgcttttttccttctaatcaacaccagtaattttactctgcattctaatatattacctgtgttattatctttaaaatgcatccacgaatgatctgtttacatttaactttttcatccctttgattcttcatcataaccttaaaactttggttttaatgacaatcaaattcaaaccagaacgaatttaactctaagttcatattattagatatctttccttatttcagctatctctaccagcagagcttaagaaaatccgatttgacttgactagacttactaggacatatctttctgtaagatttccaggtcatcacacacagctcagcttctttttgactttctgaactttgccatgtatttgttgcaaagtatttccgtagttcaaccctgtactcataccttcctagtcagtgacattgccaaaggacaagtcttgcatagaattaaagtgatgggcagaatctttatgatatttttcaaagtgctttatgtaaaatattaggtaattgactagctttaggtcaaaccatgggtaaatatcaagcacatgattagaaaccagttcttggccaggtgtggtggctcacgcctgtaatcccagcactttggtgggctggggtaggcagatcacttgaggtcaggagttcgagaccagcctggccaacatggcgaaaccccatctctactaaaaataaaaaaaaaaaattagccaggtgtcatggcgcatgcctgtaatcccggctactcaggaggctgaagcaagagaatcgcttggatgcaggaagtggaggttgtggtgagctgagattgcaccattgcattccagcttgagcaacagagagagactccatctcaacagcaacaacaacaacaacaacaac

SEQ ID NO: 238056 - DNA, 440 bp, Homo sapiens
agcacaagtgaggaggtgtgcttgaaagagaaatggagtgtctggaagtgggtgagtatattctggtaggtgtgacaaaggcactgttcctccaacaccagtcctgggaaaggcatatgatatggtttggcgctgtgtccccagccaaatctcatgatgaattatgagcttcagtgttggaggaggggcctggtgggaggtgactggatcatgggggtgaatttcccccttgttgttctcgtgctagtgagttctgagatctggttgtttaaaagtgtgtggcactgccccttcactctctctcctgccgccatgtgaatatgtacttgcttcccctttgccttccccatgattgtaagtttcctgaggcctccccagccatgcctcttgtatagcctgcaaaactgagtcaattaaaccttgtttctttataaactatc

SEQ ID NO: 238057 - DNA, 128 bp, Homo sapiens
ttatggaggcttgggttgccctgatgggggtcagcaatgttagggctttcaggtacttagtggttattaattatattccttatataatagctgaggagattaaggattaaggaagagaaatgatttgc

SEQ ID NO: 238058 - DNA, 291 bp, Homo sapiens
cagcctgattttaataatgaaggaagaaaatcatagttaatctagggatgaaaccttacctcttttggtgcctagaagttaaactattaggctacattcacatgtaatattttagaacatatgttatcttttttactgtccagtggtcacattttcctactaagaaacattaaaatctgccaggcgcagtggctcacacctgtaatcccagcactttgggaggccgaggtgggcagatcatgaggtcaggagttcgagaccagcctgaccaacatggtgaaaccctgtttc

SEQ ID NO: 238059 - DNA, 404 bp, Homo sapiens
tgggattacattgtttgagattactaggatatgtggttcataagcactttcatgtatagtcaagttattgctacccgtctcagtgtagaagtggcttacaggaaccaccacccactgagataactcacctgacatcagagactaaagtgaaaggtcagagatctgtcacaataagaatgtgtgctgtgacatgaggcaccagaagtctgtggacagtgaagccaataaatccttttaacccctagatgtagaaaattataagcgtattactcagtctcatcaaagtctagtcaaaatggaagctctcttctttaggaatatacttattaaatatgcatatacaattatacatacatcatgaaataaaatgatctcttgcatatttgcacatgaaattaatagaa

SEQ ID NO: 238060 - DNA, 439 bp, Homo sapiens
cgatctgatcccatgtgccctaaaaggcagaaagcctcctcccactgatcgcaacataggatttcacagagatttgaagtatgagaaaatttgaagcagacatactcagtacgtgttgctgtttggaacctggaggagaccacatgagaaggagtgcaggcagcctctaggagccaagagtgacagctcacagcctgtgaggaagcatggatctcagtcctacagttgtaaagaaaaggaattctgccaacaacctcaatgagtttgaagcagattcttccttggtgccttcagataagagcccagccctgccaactccctaatttcaggcacgttaaaactctgagtagagaatccagccaaccctgtcccacactctactcccacttctgacctagagaactttgagctaataaacgggtgttgttttcagtcacta

SEQ ID NO: 238061 - DNA, 3170 bp, Homo sapiens
aaagtacatcctttttgtctccattttttccctttcttaaacaaagcaaacatttgtatactcacacactgaaggaaaaaagtgcaagtgttataagataattagaacggttaggataattgccttttatggatacataatgcttcagttgtttactgctaaatgaaatgtaaaagtatatattagactaaggaatagtgtacaaaatagatctaaatacaaaggaaattgtgttctgtctgaaaatttgtagatgggtctaaattaacaagaataaattaagaaggatatatacacactcatttatacccttgtgcgtatctcacatatgtgaacacacacaccaaatacactgaaatgtccatatttagtgccaaaaattgtgatgaaaaaccagtgggattatcctttgtaatagctcattctttaagttgcatttcaataaggcattgctgtgaatccagaggagattgtcaattacagaatttttttcatgatctagtatttgcttggtgcctcagagaaaatggttgttcatctctgcccctcactgttcatgtttgggactattgtttggctgcgccagtagagcttattctgataagctcaccaaatttcaggagtagcctcctttcaataactccacacttgtgcatgtggcttagtgaacttactggtgactcagtcatagcaagaaagggcatctcatgtctatgtgactacaaatatcagggaacagattctccatcaccaaccccaacctctaccctaacacaaaggtgtatgacaaaatgagacaaaatgaaacaaaattgctccacatgctacagtggcctactgttgactagaagccttactgataacagaaacagttgattgacacatatttttaaataaatataatatttctctagttaggttttctatttcattttattttaaagatgacaaaaactaaatatgcttctcaaacctctacctttttcaaattaagtgaagtcttcttctcatttaaagctgtttatactcaatttgaaatatgaaacatagcttcaaatccaacaaagagaatgttgctaactctggataacacttggggacttgagtccctgaaaggctgattgacaaccagattgacaactctgattgacaaccttgcttactttgatagggcttactatacttagtatgatagtttttaaattaatttagagcagaacctttccaagggatctgtgacaagaatggttaaatactgaagtgttgaagaaggaaataatttatcctgaactttgaaagtgtattattactaatgaatttaaagataagtgtagaattgatcatttatcatttttaaaccttttaaattagaattataatgaaaaatgcactccccatcccacacacacaaaccccaacaactctttaggtgcctacaggtaggaaaaattgcatttatctgaattaatcttggagtgaatactaaagttagttggaaaagctcctgaaatgtatgagacctcgaaatatcaattaacaaaaaatagtacctaaaatgtcttctaagaagtgtagtcttttaactaggatccttcttcctgtgtaaacactgaaatgaaattttggaatgaacctaaggtggtcctgaagtgctgtgttactagaaaaagatataattggtggaaagggtgggtggatacacaggaagaagcaagaacctgaactcctgctggctgatggaagaaaatgggtgatcaagtttttgcttctgaatatttgacataaacatcataattaacctcacctaaagaaaacttaaaaggccaggagtagtggctcacacctgtaattccagcactttgtgaggctgaggcgagtggatcacttgaggtcaggagttcgagaccagcctggccaacatggtgaaacctcgtctctactgaaaataaaaaagttagccaggtttggtggtgcatgcctgtaatcccagctactcgggagaccgaggcatgagagtcacttgaacctctcatggcggaggcggaggcggaggttgcagtgagccaagattgcatcactgcactccagcttgggtgacagagcaagagtctgtcaaaaaaaaaaaaaaaaaaagaaaaaaaaagaaaagaaaacacaagaaaaatatttgagagtcctcaaagctttgtataaacacattctttctggtacattcaaaaggaactgatttcagattggtgtagggcaaagcagaaagtaagtgtgtggtcacagaaatgaaaggacaagagagttgacaagagttacaaaagacagacaacagatcattaacattgctgttgatttaatttggtcactagaaatgcggcattcatttttaaaagaacgtctatctatccataccaataatctggagatgatcacactttccaagcagagagctgaagtgaaggcttgaggggatgcctctgcctctcttcattttctttcatctacatggctgaccaatattcacgcattaatagattttggtttctctctggttccaacatttacataatacagtaatagttataggaaagggtttgcatgttcattatataaacccataccgattttttttctacattcatctataaattacatacgagtggggtagctctatttcttgctaattcctgacagtatttattttaagcatgtctttaattcaaagggatcaaatatgttataaggaccacgtatttattatttcaggtgttttacacagtatatcacattttatccttaaacacatgcacatataggtatgacactttatacttgtatagtataaaaatattaggccaggcgtggtggctcatgcctgtagtcccagcactttgggagactgaggcaggcggatcacaaggtcaggagtttgggaccagcctgaccaacatggtgaaatatacaaaaatacaaaattatacaaaaaacatgcaaaaaatatacaaaaattttgtcctaaaaatacaaaaattagttgggtgcggtgacatgcacctgtaatcccacctactcaggaggctgaggcaagagaattgcttggacccgggaggcagaggttgcagtgagccgagatcgtgcaactgcactccaacctgggcaacagagtaagactccttctc

SEQ ID NO: 238062 - DNA, 378 bp, Homo sapiens
aatagagacgaggtttcaccatgttggcaaggctggtcttgaactcctggcctcaagtgatccacccgcctcggcctcgcgaagtgctgagatatcaggcctgagccaccacgcctggccctatgacaatgatctggtgctcccaaatgacccagagagacctctcagggattccccaccctcctaacccttctggtgttcacagggaagctggtctgagctctggccaatcttccatcggcctcgtcttctctcagatttccttttttgcttcccaatctgtcgcccagtctggagtacagtggtgtgatcaaggctcactgcaacttcaatctcccaggcccaagggatcgtcccacctcagccttgtgagtagct

SEQ ID NO: 238063 - DNA, 442 bp, Homo sapiens
ggaaactatactcaaaatgccaatgttataaaagacagagtgaaaagctgttgcagattagttgagattaaagagctatgataactaaaggcaatggatgatccttaccaagacttgtagtggttgagggaaagggtcataaaagacacattttgcggccgggcgcggtggctcatgcctgtaatctcagcactttgggaggttgaggtaggtggataatttgaggtcaggagttcgagaccagcctggccaacatagtgaaactccgtctttactaaaaatacaaaaattggccgggcagtagtggccatgtgcctgtagtcttagctactcaggaggctgaggcaggagaatcgcttgagcctgggaggcggaggttgtggggagccaagatcgcaccactgcactccagtctgggccaacagagaaagaccctgtctca

SEQ ID NO: 238064 - DNA, 487 bp, Homo sapiens
caaatgggagagaaaaacaggaaaagaaaccatgggagaaaaccagagcctgggcaaacgaacatgcaagtggagacatagtgttttctaggacaacaaaacactttagtttggctagagctaagagtgtggtaggtagacaaaattagaatcagattgtagaaggtcttggatgccaggttaatgattttgaactttatattttttattttcctttgttcaaatcccctgtgataagttgttttattttgtttagagtgggtatcaggcagatttctgggtgaggcccagaggagcatttttattcatccatccattcaacaagggactatgtcttatccaacttgtatccctagagtataacacaacatctgcatataagacagaaagtaagtgcttgttaaaattaagcattttggccgggtgtgagcccctgcgcccagctggcatcctgcttttgagcaggaggtggcccaggccgtagccc

SEQ ID NO: 238065 - DNA, 611 bp, Homo sapiens
caaatgggagagaaaaacaggaaaagaaaccatgggagaaaaccagagcctgggcaaacgaacatgcaagtggagacatagtgttttctaggacaacaaaacactttagtttggctagagctaagagtgtggtaggtagacaaaattagaatcagattgtagaaggtcttggatgccaggttaatgattttgaactttatattttttattttcctttgttcaaatcccctgtgataagttgttttattttgtttagagtgggtatcaggcagatttctgggtgaggcccagaggagcatttttattcatccatccattcaacaagggactatgtcttatccaacttgtatccctagagtataacacaacatctgcatataagacagaaagtcagtggattcaaaacgatgaaagtggattcaaaacctctgtcaaggggtgctgtcctttcctggccaagtctcttttattctcttagggctgcaacctcttcacctgggaaatgaatggtcctgtgatttacaagagcagggtccaggctgaaggtgcaggccctatccaagacacaacatttccagtggcagagataaaaaagtaagatttcagactca

SEQ ID NO: 238066 - DNA, 201 bp, Homo sapiens
acgtgataacaaacaaccccaaactctcagtgacttacaaaaagccaattgctttcttcatcacattacacatcacagctgtagattcactgcagctttgctctgtgtcttttcattccagggtccaggctgaaggtgcaggccctatccaagacacaacatttccagtggcagagataaaaaagtaagatttcagactca

SEQ ID NO: 238067 - DNA, 418 bp, Homo sapiens
ccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccg

SEQ ID NO: 238068 - DNA, 832 bp, Homo sapiens
aggtcaggtcataaaaggatatatagctggcttccttttggctctctctcactcttttacttgctctcttggaaagctcacctttggaacctagacgccatgttgtgaggaagctcaaactagcacacatggagaaaatctcatgctaccagcctgcaggcagcatcaggtggtcagacatgtgagtaggcagactttcaaatgattccaggccctagatttcacagagcagaaacaagccattggtactgttctgtggtgtgccatgccaaacccctaacctaccgactccatgaacatggattgtttatgcaactaagttttagagttatttattgtgcagatataataactagaacaactcttcaatttccaagttatgtactattgtcatatattttatctgtattgtgtgttttaattctgttgtcatgtactttaatgttctttaattctaagactttatatagtcagtgtttgtgtttatacatacacatatatataaaactttctttgcttttcattattttttgtatctaagacttactcctatgggctgaacgtttatgtcttcccaaaatttatgtgttgaaattctgatcttcaaggtgatgtaatttggagatggggcctttgaggggtgattaggtcatgggggcagagcccttataaaagaggctggagatctctcacccctaccatattaggacacagcaagaaggtgccatccttgagccggcatgtggaccctcacgagacactgcatgtaccagtgccttaatctgggacttcccaacccctaaaaataaatttttgtcacctataagccagt

SEQ ID NO: 238069 - DNA, 392 bp, Homo sapiens
atttcagtacttaaaatgttcttttaaaatataaatctggtattctcaatgccaacatatggaactgaatttaataacatctctactactgaataccttcttggtaatttgcccgtggaaatatttggaacacttcgtaaattaagcaatcaaagtgtttccaaatgaatcagtaagaaacataattttttcatattttgccaaaattttaaaacataaatttgtgcttataaaatgtttaattgtagcaataaaccctcagtaaatacaagactcaagtttgccaaagggtttcttctttcttcttcttttttaaatttttttcagttcattggaatcttcctcaagagataagagtttgtctttggcttatacaaaacaaaacaaacaaa

SEQ ID NO: 238070 - DNA, 481 bp, Homo sapiens
cctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaacc

SEQ ID NO: 238071 - DNA, 380 bp, Homo sapiens
agaaatggagtcacaggataatgtataagaggcaagaatgccagatgcaggatattactcatcatttgacaatcaataaagaataaattgtcatctatgtcaaaagaatgcttttattgatcaaccaatccttgtctgcaagttgagttacggataatgtcagtcactgctgttctattgccagacttcatgcctacctggctctatgaaacgtcggagaaagcaactcattcctctttacacaaatgatagaccgaatataggaaatgcaaagcctaacaagaatgggtggcagcactgggaatagcatattgtgtaatcttgtctagtagcctgtaggggaaatgaaaatgcatcatgacttgcagccacttacaaga

SEQ ID NO: 238072 - DNA, 394 bp, Homo sapiens
gttggtggctcagagaagctggtgcctggaaggagcgtggccagtgaggaggcacagcaggacttaagttgcttattatatgtattcccaaccgcttgttgaaactaaagtgaatcctcccttaaataacatatcaactagaacctcaggtcatctctatagtttttaaaacacaattttccatttcaaaaaactatgctgataaaaatataagaagtgactgataatcaagagaaaaaatcagacaatagaaacagacccacaagagatccaggtatggaagttatcagacacaaactataaaacagttgtgattaatatgttcgagaaattaaatgacaagatagtttcagcacagatgtggaactcataaaaaattgaagtgaatttatag

SEQ ID NO: 238073 - DNA, 603 bp, Homo sapiens
tgagagtagagaccacaacaagactttattataacccttgccctgcctgttctaagttctgtatcttaaatggcccatggtgagcaagatcagttaggtgacaagcaactggtctgtacatctcaatcttacttctattctttctcagtactgatttcagcagaagccagtggccctcctggaaatgctttttccttatgctttgggctaatttagaaaaggcagaagttatcaaaaagcatactgcagaaagcctgttttgttacctgcattttgttttacatagatatattgtattcttagtgggctttcaattctatccttgcagaaatagactattgtcacccaactactgtttccagccgagactccctgaagtgcctctggtttttgtcgttttcatcagcctccttttctgcttcctttattatttaccttgacttaaagcttcagacaagctaggacagattcaggcaaaatgctatgacaaacaggcaaaccagaatcaaggtacaggaggtttgtaggtagtcctgattgatgaattcattctcatcacatctttctttcacacccacttgatgtggataccaaagacttatt

SEQ ID NO: 238074 - DNA, 332 bp, Homo sapiens
gtagcctcctaccaaatgccacggagtgagtcactttggaagtagatcctccaaccttggtcaagcctttggctgactacaacttcatgagagacccagaggtaggaccacctagcttagccactcctggaatcctgactcagaaacagtgtaagatgaaaagtacttggtgtaagccactaagctttggggttatttgttacacagctataaataactaatatatagggtaaaaggaaaaacagtaaatgaatgtatgagttctttgtactgtttttgcaacttttctgtaagtttgaaattatttccaaataaaatgttaaaaagtaaat

SEQ ID NO: 238075 - DNA, 497 bp, Homo sapiens
cggctgcaggctggagagggctcgcagccgggctcggagctggggccgtctgacgggctggtgcccacagggtcgttgccgccacccaccggcaagtcgcagacccggcctgagcctccctggacccttcctggcctcttcctcctgtcctaggtaccgcggcgccaggagaaggcgaccgcgtccacaccccgccatgacagagaggggacctcaccctcccccggaacaccccaagacccctggaaatgcagtattaacgtagaaaagatgttttacttccatgttttggctaggaaggtaataaggtcgagacaaaataaaaagactcaaaactgacctttaatctggggataataatgaagtctgcgatatctcttccaaaaactgtgtttggtgtgagtgtaaacaaaggtgactattttacttctagggatctacaaatgggatgcatttcaaacacttcttgtaataaagcataacaattgccttgaaaa

SEQ ID NO: 238076 - DNA, 468 bp, Homo sapiens
gaatggtatttagagagtaaaccccgatagagagggtgtgtgtctggcacagagaagagcctgtgcaaaagctggtggggcgagaggacaccgtgtgttcatccacctgaggggcgaccagcaggctggagctcagcgggttgagaggaggatgcagagcccgggaaaggcaccctaggcagagggcacagaagtgcaaaggcctggagtcaggcctgagcctgtgtggtttgaggaacggacagaggcctgtccgtcaggaagggaatggcacaggggagagaccttaggccacagcagagggcagggcagagggcagggccgtgctgggcactgtgggctgtggatggtgctggcatttaagaggggagaccatagaccagggcagagggcagggccgtgctgggcactttgggctgtggatgggagctggcatttatgctcaggtgatgggaatgtgttaaaaga

SEQ ID NO: 238077 - DNA, 328 bp, Homo sapiens
gacatcatttgtgtctgggctattgacccaaaacctcaaagtgggtactgaagagcgacaattctcacccagttcctgacacctccggggcaggcaacactgcaatgtgggaacctaaggcaacaaacaggcatctctttagaggagcatgtcctttatcatgccaaagggggctggattttaggaggtcatcatgcagctcttcactgacattttacccatctagagaatattcttcactgacattttacccatctagagaatatttccttcctagattttgcttccctgtcatcttccttttaataaataactccatcctttgaat

SEQ ID NO: 238078 - DNA, 434 bp, Homo sapiens
tatactatctctggcaagctctctctccatgtgatacctcctaccatgtgatgacacatcaaaaagatcatcataaggtgtggccccccaatcttggacttcctagccttcagtaccattcagccaagtaaacttccattgcttataaattacccagtttgtggtattctcttatagcagcacaaaacagagtaaaactgattctcagtgaaaaatagatctatagatgcaaaacatcccttgacaatctatgggaagagtggttatttcttttttgattattgatgttcccagcaatctaggcacaatctctggtccaataaatatttgggactagtctactgcaagtcgatatctgttgaactatgctatgtctagcattcttgtaggctaaaatatcaccaatatcttttctttgtgtttccaatgacttg

SEQ ID NO: 238079 - DNA, 428 bp, Homo sapiens
tcttgaaaagatcataaaaactcactttaaggtgtatatgaggagttttgtctcccaggaaggtttgcattgtatctgtaatggtggagtctcaggcattgacttcccaggtgaaggaagggtgattttgggatgggggggccttcctgaaacctctgaagaaacagcacaccagcacctctgccagccagctgcatccaggatcaatgttccccctagttctggttcactcttttgaagctttccaagtcccagaagtgaattcttagcctttctttgagctctctttggtccaggcacagctgtaggaaaaattgtacagtggcatgaaaaaagtgaagggtttagtgtagtaaattctgcaaattttcttttaaaaaaaactgcattttaaaaaataaaaatactatgtcctattgtaaggtaaa

SEQ ID NO: 238080 - DNA, 2294 bp, Homo sapiens
ataaggtataaggaaggggtccagtttcaattatctgcatatggctagccagctctcccagcatcatttactaaatagaaaatcctttccccattgcttgtttttgtcagggttgttgaagatcagatggttttaggtgtgtggtcttatttctgagttctctattctgttccattggtctatgtgcatgtttttgtaccagtaccatgctgctttggttactgtagccttgtaatatagtttgaagtcaggtagggtgatgcctccagctttgttcttttttgctgaggattgccttggatattcaggctctttttggttccatatgaattttaaaatagtttttttcctaattctatgaagaatgtcaatagtagtttaatgggaatagcactgaatctataaattactttgggcagtatggccattttcacaatattgattcttcctatccatgagcatggaatgtttttccatttgtttgtgtcttctctgatttccttgagcagtggtttgtggttctcctcaaaaaggtcctttgcttcccttgttagttttattcctaggtattttattctctttgtagcaattatgaatgtgagtttattcatgatttggctctatgcttgcatgctgttggtgtataggaatgctagtgatttttgcacattgattttatatccccaggctttgctgaagttgcttatcagcttaagaagcttttgcactgagacaatggagttttctaggtacaggatcatgtcatctgcaaacaaagataatatgacttcctctctttctatttgaatatctttatttctttctcttgcctaattgccctggccagaacttccaatactatgttgaataggagtggtaaaagaggggatccttgtcttgtgctggttttcaaggggaatgcttccaggttttgcccattcagtatgatattggctgtgggtttgtcatatatggctcttattatttagaggtatgttccttcaatacccagtttatttagagtttttaacataaagggattttgaattttattgaaggccttttctgcatctattgagacaatcgtgtggtttttggctttagttctgtttacgtgatgaattacatttattgatttgcttatgttgaaccaaccttgcatcctggtgatgaagccaacttgatcatggtggataagctttttgatgtgctgctggattcggtttgccagtattttattgaggatttttgcattgatgttcatcagagatattggcccgaggttttatatttttgttgtatctctgccaggttttggtatcaggatgatgctggcctcataaaatgagttagggaggagttcctccttttcaattatttaaaatagtttcagtagaaatggtgttagctcttctttgtacctctggtagaattcaactgtaaatccatccagtcccaggcttttttttgtaggctatttattactgcctcaatttcagaactcatttttggtctattcagggattcagttttttcctggttcagtctttggagggtgtatgagtccaggaatttacacatttcttctagcttatgtgcacagaggtgtttatagtagtctctgatggttgtttgtatttctgtggggtcagtggtgatatcccccttatcatttctgattttgtctatttgatacttctttcctttcttccttattagtctagatagtagtctcttttattaattttttcaaaaagccaacccctggattcattgatttattgaaggttttttcgttctgtatctccttcagttccactctgatcttggttatttcttgtcttctgccagctttggggtttgtttgcttttggttctctagttcttttaattgtgatgttaggttgttgattcaagatgtttccagcttttatcagccaggggaactcttgtacactgttgatggaaacgcatactggtgcagccattatagaaaatagtatggagatttcggctgggtgcagtggctcacacctgtaatcccagcactttgggaggctggggcaggaggatcacctgaggtcaggagtttgagaccagcctggccaacatggtgaaaccccgtccctactaaaaatacaaaaattggctaggtgtggtggcacttgactgtaatcctagctactgaagaggctgaggcaggagaatcatttgaacctggaaggtagaggttgcagtgggccgaaatggcaccactgcactccagcctggatgacagagtgagactgtcaaat

SEQ ID NO: 238081 - DNA, 415 bp, Homo sapiens
atttcaggaaaaataacccagaataacaataattagaaggatcttgggaaccactgatctacaaagatttcagaaattacttattttaatttgaccaactgaccctgttcttagttaccagagggaaaatgtttcagagtcggatttatggaataaatttttgaactatacctaatgttggcttttttattgtaaaccacttgataggagatgtgcagtacacaactttcttattttgctatttattaaaaagtttttttaaatacagaaacgtctctagtttagtggcattaaaaccatcgtttttttttttttaattaaaaaaaattggctctctttaatcatgggaaaagctgtttttgtggccttcaataacattagttgcctgaatttttcttatgtttctcagtcatta

SEQ ID NO: 238082 - DNA, 168 bp, Homo sapiens
tagcccccattcaccactctggttttctctttctttatttttggtccctggagatttcccttacttttttgcaagttcagtgaagcatctgagaggatgtttggtatatattgtccaacatttctagatgttttgtagtggaaagattttcagattcaaaatgagggt

SEQ ID NO: 238083 - DNA, 403 bp, Homo sapiens
cagagtctagtgtctgtcatttaaaatgcaagaatgagacacctgtattttaaattaattgtgtagttattgagacataaaatgtttcatgggcatttttttgtgtaattactgaaagctccatgtgcgctttttagagtaattactgagaggccaacaattcgtttttgttacttgtattttaatatttaaatttttaaattttaaatcattttcattaggattctttctcaaagtttctgaaaaccctaatgtctgcttagaggcttccgtatttttgttgttgttgctatttaaaatgaaatgctatagattttggacaatgtattgtgaagaaaatggctcccaaatataagtaaagcacgggtaaacgtggaggaatacaacgaagcactaagacaaa

SEQ ID NO: 238084 - DNA, 172 bp, Homo sapiens
tcgttagagtattgtgtagtttgttccccaatcttcaaaaaataagaaggttattgagctggaaagaattcagaatcaagcagcaatgataattaactttattgtgtaggatctactttccttcctgttaaattgaatcaaggctagaaaaggaatggcttgagcacctgat

SEQ ID NO: 238085 - DNA, 1318 bp, Homo sapiens
  misc_feature (1315)..(1317): n is a, c, g, or t
tccggcagttttacttccgttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttatcctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataannna

SEQ ID NO: 238086 - DNA, 2169 bp, Homo sapiens
tccggcagttttacttccgttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttatcctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctac

SEQ ID NO: 238087 - DNA, 203 bp, Homo sapiens
aaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttc

SEQ ID NO: 238088 - DNA, 309 bp, Homo sapiens
gttgttcagcagaagtcttggagtgcattttcagtggttaaggtgaaaaaatgactactaaaaatttagaaaccaaaggtaagtggcttttttataattgtttttaaaacatgacatttatgacgatgtgaaggaacgtttgagccagataactagatctcatggacccccttgggaatcatttgttatttcagatccctttatgtttattttttagtgcagtgtttatatttcagtactttagatgtacaagtgaaatttaacatcattagttagaatttattaggtgactactcttaaacatttaat

SEQ ID NO: 238089 - DNA, 2768 bp, Homo sapiens
tccggcagttttacttccgttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttatcctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatttgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttcttta

SEQ ID NO: 238090 - DNA, 2857 bp, Homo sapiens
tccggcagttttacttccgttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttatcctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatttgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttctttattgcgactattccttttttcccccagaattagtgctttggtttaggtctttgtctagcttaactacttccaattgattcttcagccttt

SEQ ID NO: 238091 - DNA, 1853 bp, Homo sapiens
tccggcagttttacttccgttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttatcctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtttacttactataaaagtctcagaagaaagcataaggggaaagcttcgtgacattgtatttggcaatgatttcttgaatatgacaacagaagcacaggcaacaaaagaaaaaatagataaattgaatttcatcaaaatttcaaatttttgtgcattaaaagatgcagtgaaaaggcaaca

SEQ ID NO: 238092 - DNA, 323 bp, Homo sapiens
tgtgagtgtcttgagacatagactttatgccagcatagtgcctggcacataatagacacttaataaaggtttattgaatgaaagcaccgcacagtgagcatattcgtgcttatagctttttctgtcttttggactatgtccttaggataatttcccagaatagagatttctatgccaaagtgacgtgaacatgtttatgaatcttaatacatcatgccaagtagctttttgtctacttgaggtgccttccaagtttgtgactctcatattgcatggtacattattgctagaatgtcagtcttgtgttccctattttctctacc

SEQ ID NO: 238093 - DNA, 279 bp, Homo sapiens
ctctacaaaaaaaaaaaaaatgctagaggctgaggtgggaggcccggagttcgagatcaccatgagcaacatagtgagacactatctctatagaaaatttaaaaatttaaaatttaaaaattataggcacatgccgggtgtggtggcacatgcctgtattcccaactactcaggaggctgaggcagaagaatggcttgagcccaggaggtcaaggctgcagtgagctatgattgcaccactgcatttcagcctgggcaacagaatgagaccccatctct

SEQ ID NO: 238094 - DNA, 410 bp, Homo sapiens
taataataataataatagtaactaaatgtaatacaataatgaaatactgtcttcagcctttagtatcatgggagtataataatagatactatttattgaagatgtatgatgtgccagaaagtgacttgggcaattggggaacattattgcctttctacttagatttacaactctgtcaaggtagggggaaataagtgcctttaacagataagaaaattgaggctcaaaagttacccagcaaataagcaacagaaaaaggattcattccagatcattctgcctccatatattggctttttgcactgtagcagcttataaaactctgggagacaagaccatacacccacctgttaaatgacaattaaacacagcatgtcattaaacagcagtgcagacagcagagaccaaaa

SEQ ID NO: 238095 - DNA, 531 bp, Homo sapiens
atccttttgtaaacaagaacattcatctttcttttgactgacatgcctggtagggcatgtgcctctcagaagctccatgtcatctgatctcatttgggatttagtgtttttatttgaaaatgtagctgccctgaggaacagcagttaggagccaacccccagtttaagcttcaagtcatggaaactggcctggtttacccagacgtcagtgatgcctgggaaagctcttgcttttccagtgcccactgagcagagatttaatttactcaatcggtacgtgtctgttaagcacattgctgtatgccaaacactttgggcataaaaggtatataggccttgccttcaaggattgtccaggctaactggggcaatgcaacatgcatggaccaaaagacagctaagtacctgtcccatgtggaattgggggagcagatgtgggccctggagacaggacagggagagctttggggagatctagccaggaaggagaacttcactgcacctctgggatttgatcagggaggatgaaga

SEQ ID NO: 238096 - DNA, 381 bp, Homo sapiens
ctaataggtgtggggtttcttttgcagcgtggtgaaaatgttctggaattagatagtggtgatggtttcacaacctcgtgaatatattaaaaaccactgagctgtatactttgaaaataatttttaaataaacagataaaataaatattaggaaagtcaatttaaaaacagaaataagctgggtgcagtgattcacacctataatcccagcaacttgggaggctgaggcgggaggatcacttgagctcaggagttcaaggctacaatgagctacgatcacgccactgcactccagtctagttgacagagcaagatcctgtctcttaaaacaaaaacaaaaaccagatgaaattactgcaaatttgattttgccacagtacc

SEQ ID NO: 238097 - DNA, 460 bp, Homo sapiens
gcttcctaggagcatatgcaaaatgtgcggccagctgcccctgcagcctcacccaaggccacttctcttttacatgctgcacctgtgggtatttgcatgtttggccagctcgcaagccagttctgaggctgagaacatcctagtctctcaaacgggattccttgttcccttgggaaccagctcctccctcccctcccaccctagaggcaaagccttgctttctgcatttctgccctgtgggtgggtgccatggaggggagcagcctcgcagaggaggcctaaagttttgagcggagtaaaggacagcgacaccttacttgcgcctttgagaagggaaacaaccagctcaggagccgcagtccggtctggtctgccagctcctgtttccccctcctcttggctgctggccttttgttcttgtcatggctcattagctccctaaacagaggttgattaaaga

SEQ ID NO: 238098 - DNA, 350 bp, Homo sapiens
gcgatctttgtggagggatcgggaccaggggaaggggcgacttggaactgagctggaagggggtgcctgaaaatgggtttatggcgtggagccagagggaaaaagatgctgcctggaccccctctgagagtctctcccttccttcctgtttggaaatgattgttacccgagactttgatgacggtcccattcagtttttaaacttcaggagggatcacagaatcttgatcgtcttgcttccctcgcgcccacttagtcctgcgtgggtagggtttccacttcttgggagcctagcccttcagctcatttttctttgagattttccctgaacgggccatcatcgaggcttt

SEQ ID NO: 238099 - DNA, 490 bp, Homo sapiens
gcatctcatattttcctcaaatagaagtttagggatacttccatgtatcagtgtttacatgtccctcatggtcaaacattttcatttttcattgaaaaactaaattttgattttagtcataattttggagatggaatgtctcccactttgtcatattttccatgggaccatgctgtattgatcaatctagcaaagccaatatgctactatgagcattaaaacaacaaaaaagaacctccaatgcctgcattgtaaagaaagctatacttgttatcttctaaacatgctgtaataaaaccagtgtaaacacactttttcatctagaatttgaaactagttttcctaaacaatacccatacccttgccctttaatcatgaaatggtgactagattgttttacaagctgttacttattaagaaatgtcgtagccctctaggcaatgtgttactcacagaactttgataatacattcttggcttgactccatca

SEQ ID NO: 238100 - DNA, 701 bp, Homo sapiens
gatggagcactcccaagtgaagagataggagagaaaggaagtagctggtgagatagggtagaaaacaagaaagcgttagtgtgctggaagccaagggggagatgtggatccagcatggagtgataaaatttgtaacaaatttctgatactccaagtaaattaggacttgcaattaacaattcgattttgtggagatgaatgatgaccttttcatgtacagtttagtagactagtggggtgtgccgggagggacggaaagtcctgactagggtgggttgagaagagcaagaagtgcctgacatctgggaactaatctaacacaagtaagcctcaatgctattacagattgatatgacgctttcggcaaactatgcttttcttctgtttttcacataacatacacttcagacaagttggttactgtccaactcaaaacaccaaacctccctcttgctaaacgagtgacttactttatcagtttcacctttatccctcctttagtctgccatccttatagataagatttcagatcctagaattgccctggttttctgagagcacccaattcagaacccctacttacttagaccctcccccaaattacccaacaaaagccaagatcctataatcaccatcttactgaatcaccccacacttctcccttgttgccatgagtaataaactaaacgtatttgacaaca

SEQ ID NO: 238101 - DNA, 301 bp, Homo sapiens
gtttgtgggatgaaaaggctagtcttggcttaaacaaaaacagctttgccacacgctacacattacatattccaaagctaacatttgaacttcaagttatccatggcactgctctcctccatttggacaatcacaattcaataatctgtagctattttactagtcttcaatgtatgccctcaaaaatttgaagaaggaaatacagaggttaactatagattattaatatttaataatagcaataactaagactgaaacctcaatatgtgcaggcaatgccatgcaattttcataacatctc

SEQ ID NO: 238102 - DNA, 170 bp, Homo sapiens
agggcctccttaaattgtattaggtttcaggccttttaaaagttgcataactggccgggcgcggtggttcacacctgtaatctcagcactttgggaggccaaggcaggcaaatcacgaggtcaggagatcgagaccatcctggataacatggtgaaaccccgtctctatt

SEQ ID NO: 238103 - DNA, 454 bp, Homo sapiens
agtggttgttgtttctgttcttctctctaataagtgtatacaggtggctaaatgcttttgttgagctatgagtacctcattctgtggagtgactcagaaagtctctaggtgttagactggaaacaggtgatgttcagtgcacgcaatgcttgaagtgttcccaggtatttagtttcaggtaaattttactgtttaaaaaaattgtttttacttgctattaagtgtgttgaccttggataatttacttaacctctctatgccttgcttccttttctgcaaaatgagagtaagaaaagtgcttacctcattggctttttgtgaaattcaatgagttaacacgtgggagaaaagatgtttttaaataatcaattcttagcagttggtcattgttatgagttacatcatgcgtagttaaatattttttaaaaaattaaaatttattttcctataggaa

SEQ ID NO: 238104 - DNA, 577 bp, Homo sapiens
ggcttgtctatggatcttttcagatcttgccaaacattagtaactcctcactctaatattcttacaatccctgctgtatttttaataatttattaactcttcaaagtcctttcacatacttttatcttgtgctgctcccagtgagcctctgaaatagatagggcatctgtcattttacagatgaaaaattggggcctggaaagtcttaacaactggctgagtcactaataaggggcagagctgggatgcatatttagtgtgcctgtatccaggcagaatagtattattatgatggaaggatatcatgcttcagggtcagatagcacaagtgtcaaattctaattcaactacttagctggttacataccctcatcaattaattaacctccacgagcctcagctaactcatatctgctctaatggagttcatggcacatagtatacatttcaggaatatttcttccctacccactatttatcatttacccactctcttacgttcataaatcagctatgtgactgattctagcagatactgtggaataattttttttaacccagaatacagactgtggga

SEQ ID NO: 238105 - DNA, 2042 bp, Homo sapiens
  misc_feature (675)..(675): n is a, c, g, or t
  misc_feature (1678)..(1678): n is a, c, g, or t
caaactggaatatatgagtacacataagtgaaaagagataatgcaagtttaaagtacagtttgatttaaagtttcctagattattagggtttcattttcctgtgtttcccttgaccctgtcttcctggctaacttagattaatgccttcatgatatcaaaatgatttccacagttccagcacaagtttcttcactgatatcttgatgaaaagaaaaaatgtctctttcttttacaagcagacaaaagctccacacttcctctcactggatcagtgaaagactggtgcccattcctaaaccaatcactgatgcaaaagagatatgagtgtcatgattggctcagactttatggctggaaagttcaagtccttgcaggatggtgaaaagaataacagatactttggaggccactgacaactctcctgttagactaggctcctaatggtcatgcgtttcctgccatattcatctacgggttcccaacatgtagcacagtgtttgatacccacatagtagataatcaacacacatctgcttagctgatgagaattgagcctgcctggaactgaaaatcacattctatatccacgcttccctctccactttagctctgaagtgctaccaccatgctgcctacctcctgcagctgcttctcaaccttcttgtaaatgaatncttctgcctaaaatgggtttccatttgtcttagactaggttacattttctcaatcaaaattcaacttaacccctccccttccaatcccagaaagatctgcctgtttagaggtactctgagacttcccttacaactggaaaattctgtgataaatgcaagaagctgtcaccagaaatgatggaaacatcaaaagagaatgttttgccagttagtccctttttattaaatattccctgaaggcagctactatgtatcttttgattattcctataaaagaaagagtataaccaagtagaaagagactagactttggaaacaggtctgggtcaaattctggtaccactacttcttcactctatgaaatgttgcccaaatgatttaatctctctgagctcagattcctcctgtataaacgggaataataatctccacctcccagggttataagagttacataaaatgaaccgtgtaacgtggctgggacagtttatggccaaattgttacactcccttcctccccttgcggcatccagactatattaccggtaggcctaatgtttttggttccataattcccatcttcaggtgatctaggctgttgaataagttcactgttgctggagaagctcttctgaaaactgctctgacctcagtgtctaatcacagaaactcgaggcttcttagtaaactttgatatcttgtctccaaaaaacataattatctgcctaccttggcatgccctggttttgtttgcctggtgaagcagaaaataaatggcttgccagcggtggtcatgatgaagacctagatattaaataagatgggtgtgaaagtcaggattgctgtggattcaaagaagccttaagtattctcagagttcccttaactctgggcttccacacatgctgcctctgtgatataaaactcaccctcctctcctatttccaaaaataaaccctattgagaatgtgtgccaggaagagaagttgtctgtagaccttcngatttatccttggacatccctgtttataaaaccctacacagggctagtgtctggtattccttcagatatttatgccttcttttggtttctctctataaattctccttctcctttcctagttttcgctctactttccttctgggcacaaaacaaaattcctcttactatctcactcagggcattttatcatcaacttttatggttttgagcactagtcctcattctaccctgtagagctcatcacaaaattttatccaacaaagatggttccctctttcagaggaattttaattttagctacgataatcattattaacaacatatgtatttcatctatcaatgtgattagattttattccttgtg

SEQ ID NO: 238106 - DNA, 457 bp, Homo sapiens
ttggtatgttgatgcttattagttgactagattttgctgtagtatctgtagcttttgagtattatttggaaacgtttgtagatccttaaggacattgggaaccatcctttaaaacttactcaagtagagaggaagagtgattcttggggaggggagaaaatcatctttgcaaataaacagattttcagaagtaattgccaacctgaattcttaccggtgcattttaccactaagggaaaaatgtagatcttcagttcaaaatgcattcaaaactcttctgtcaccaatgtgtgtgtgtgtgtgtctgtgtgtgtgtgagagagagagtgatgtgagaaagtaaaacttgtgggctggaaagtagcgaatttagtgttgttcctgtttatagtgtattttgttctgtgcaaagaaaataaaagagtttctgatttcaaggaacttatgataactgtag

SEQ ID NO: 238107 - DNA, 1028 bp, Homo sapiens
gtcttgcaaattttgaagtgaaaaaaagagtaacagttgggatccagaggtaaggatttaagtatttatgaataaaaacagtggtaggcgggttaggcttagaacctcagaggtcagtttcatgtgatagcccagtagggaaggggattaaggtggtgatctctcttctccagttttttttttttttttttgagacagagtcttgctctgtcacccaggctggaatgcagagcgagactccatctgaaaaaaaaaaaaaaaaaaaagccaaaaagtttataaaagcaagaaagatagaaaatgaaatgtaaataacaaaaaccataaaaggaaaatcataccaaacctttacacaaaacatcattgcgttgtgtattttgtgtcacaaaatgcttgacaaattatagtaattaaggcagcacgcattcatggaagggcagagcatctggcttaaccagaagcagaaccacacacaacacaggtcattggatccatgccagtggtgacgctgcagtgcagtggggagaggatgaccttttcaatcaatggcactaggtcaactgggcatccatttggacaaaaatgttatctggatgcccgcctcacccacacaaatcaattccatattcagcaatcccacttgtgaatctatatcttaagaacttgaaatcagtatgtcaaagagacatgtgcactcccatgttcactgcagcactattcacaatagccaagttatggaataaagccatgtccatcaacagatgaatggacaaaggaaatgtgacacatatatatataaacaatgtaataataatcagtctgaaaaaagaaattctgtcatttgcaacaacaccgatgaacttggaggaccttatgctaagtgaaatacgccaggctcagacagacaaatactgcatgatctcacttcttttttgagacagagtctcactctgtcacccaggctggagtgcggtggtgccatctcggctcattgcaacctctacctcccaggctcaagcgattctccc

SEQ ID NO: 238108 - DNA, 974 bp, Homo sapiens
gtcttgcaaattttgaagtgaaaaaaagagtaacagttgggatccagaggtaaggatttaagtatttatgaataaaaacagtggtaggcgggttaggcttagaacctcagaggtcagtttcatgtgatagcccagtagggaaggggattaaggtggtgatctctcttctccagttttttttttttttttttgagacagagtcttgctctgtcacccaggctggaatgcagagcgagactccatctgaaaaaaaaaaaaaaaaaaaagccaaaaagtttataaaagcaagaaagatagaaaatgaaatgtaaataacaaaaaccataaaaggaaaatcataccaaacctttacacaaaacatcattgcgttgtgtattttgtgtcacaaaatgcttgacaaattatagtaattaaggcagcacgcattcatggaagggcagagcatctggcttaaccagaagcagaaccacacacaacacaggtcacaatcaatggcactaggtcaactgggcatccatttggacaaaaatgttatctggatgcccgcctcacccacacaaatcaattccatattcagcaatcccacttgtgaatctatatcttaagaacttgaaatcagtatgtcaaagagacatgtgcactcccatgttcactgcagcactattcacaatagccaagttatggaataaagccatgtccatcaacagatgaatggacaaaggaaatgtgacacatatatatataaacaatgtaataataatcagtctgaaaaaagaaattctgtcatttgcaacaacaccgatgaacttggaggaccttatgctaagtgaaatacgccaggctcagacagacaaatactgcatgatctcacttcttttttgagacagagtctcactctgtcacccaggctggagtgcggtggtgccatctcggctcattgcaacctctacctcccaggctcaagcgattctccc

SEQ ID NO: 238109 - DNA, 974 bp, Homo sapiens
gtcttgcaaattttgaagtgaaaaaaagagtaacagttgggatccagaggtaaggatttaagtatttatgaataaaaacagtggtaggcgggttaggcttagaacctcagaggtcagtttcatgtgatagcccagtagggaaggggattaaggtggtgatctctcttctccagttttttttttttttttttgagacagagtcttgctctgtcacccaggctggaatgcagagcgagactccatctgaaaaaaaaaaaaaaaaaaaagccaaaaagtttataaaagcaagaaagataacacaaaacatcattgcgttgtgtattttgtgtcacaaaatgcttgacaaattatagtaattaaggcagcacgcattcatggaagggcagagcatctggcttaaccagaagcagaaccacacacaacacaggtcattggatccatgccagtggtgacgctgcagtgcagtggggagaggatgaccttttcaatcaatggcactaggtcaactgggcatccatttggacaaaaatgttatctggatgcccgcctcacccacacaaatcaattccatattcagcaatcccacttgtgaatctatatcttaagaacttgaaatcagtatgtcaaagagacatgtgcactcccatgttcactgcagcactattcacaatagccaagttatggaataaagccatgtccatcaacagatgaatggacaaaggaaatgtgacacatatatatataaacaatgtaataataatcagtctgaaaaaagaaattctgtcatttgcaacaacaccgatgaacttggaggaccttatgctaagtgaaatacgccaggctcagacagacaaatactgcatgatctcacttcttttttgagacagagtctcactctgtcacccaggctggagtgcggtggtgccatctcggctcattgcaacctctacctcccaggctcaagcgattctccc

SEQ ID NO: 238110 - DNA, 781 bp, Homo sapiens
gggaaaacgtatcagcacatgaaataccttgtaactatttcatttatataatttgctacgtgttctttgcaacatagtgaaaaataatcatgtctgatgtttagtaggcacataataaatagtaatggaatgaatggttgtatatttagagagccatgctgaaaggttaaatagcaaaatatgactacttggagaataatgttaaattgtcaaggagagcagtgttatatgaatactcggatggatatatagaaaatgagaaaagcgacagaaggaacttaaagagattttaaaaatagctttgtctaaagattaaaaattaaagttctaagtaacttcctaggaagatatacaagaccacaatgagatgccatgacacctctaccagaatggatccaattaaaaaaaaaaaatcaagagttggcaaggatgtagagcaactggaacttccatacattattgtaagagtgtaaattagtacaaccacagggaaaaccgtttaataatacctgctaaaatgtaaatcttactctgtcctttaggatttccatttttaggctacatatacccaagaaaaatatgctatatgagctccaaaacaatctgataattttatagcagatttataatagagaaaaaatagatacagcatagattcaaaagtagaatggataaattgtggcattattcatacactggcatatactataaagtaataataaagaactgttacacacaactgcatggatggattgcaaagatatgatgagcaaaagaaacc

SEQ ID NO: 238111 - DNA, 286 bp, Homo sapiens
cctttatttcctgaaagtgaacgaaaatggcattgcttactcctgagaattagaaagtaacaaaaattaatttaaaaattctaatgatgatgtgtagtttctttggttaattgtaattagtggccacttctcttttcttagaaaaaattactcttaaaaatattaatggagccgggcgtggtggctcatgcctgtaatcccagcactttgggaggccgaggtgggctgatcacctgaggtcaggcattcgagaccaggctgaccaacatggtgaaaccctgtctct

SEQ ID NO: 238112 - DNA, 553 bp, Homo sapiens
caacccatgcttactccattaatgtcctcaagtgtcaacaagccttctccagctggattggctaacttttctatttgctggaacatgccaagttgattccattcttagggtcactgtacttgctcaagttgtctttgcctagaataataatctcccagatctatacaggtatgttctcatcctttgggtctcagcttttatttttcttttttagtgacaggatctcactcttgcactctagcccaggtgacagaataacaacaacaacaacaaaaatatatatatacacagagagagagagaataggcatatacatagagaaagaaaatagagtttactgggtactgggggaagtggtgttactggttacagagtttccatttcaagttttggaaataaatagtagtaatggttacacaccattgtgcacgtacttcatgccactgcattgtacactacattaatattagatgaaggagatttcagggacaaaaactttacaaaatgcaaactaatcagtcctcaagttcatttcctgacacctccaccaaaa

SEQ ID NO: 238113 - DNA, 458 bp, Homo sapiens
agcttgggtgacagagtgagaccctgtctcaaaaagaagctgtatatttcaggcatgttaagtatattcacattgttatgcaaaagacttctaaaagttttacatcttgtgaaactaaaacccagtacccattaagtaacaacaacgcatttaccctcttcccagcccttggcaaacacccttccaatttctgtttttataagtgtgactacttaagatatataagcggaatcatacagtattcatcattttgtttctggcatataggtgacataatatttgcaaagtttatcttaaaatgtgacaatattttcttctttaagactgaataatatttcattgtgtatatatatatatatatatgcaacacttttgatgtgtttataaatcaagagacatctgagttgtttcagccctttggcttttgtgaatacgggtacaataaacatggatgttct

SEQ ID NO: 238114 - DNA, 496 bp, Homo sapiens
agcccaggcattctcttccagcccctctcgccatgtacccaagttgccctttttgcctgagctctcgaccttattctgagtactctactctttcaatgctgaacttccctgggttgcttttgcttctttcttcagcctcattaacatctcccgggaggtacaatctgagatggagatgagattcaaagcagtgagagagagagagtgtgtggtgcatgtgtagatttcatcaacaatttggcccagggggaggtggagccacgtagaagattgtggctggtttctggactcagcttggccatcctctctattttctagtgccgtgaataataactgaagactggctgcttacaccctttacataatcccatcaagctctgatggaacagataagaaaagcacattccaaggaattcactctcagcctgtgtcaacatgtattataacgtccagctaaaagctaaaagaatctaataaaaacaaagagactttaccc

SEQ ID NO: 238115 - DNA, 374 bp, Homo sapiens
gagcgccgcgggtgccagtgggcccgcaggtgggaggttcggggcggggaagagcccgcgagaggcggccaaggctggaggtgagcgggaatgaggccaggccacgactcctccctcctctcaaagatagtttcccacggtggcggcgagatgcggcccttggccctaatccgggctttggccgcccttcgcgctttccaggacccttccctcggcctgggaggggcgacggtaacggcgcgagggctaccaaggcgggttccgtgacccctccaacatgccttgtctgccggcgggggctgccccagtgccaagccctgtggtcccagaacttagcaaagaaaaagacggccaattaaaattgaatttcatat

SEQ ID NO: 238116 - DNA, 347 bp, Homo sapiens
tgctaaggtagaacacagagaacatcttaagaaattccaaaatcaaaaaatcagataagccaccttttctgaacagactgcagaaaaagtaagcattaatatcaaaaggctggcaaaatggttctatttcaatattttaaaacaccccttaagataaaaaagaaaataaaaactaaataactgcagttagttatggattgaaaaatgaatgtccatgagagtaccacgtcatgaaagacatggacaaagcagtcatcagaggaaaatttgtagctctcaatcctggtgctagaaaacaagagaggcagaaaaaaataataaaataagtgcaaagatagcaaaagtaa

SEQ ID NO: 238117 - DNA, 461 bp, Homo sapiens
actattagctactgtcatgggtccctgcttatctcacccaagtgtcttgggggtccttgtgggccagttcttccctagcaaacagcgtggggctagcacactggcagagcccacccaattgcctagggaaggatgggggcagtctgggattggctttcttccacccaaatccaacaaaagagactgcatagaacagtatctgtgcagagggccagggtcaggcccatagcttgttgctaggaggacatgcattgcaatcgtctgagccagcacctgcctctgcctagcaaggcgtccgaattctcaaacacaccagagactcaaagatggagagaaccccctctggttcctttctcactgaggccctggatgcttctcccctgagtatttcccacccctggctgggtacgtggcacacctccagcatcatctcctagccccggggcctccagcccattcct

SEQ ID NO: 238118 - DNA, 409 bp, Homo sapiens
gaacaacaacaacaacaacaaaaaaccctgccagatgataggtaaaataaataatctagaatttataattaaggaagaaaaaattgacagctgcctctctcaaaaagggaaattaaatacttaagtatctcactccagaacatctgaattgcgtttcctctgattattaaatgaaactgcactaacaaaaccgaccttgctcctccctcaaacctgatccagttaacaaacttacatttaatctgtaacaatgcattaaaacaccacaaacgtgggcaaatacagtctcaaagactaaaatttgtgtttatggccgggtgtggtggctcacatctgtaatcccagcactttgggaggccaaggtgggtggatcacctgaggtcagaagttcgagaccagcctggccaac

SEQ ID NO: 238119 - DNA, 497 bp, Homo sapiens
ggcagcagcaactgagcaatgaagaggttttctaggatgtttttgtcttcgaattacaggtttctgcatgagagagagacttagagtttcctctagcagtatttttctaaagagaaacttgcctaaattttaaaagatatattcttgtaatacttaaataaggcctttttggttctaatgttggcttttctttaaagccatcattttgtttggaagaaaaactacttaatgtccattttagtccctcttccttcaaagacatttaaaaggaagtcatgtttgtactagtggacctcttgggcaaataatattaaaaagatattgtgtttgatttgtgaatgaaacccagggttgattttaatacggtcatcataaaataagttaaaggacattatttcattgtgcaatctaataaacctaaccacactattaagattcagttaaattcaattttactttactatgatggttaatttgtattggcaattgtaaataaa

SEQ ID NO: 238120 - DNA, 446 bp, Homo sapiens
caaataaaaaaacggaaccggttgcaagcagggttaaatagcgtggtcagagtaggactcactgagaatatgagatctgagtcaagtcttcaaggatgtgaggaagtaagtttctggcagaagagctgtgaagggctgtctggccagagaagattgcaatgcaaaagccctgaggtgggaacgtgtttggtgtgtttaaaggaaagcaatgaggccagtgtagccagaacagagtgtgcaaggagagaaggaacagaagatgtggagggcagatcagtttgtaattgtacgcccagtatgctgattctttgtgtaatctccagactgtattaaactgcaagagcagggcccctctctggctttgctcatcattgtattcccagagccttgcacaatgcttggtgcataggagatggaaatttgttaaataaatgaattatggataa

SEQ ID NO: 238121 - DNA, 538 bp, Homo sapiens
ataagccaaacacagaaagacaaatatcacatgttctcacttatctgtgaaatataaaacaattacattcttagcagtaaagagtagaatggtggttactagagctggggggtgggaggaatggggagatggtaatcaagatataaagcctcagttaagatgggaggaataagtttgattgttttttttgagatgtgtttcatagcatgatgaatatagctaaatagtaaatcccaaatgctctcatttgacaaaaatgtcaaatatttgagatgatggataggttacttagcttgacttaataattccccattgtgttcaaagatcataacttcatattgtaccacataaatatatacaactgtactatcccaatatataattttaaaactaatataatgaaaaagaaattgaagttcaacattcccagaagctaagtgtaacttaaaagttttgtgagaatttgttttaacaaacaaacaagttttctctttttaacaattaccacattctgcgcttggatatacagcagtgaaca

SEQ ID NO: 238122 - DNA, 503 bp, Homo sapiens
tgcaaaattttaagaagtagatttacaaccgccacaattttaggtgatttttttcagcttgttagtgtttcctttcttatgtctattaacttttcacatatcagaaactagaattctgtagcatgttgggtaagaccattctatggtgggaagagaaattaatcatgagcattaaccaaaacccactgtgtaaaactactataggttagtcttactccctgctcaaattttctaaaacctctgttgttgaagtcaactataaatgaaaacagacgagcagagagttaaaagcatggctacattcagctactgtggtaagtggtggatgttcattcatcgtgtttttctgagtgatgggcactattctaggaactagaaatacagcaatgaacaaaacaaagttcctacccttacacaactgccattccagggtcaggtgtgatatcctcacagggctcaacgctcctagtgtgactttttccctattgatgaccatgcattga

SEQ ID NO: 238123 - DNA, 647 bp, Homo sapiens
  misc_feature (215)..(215): n is a, c, g, or t
ctcccaagcgattataatttgggatcccccagggtttttccaattaagcctttgtaaaacgacgggcaatttaatttaatagggccccccttaaggggaattgtggacgcgggccccccccagaggttttgtttacggattcactcaggtatgtgtcagtggacctgcatttggtatgggtggtccagctcgtttcttctcatgttatgttgttntcattgttttttatttttctgctacagtatttattgagagaactgcatagcaaaacaaatagtagcatatgtgtaagttcacctttgcccactgaattctgaaataacaaaaaaggatctaatgggactgaacatcaaactccagccattggattgtagggcttttaagctacctaatgagggaaacaccaaactactctggtatgatcacagaggcatccaactgtagtaattatgtcatggccaaaattgatcttcagtcctcttccaccacgttggcatccttcagttaaaggaacaacagcctttcacctggtgtggtcagtggattcgcatacaaggtttgtagttcttatttatgatgtgacagaccagtgatctacttcgccatttcagcatcctggtataacttccttccttccttcctttctc

SEQ ID NO: 238124 - DNA, 441 bp, Homo sapiens
cagaggagtcggcttagaagccctgatgatgcattttgttttgatgagttgagtttgaggttgatcacagcaagtgatcaatcataaaattagacatcttggatagagattggagatggcaacagatagaaagtgggttgaaaaacaaagaatgggccgggcgcagtggctcatgcctgtggtcccagcactttgggaagccgaggcgggcggatcacttgaggtcggggtttaagactagcctggccaacatggcgaaactccgtctctaataaaaaatacaaaaagcagctggatgtggtggcacatgcctgcagtcccagctactctgtgggctgaggcagaagaatcgcttgaatccaggaggtggaggaggttgcagtgagctgagatcgcgccactgcactccaggcctgggtgacagagccagactcggtctca

SEQ ID NO: 238125 - DNA, 522 bp, Homo sapiens
ctaaaagcacagcacttaatcctttaccttgtctatgatgcaaagacctttgttcacgtgtttgtctgctgaccctctccccacaattgtcttgtgaccctgacacatccccctctcggagaaacacccacgaatgatgaataaatactaagggaactcagaggctggcgggatcctccatatgctgaatgctggttccccgggtccccttatttctttgtctctgtgtctttttctttcctaagtctctcgtcccaccttacgagaaacacccacaggtgtggaggggcaacccaccccttcaaatctatctacagatgagaagcctactaaaattttaagaattgtattaaaaacacacacaaaccttggctacaacaacttgtggctattccaaattaagagaaattacagtccctagtcatctaagaaatggtctcaaaaaagctgtgcaactcccaaagttggcatatatatccctcagtagctgttcagatgtagccatgaagattaaaaaaaaaa

SEQ ID NO: 238126 - DNA, 224 bp, Homo sapiens
gctcccataggcactggtttctcatcttcccactggctttccccacaatcctctaccccagaaaggcagcttgatcctagcctcccactcccagccagcccctgacccagctctctggttggacatccctctagctttccaaatcccagaggtactatcagaaaccactcagtcacagacccctctgcaacacaggagctcaccaaggggggaaatgcctatat

SEQ ID NO: 238127 - DNA, 361 bp, Homo sapiens
tagagacagagtttcacactgtttaccagattggagtgcagtggtgcaatcctagcttactgcagcctgtaggtcccgggctcaagcgatcttcccacctctgccacttgaataggtgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctacttccccaggctcttcccccgtttgttaatacataccatgaccttggcctttcccacctcttaggttttgcttactttcccttctgtcctttactt

SEQ ID NO: 238128 - DNA, 1491 bp, Homo sapiens
ggcaaagctcggagtcccggcggaggggcggacaggtggaggggttccactcgcactgaccgcagcgcacgggcagcggggctgaccaggcgcttcccggccccataaaactcgggcgggaggcgaacgccgttttatgcaggcggccgggcggcctggctcgctttcattcccggctccgcgaggcgcgagggccgagccctccaagctcgtaaacgccttggccgcgagctccctccccgggcccgcgggccgtcatataaggcgcagcgccggcttggggtccagccgcccgcccctgccgccaccgcaccatgtcctgcctctactcccgcctcagcgccccctgcggggtccgcgccttcagctgcatctcggcctgcgggccccggcccggccgctgctgcatcaccgccgccccctaccgcggcgtctcctgctaccgcggcctcaccggaggcttcggcagccacagcgtgtgcgggggcttccgcgccggctcctgcggacgcagcttcggctaccgctccgggggcgtgtgcggacccagccccccatgcatcgccaccgtgtcggtcaacgagagcctcctcacgcccctcaacctggagatcgaccccaacgcacagtgcgtgaagcaggaggagaaggagcagatcaagtccctcaacagcaggttcgcggccttcatggacaaggtgcacttcctggagcagcagaacaagctgctggagacaaagctgcagttcttccagaaccgtgagtgctgcaagagcaacctggagcctctgtttgagggctacaactctgcgacgggaggccgagtgcatggaagccaacagtgggaggctggcctcagagctcaaccacgtgcaggaggtgctggagggttacaagaagaagtatgaagaagaggtggcactaagggccactgctgagaatgaatttgtggccttgaagaaggatgtggactgtgcctacctgcgcaaatcagacctagaggccaacgtggaggccctgacccaggagatcgacttcctgaggcggctatatgaggaggagatccgcgttctccagtcgcacatctcagacacctcagtggtcgtcaagatggacaacagtcgggacctgaacatgcactgtgtcatcactgagatcaaagctcagtacgatgacattgccacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacagccgaggtggagaacgccaagtgccagaactccaagctggaggccgcggtggcccagtctgagcagcagggtgaggcggccctcagtgatgcccgctgcaagctggccgagctggagggtgccctgcagaaggccaagcaggacatggcctgcctgatcagggagtac

SEQ ID NO: 238129 - DNA, 575 bp, Homo sapiens
agcctgacagtaacccagcacagcccacaggcctctcagtctgtcgctcatcccatccaggcccacctggacagaccctcacttagccctgaataagcaattatgaaacaaggattctccagctgcatcctcaggccaggagagaccagcaggggccatgtggtctaccccttgcctctgcacatcttactgccggttctgtcttgactctggctgttccccaaggagggctggggatattggctcctccaaccaacatttctcccacttccacaccaggtgcacttcctggagcagcagaacaagctgctggagacaaagctgcagttcttccagaaccgtgagtgctgcaagagcaacctggagcctctgtttgagggctacaactctgcgacgggaggccgagtgcatggaagccaacagtgggaggctggcctcagagctcaaccacgtgcaggaggtgctggagggttacaagaagaagtaagtgcagtgggaggagggtttggagaaattaaatgggattaagtcaaagtatgatagatttgggttcgaccataagaggaacttcccaa

SEQ ID NO: 238130 - DNA, 994 bp, Homo sapiens
ggcaaagctcggagtcccggcggaggggcggacaggtggaggggttccactcgcactgaccgcagcgcacgggcagcggggctgaccaggcgcttcccggccccataaaactcgggcgggaggcgaacgccgttttatgcaggcggccgggcggcctggctcgctttcattcccggctccgcgaggcgcgagggccgagccctccaagctcgtaaacgccttggccgcgagctccctccccgggcccgcgggccgtcatataaggcgcagcgccggcttggggtccagccgcccgcccctgccgccaccgcaccatgtcctgcctctactcccgcctcagcgccccctgcggggtccgcgccttcagctgcatctcggcctgcgggccccggcccggccgctgctgcatcaccgccgccccctaccgcggcgtctcctgctaccgcggcctcaccggaggcttcggcagccacagcgtgtgcgggggcttccgcgccggctcctgcggacgcagcttcggctaccgctccgggggcgtgtgcggacccagccccccatgcatcgccaccgtgtcggtcaacgagagcctcctcacgcccctcaacctggagatcgaccccaacgcacagtgcgtgaagcaggaggagaaggagcagatcaagtccctcaacagcaggttcgcggccttcatggacaaggtgcacttcctggagcagcagaacaagctgctggagacaaagctgcagttcttccagaaccgtgagtgctgcaagagcaacctggagcctctgtttgagggctacaactctgcgacgggaggccgagtgcatggaagccaacagtgggaggctggcctcagagctcaaccacgtgcaggaggtgctggagggttacaagaagaagtaagtgcagtgggaggagggtttggagaaattaaatgggattaagtcaaagtatgatagatttgggttcgaccataagaggaacttcccaa

SEQ ID NO: 238131 - DNA, 1031 bp, Homo sapiens
acttcatcattatgtttatttcattaattcatcaaacattttattgagcatctactcaatgttgtaggtgctatgttgggctctgagtgggaaaggagtaaggaagtaagaaggaggagaaaggagaggtaccagaactgggcagggttcctgccccaaaggagttacagcccagaaacagagaggaggtcttcgaaaatgtgcagggcccccaccctgacccacatcaggaatgaaagtccctgaaatagaaagagctttgagtaacatgggttggtttgaatgcccagaagaaagggatggacaagttcccttcagtccaacacttttttgattcttgtgaccacctccaaaagatccagttcccggaatgtgtttgcctgtgccttcattcccattttttttcctccccagatctgagccttgtgtgttttgtccccaggtatgaagaagaggtggcactaagggccactgctgagaatgaatttgtggccttgaagaaggatgtggactgtgcctacctgcgcaaatcagacctagaggccaacgtggaggccctgacccaggagatcgacttcctgaggcggctatatgaggaggagatccgcgttctccagtcgcacatctcagacacctcagtggtcgtcaagatggacaacagtcgggacctgaacatgcactgtgtcatcactgagatcaaagctcagtacgatgacattgccacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacagccgaggtggagaacgccaagtgccagaactccaagctggaggccgcggtggcccagtctgagcagcagggtgaggcggccctcagtgatgcccgctgcaagctggccgagctggagggtgccctgcagaaggccaagcaggacatggcctgcctgatcagggagtac

SEQ ID NO: 238132 - DNA, 450 bp, Homo sapiens
tcatgcacgtcaccatagacctgaaaatttctttggaaaacagaccctgtaacatgattgctaggtcataaaatagtctaagcttaatttgtcaagtactgccagattgtagtgatgtgatcatagcacacagtaaccacctgcctcagccttgcaattaactgggattacaggtgcacaccactatacctggctaatttttatatattttttatagaggtgaggtctcactatcttgctcaggagttcgaggccagcctggccaacatggcgaaaccctatctctactaaaaatacaaaaattagctgggtgtgctggcaggtgcctgtaattccagctctttgggaggctgaggcaggagaagcacttgaacccgggaagcggaggttgcagtgagcagagatcacaccattgcactccatcctgggctacaagagtggaactccatc

SEQ ID NO: 238133 - DNA, 346 bp, Homo sapiens
ctaccctaaccaccatagaagatccggacttagtggtattggactggaatgataaaaactatccagggaaggccgagcgtggtggctcatgcctgtaataccagcactttaggaggctgaggtgggtgggtcaggagtttgagaccagcctagccaacgtggtgaaaccccgtctctactaaaaatacaaaaactagcggggtgtggtggtacatgcctgtaatcccagcagttacttgggaggctgaggcaagagaatcacttgaacccaggagtccgaggttgcaatgagccgagagcacgccactgcactccagcctggatgacaaagcaagactctgtatca

SEQ ID NO: 238134 - DNA, 512 bp, Homo sapiens
atattctctcctacccatttcctttattaatatcttgctgttgtgtggtagatttgttacagttgatgaaccaatattaacagaagtccatagtttacattcaagttcattctgtgtgtttgtgcagtctgtggattttgacaaatatataatcattcagaatggtttcactaatccagaagtctcctggtgctcctgtcttccctcctttctctaacccctgacaactatttttttttactgtctccatagttttgccttttccaaaaatgtcctatggttggaatcatacaaatgtagccttttcagattggcttctgtcactaagcaatatgtatttaatggcttgataacttttcatggcttgataactcatttctttttaatgctgaataatatttcactgtatggatgtaccacaagttgtttatcattcacatactgagtaacatcttggttgtgttcaagttttagcaattgtgaataaaactgctgtgaataaatatttgtgt

SEQ ID NO: 238135 - DNA, 234 bp, Homo sapiens
cacaaacaatgagaggtttttttccaatggtagaaatgacataaattcattgtaaggaactttggaatttatcaaaaagtgtaaaggcagaagaataaaaattgaccatattcctagatgtcgagtaagttttcctcagaataaatctttagaaatgacgttgacagaatgaagagggttcaaatattaagtttttggtaacatactgccaaatgcccttcagaaagtttgtac

SEQ ID NO: 238136 - DNA, 583 bp, Homo sapiens
aaagcctcacttcctcaacaggaactaacagcatcacaaaagaatgacaggcctccaggttccctggtgtagcctgaccggcaccagcctagtctggtgtccggaaacctgcctctccccgcctgtatgtgtgcctgattaaggcagcataacactgaagggtgagagtcctggctccgatgtgagactccttgggttcaacttccagcttgccgcctcccagctgtgtgaccttgagtacgtcatcctcccctcaagcctcagtttcctcatctgccaaatcgggataataacaatagctcattcataagggcgttgtgaggattaaacctgacaacttcataaattacttagaaaaggcctggagctagtgagtgctcagtgaacatccagtattaccatgatcgtgtatatgtcactagacctctaagttttctttcaacatgtgaattctgggattaagtctaatattgaaaagaaaaatcaggaacaggggagctagcatcaggcagaaccaaagctccggtctatcatttgcagactttgtagtaactgaggctccaggacagtgcatgacaaaaag

SEQ ID NO: 238137 - DNA, 396 bp, Homo sapiens
tgctttctacaggaggacagggatgtttgtcttgctcactgctgtgtcccccgggcctagaaacttgcttagcacagagtaggtgctcattaaacaagcgattgagttaatacttgggtacagataggtgtgaagcgtgggcatgggtgggggacacgctcggtttgtttagtatctcccgggtttccccgttctgatgcgccctccccgtgcccccgtcgtgcctccagacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgctgccgcgccccgggaccc

SEQ ID NO: 238138 - DNA, 1705 bp, Homo sapiens
  misc_feature (1088)..(1088): n is a, c, g, or t
  misc_feature (1172)..(1172): n is a, c, g, or t
atctaaaatgcttttgttttaaatggacaaaatttgccaaacacctttttacctttctgcctggaaaaatgttttgatgtgttggctttccacctcctgatttttgtgtgtggctccttcccctaccccctcccgccccgccaaatgttgttgtacactgccttgtctgtttcatttccacgtgtgggttcactgaccacattagctggtagctcctggtattgtatgcttcctatccagaatttgttccatagaaaacctgtgtcttcaacatacttgctttgaaattattttgatctgtatcagcaggaataggttttgagatcctggatattaacttctgggtgccactctctctagaagctaattgactgatttgtggtggaggcgagatgagagtctatacatttgacctatttcacagagcttaccttgcaagctattgaaatgcaaatacagactagcttagagattctaagaattcacacattcagttctttgtttttttctgaaaaataagcattcaaatttcatgcacattctattattcatgtgccttatatttaggttccgcttgtatgtctagataaatcttatcaccattatttaaaatttcatgaatgaaactttgcatctttaatactaacactagcctagaccaatcaaaataatttgaaatgcagcccttaaatgaactcctccgtgtgtctgtatatatacatttacatatacacctttgccaatgccttatctaccactgtcttttaaatctactccatgtaaaatggggaacgattcaaaacctcttttatattgttgtgcctcagaaaaaaatggaatctttggaatgtgctgcttaaaaggcttctatgagatagcacattaatgtcaaagcacattttctttgtttgatagttgtcacgttagtggtcctgaaacagaatactcttttccgtgctgtccattcatttgtatttttaagtcatccaccacttttcatttgtcaagcacttgaaaaagaatattgtgtgtcagcaagatagttcctctgtcatttgatctacaagttagccttcctgaacagttantgccttcagaatcctttttttctctgagctatggtcgcttaacagagaggagaatgattttcttagccagatccaagactcccncaactgagtctactgcctaatgcctattggtgctagcactaacattttctgatacagtcttcaatatgtgatgaggctgagtatccggcattaagtttggaagaaggaacatagacttaagtgaagttctttgttaagccttatgtccccatagagtgttgatgatggtttgaattgagtcactttctgtcactttctgggagccatatcaaaaaagactttaccagttctctttgctgcctttgaagttctgtaatttctaggtagggtcaattttctgggaaaaataacaaatattcatgggaattttgatacacagcctgggtgacagagcgagactccatctcaaaaaataaaacaacaacaacaacaaaaacacaaatattagctggaggtggtggtgggagcctgtaatcccagctacttgggaggctgaggcactagaatcacttgaactagggaggcggaagttgcagtgagctgagattgtgccactactctccagcctgggtgctggaacaagactccttctc

SEQ ID NO: 238139 - DNA, 109 bp, Homo sapiens
tgcaggtccacagtagctctgcatatttactggttacatgaaatattttgatccaggtatgcaatgcatattaatcatgtcagagtaaattatatatacagataaatgc

SEQ ID NO: 238140 - DNA, 490 bp, Homo sapiens
tcccttttgcagagaggactggggaagagtcagggagtcggggacatccaggaaataggtggtaggagtgtctgttcatgtgacacactagcagtgcctgctttccaggtacaagtcctcctgtatggattcatttgttaacttagttcttaaagtgtttgaatcttagtaatgattttaaaggaaatttaaaatagggagaaaatgggctgggtgtgatggctcacacccgtaatcccagcactttgggaggccgaggcaggcggatcacctgaggtcaggagttcaagaccagcctagccaacatggtgaaaccctgtctctactaaaaatacaaaaattagctggatgtggtggtgggcgcctgtaatcccagctactcaggaggctgaggcagggagaattgcttcaacccaggaggtggaggttgcagtgagccaagatcgcaccgttgcactccagcctgggcgacagaacaagactccatctc

SEQ ID NO: 238141 - DNA, 387 bp, Homo sapiens
atggtggaattttagatcattgattttaaatctttttttatataagcattaagtctataaattatcctctgagcactcagttacacccaacttaattttagaacatgtcttttttcattcaatttgaaatattcaatttgaatatccttcttagattcataagttattgatatgtggattatttattttacaaatacttggcaattttctaggtatcttattgtgaatttctcactgaattttactatggttaaacacttcagtcttttgaaattatggtctctcttgccaaatgtttcaaatgcacatggtagcattgggatattatgtaaatatcaattaggtcaagttggttgattgtattatttatatcttctgtattcttac

SEQ ID NO: 238142 - DNA, 459 bp, Homo sapiens
gattaatataatgcacctaagccatgcctagaagataatgttttgtaagcattgattattcatgtcttggtattattatttttatctgccaataaaaatactgaattatcatgtgtatgtcattctaacatgcagacatagcaagtaaaaaaaccatcaatttatcatcattaaacctgtgttttattctgactctatcacctatggggtatgtgaccttgggaatgtcacttcatgtctcctggggtgattaagacactaagtctgacttctccactgaaaaatggggttcactcatctgattgtcttgaaaatcaaatgcaattttcttagaaagtaaataccaatgttgaaatgttttatatacacgtgaaattagtaatgacaggagaaagtataacagtagaaataaaaataagagtaagaagagtaatttatgttaatcatagaaaaaaggaa

SEQ ID NO: 238143 - DNA, 509 bp, Homo sapiens
tgtccaattctgtctaatggagccctaaggaccaacaatagagcgggcgagcggctcattgagagtctggcagcgccgggcaactgggccccggctgcgcgcagcgtccggcgcgcaccgcgaggggacccggcacggcgagagtcaggtcgcgggttccaaccacgcggcccgcagacgagcctccgacccggatttctgaagggagggttggactgcgctgcgttctgaggggtccggaagttcggacatggtgactgaaggagggtgacgtggtcagataaggggccgggggcaaagggaagcggccaagagctccagcgtcgccagtggagccgggaggcgcgtgcagcgccagcggaggaggaggatcccggagcccaaggtcctgtcatggagctgcgctcggagctgcccagcgtgcccggcgcggcgacggcggcggcggcaacagcgacggggccgcctgtggcgtcggtggcgtcggtggcggcagccgcggcggccgc

SEQ ID NO: 238144 - DNA, 680 bp, Homo sapiens
gctttgtggatggcattcattttacttactttaaacctcctgcttattagcaactctgctttagcacatgagtttatctgagcaaaataggcaaaaagtgcaaatggtttgaatttaagatgactgatgatagcagcattatacacttgattatcagctctttgcttatctctgtccatggagggtaacagtggtacagacaattaaatcttttgtttgactttgaactgcctcgtcatattctgggatccttagatcttgcttatattactcctaaagaccaagttgctttcatttcacttacagtgggcaaagaaaagccaacctttaaaaaaaagtttcaggttgtgtgtggtggctcacgcttgtaatctcagcactttaagaggccaagatgggagaaccgctggagcccaggagtttgagaccagcctgagcaaggtagtgagatgctgtctctacaaaaaaatttaaaaattagccaggcatggtggcgtgcacttgtagtcccagctccttgggaggctgaggtgggaggattgcttgagcccaggagttcaaggctgtagtgagctatgatcacaccactgcattctagcctgggtgccagagtaagatcatgtatcaaaaaaaaaatttttttttttaaattccatggattattcacaagcaggctatgt

SEQ ID NO: 238145 - DNA, 161 bp, Homo sapiens
taaaaaatgtgaatttacaattctacagtttagccccaaaagcacttgttagaaggatgaaagcgccaaaaaactggtttcttgcccaaataagtttgggaatgggaatgggtttaaaaatgattacaaggcttttttttttttttttttgagacaggatc

SEQ ID NO: 238146 - DNA, 440 bp, Homo sapiens
attttcatcaaagtgccaggcttatttatagtggcaaggttgaaggtttactacaagaactttaggtcctttctgttaaagtgtttataggtatttctcttgccttttttcaaggtaattatcaacttcagcaaataaactgaatcagggagtgaataattggccctatatataaaaaagagttttttaaactaacaaaacagctcagtgcagatggacataaacagaatctctttatttcaacactttggctcaaatgcagcatcaaaacttaatcctatttgttacaagaggatatggcttttgtagcaaaagtacactggaatctttaaattaatcagaacccacattgtagtttgtccaagccaaagtcagtgcagttaggcttgaacatgcgaatgtgaatcttgatcaattttaaatgtaatattacatttttt

SEQ ID NO: 238147 - DNA, 428 bp, Homo sapiens
cagaaggtatttcagtagagagaatttagtacaaatttatgccggagagagagaatataaaccaacagtctaaggaattagttgaattgatgttggggggctgtaagcaacggagagccctggggcaacctagagctgatgagtgcagggagcagccctttcccctgagccagagaaatgacaggaagggccacctaccacaaccgaaaggcttacaggatttgaaaccagtctggccaacatggtgaaacccccatctctactagaaatacaaaaattagctgagtgtggtggcatgtgcctgtaatcctagccactcaggaagctgagggagcagaatcgcttgaacccaggaggcgggggttgcagtgagccgagatggtgccacggcactccagcttgggtgacacaagtgaaactccatctca

SEQ ID NO: 238148 - DNA, 431 bp, Homo sapiens
tgccctgcagatggacttgcaaaggtagaggatgtatgtgtcctagaattgttcaagcagcaaaaagcagaaaaactctgcccacagaagcttgtcaaataaatgatagcgtgtctcacagtggagtgctacacagcaggtaaaaaacagaatccggctaggtgttttgtatcaacatgaagctaagatacaatggcactctgtagcagcggttagagagaatcccgcaattgctctgttatcaaggaggaacaattgctaagttacagtgctaacaattgggaaaagcaagcagctacactcagggccacgctcacccacttggggtgggagggagacctggtcttcacctataccctttggtgctgttttaatattttgcttcatacataattcacttattcacaaaataaaattagcaaaatggagac

SEQ ID NO: 238149 - DNA, 1607 bp, Homo sapiens
attataatgaggattaaagtaaagaacagaccgggcatggcagctcactcctataatcccaggactttgggaggctgaggcagaaggatgacttgagccaggggttcaagaccagccttggcaacatagcaagaccccatctctatttaaaaagataaatataaatatataaagaacacattgcaaagcatgtggcagtagtgagctttcaggaactggtggtgctaatgaataaatagcaccttagtaatgctcattctatctcactcacaaactggacagttcatgcatttgctggggtttcattttgaagtaagaggatggtttgtttctgcttagttttccccagtgactgagaaccctagcaagaaaacgaaacacctgtgcagacacattatacccatggagctgcatttctgtatgtactttttgcaggccattatcagacattacactgccccagaggttaattgtaatctccagagtccattgcacttccacagtggctgggatctttggccactttcccagcctgtttatggggagcctgacctgaagcacatctcctaagtgttttccaagttggcactgagtctctccgacttggaaatgccagcacacagctttgtgtgtgcaatgatttagctcttatgaaggcgccagtgaaatgcccactcctacccgggtgttggacattttggagacctggaaagaagtaagcagtgttattgacaagcacaggccctgcaggggactgtgggaagttaggcatgattctgtcccttgtgccttaacaaggactggtgaggacactcagccattccctcagtgcatcaaaatggaggccagcacattgtatagccttagtttctctatcagggattagggtgataatgattaaccagaggacttagggtcaactaatccccaaagtggttctcagaatactatgaaaatgtagcacaggaaaaggttccatggccaaatatatttagaaaatgcaatgcactgtctttccttctttgcattttataatatgcaatttgcatattcaaggccctgagaagtcctgcagtaaggaaacaaacttaaccttgttcagtccagcagcacccaaatcaaatttccatgagcatctttttccctttaacatccccagcagctaggaaaaacactgaagaaattctagattatctaattatccccaaagtttatttttatttttttaacttttttttttagtttttttgtattatatcctgctccttctgtagattgcaaaagtttataacaagtgatatgtgaatattaagaaaggagaatctgagccaggcgcagtggctcacgcctgtaatcccagcactttggcagggcgaggcgggcagatcacaaggtcaggagtttgagaccagcctggccaacacagcgaaaccctgtctctactaaaaatacaaaaattagccaggtgtgatggcaggcacctgtaatcccagctacttgggaggctgaggcaggacaatcgcttgaacccgggaagtggaggttgcagtgagctgaggctgtgccattgtactccaggctgggcaacaagagcacgactccatctc

SEQ ID NO: 238150 - DNA, 343 bp, Homo sapiens
agtagtttactttcaagttaattattaacataaagtacttaaaactcatcttcacaattgccaaagtgattttaagtacataccttcttttattatgttgcatagcatttttaatcatataaaaatttgctcacaggttttagtcaaaacttctatgatactagtctatactatataatttggcatataattatatacattgttgggatttgtgaagtattaactatgttttccaaccagattgtaagcaccttcattgcaactttgatagatataggtgtatctcacagatattgcaggttccgtcccggccaacagcaataaagcaaatatcacaattaaa

SEQ ID NO: 238151 - DNA, 236 bp, Homo sapiens
gctgtttcttacaaaactaaacatactcttactatacaatctactaatcaagctctttgatatttatccaaagaagttgtaaatttatgtccccaccaaaaatgcacatgagtgcgtatagcagctttattcacaattgtctcaaactggaagcagtaggtgaatggataaacaatctgtggtatatctatatcatggaatattattcagcaataaaaggatgtgaactatatata

SEQ ID NO: 238152 - DNA, 846 bp, Homo sapiens
ggggcttgcaggggtgcctgggtcgggggctgcaggtgggagtgagcaaatgtgctgtctcgccacctcgggacaggtggtagggcctctgacacagagtggtccttcctgctgttcacagctcagctcaccgtgggctgaccatagattctcgttgaaatcctaacgccccaggcaatgatgttaggaggcggggcttctgggagatggcaagttcgtgaggctgcagctctgctgggggatcagtgtccttctacaagcggctccagggaggtcccttgccccttccaccatgtgaggacccgagatggtgccgtctatgaaccgggaagtgagtcctctccggacgtggaacaagttggtgccttgattttgaacttgcagcctccagcttcatggggtttaagtacgatgatgctgcattgagacgttgtactgtgtgaagtcagggccttctgtgcatcggtcgagggtgcaatgcacacggcacccccgagcagccacccatcctcccttccctccaccctgcgaggccccgttgtccgtctgtccacactctgctccatgagcacacgtgacttagcttcgccttgtgagccgctgcttggggtgagcatgcttcctgctggatgcttctctatgtaagcacctgcctgagtgtcagccctcttaaggtgaaccgctccgtgtcattcgtacattcacaagtttgtgccgccatcatcgtgatcggattccaaaacattttcatcacctccaagaaagccttgtacctggcagcagtcactgtctctatggatttgcttattctggacatttcataaaaatagaatcaaacagcatttg

SEQ ID NO: 238153 - DNA, 479 bp, Homo sapiens
ggccttggtgatacaggacagaggtgcccgtgcaggttgtgcctgtggctgggtccccagggagaaggtggcaaccccaggccagcagcctcctaccctgaactccaggcaacatcgtcggccccctggcactgcacctgcactgtgggcagagaaggagggaaggctgggagaggaggaggaggtcgaatgtcgctggaggtcggcgtccttctgcagccgtgggtgagccgctgcttggggtgagcatgcttcctgctggatgcttctctatgtaagcacctgcctgagtgtcagccctcttaaggtgaaccgctccgtgtcattcgtacattcacaagtttgtgccgccatcatcgtgatcggattccaaaacattttcatcacctccaagaaagccttgtacctggcagcagtcactgtctctatggatttgcttattctggacatttcataaaaatagaatcaaacagcatttg

SEQ ID NO: 238154 - DNA, 294 bp, Homo sapiens
ctccactttccgatttcaagcaattctcctgcctcagcctcccgagtagctgggactacaggcgcccctcaccacgcctggctaattttttgtacttttagtagagtcagggtttcaccatgttggccaggttggtcttgaactcctgacctcaagtgatccatctgccttggcctcccaaagtgttgggattacaggcatgagccactgcgcccagccagaaacttcattttctgtcagttaagcagtccgttttgttatcacacatatctgttctcccttctgcaaataaac

SEQ ID NO: 238155 - DNA, 668 bp, Homo sapiens
aacatgactcttgcacctaaccactatcaaaagaggtcctttctcaggtttccaagaatgcctatcccaaacaggcattgaactctgtccaacgttcttcctgctgccatcaatacagtcatctgatttctcttctcacccaaatgcaccgacgcattttctgatgtgaaaccgtccttgcattcgatccagtccattcggtcaggccagtgttcttggtaaaatactcttatttggatagctaatatttgatctaggatttttgcctacatggaatgagtctgcagttactttacttgttactgtcctctcttggttttagagccaagtttccgctgcctttgtgggatgaggtgagctgtttttcctccatttaaaatttctgggccaggtgcagtggctcacgcctgtaatcccagcactttgggaggccgaggcgggcggatcatgaggtcaagagatcgagaccatcctggctaacacagtgaaaccccgtctctactaaaaataaaaaaaagttagctgggcgtggtggcgggcacctgtagtcccagctactcaagaggctgaggcaggagaatggcatgaacccgggaggcggagcctgcagtgagctaagatcgagccactgcactccagcctgggcgacagagcgagactctgtctca

SEQ ID NO: 238156 - DNA, 435 bp, Homo sapiens
gcctgtaatcccagcactttgggaggccgaggtgggcggatcatgaggtcaagaggtcgagaccatcatggccaaaatggtgaaaccccggctctactaaaaatacaaaaattagctgggcatgctggtgcgtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattgtatgattcagtgaatctatgatttgtagatggtaaaataacagccagcactcagtgtggcacgtgctacgtgccaggaactgtcctgtgtgcttttcacatggatgaattttaatcctcaccgtacccttcccagccagctacta

SEQ ID NO: 238157 - DNA, 687 bp, Homo sapiens
aaagccaggaaatgcataattaaagtggtgaaaaaaagtgagataaaaaaacctgtaaaccaagatttctgataatgcaaaactatttctcaaaaattaaagagaaatccggccatttccgaattaaattgaaggagatcattattagtagccatgccctaccagaaatgctaaagggagtccttcatgttgaaatgaatgactacggttaattaggcccttatttgatgtgaagttatgagtggcttggcgtttaagccaagccacttaataaaacccagttccgacaaagtaagcctgtttttcaacacttaattttccctttctgttttttttattttttattttttggtctcactgtgttcccccgactgacctcaaactccgaggcttaagcagtcctcctgcctcaccctaccaagtagctgtaatcccagctacttgggaggctgaggcaggagaataatttgaacccaggaggcagaggttgcagtgaactgagaccgcaccattgcactccagcctgggcaacaagagcgaaactccttctcaaaaaataaaaaatctcagtcgagcatggtggcttgcatctataatcccagtgctttgggaggccaaggcaggaggatcacttgaggccaggagtttgagacctgcctgggtaacaaagtgggatcctgtctctac

SEQ ID NO: 238158 - DNA, 394 bp, Homo sapiens
gctactaacatattgattatagaggactttttttcattccttttatattgcagtatgattgtcttgtattaaatgtgtctgcttctttccttcctcctctctctctctctggatacttgtccttggaccccagccaccatcctgtgaggaagcccagagcacatgaagagaccacctgcacatgttcagatccactgccccagctaagatctccgctgacagccagaccaatcaccaatcttaggagctggcgagccttcagatggtccaacctttgaggccccccagaggagccaggtggagcatagatgagccatccatgtggatccctccaccaaatggaagatttaggagcaaaataaacaatgttgtcattgctttcacccaaaaaaaa

SEQ ID NO: 238159 - DNA, 681 bp, Homo sapiens
aactccaggcgattggcgcgaaggaggcgaaaagggcggattccctttccgggtcgcgcccgggctgcaggtccttatcccgaagctggggttactaggtgaacacggccggagggagagcgctctgaaatccattcttcagccgcacgtggaaaatggacagctgtgactcttaaagagaattaaagcaacaaagcatctcagcctgctctatgagctggatatttcgtaggaaagagccgatttggcgaaagttacgtaaacaatggaattgtctcagtttgcgcctttgtttcgtttgacagcccttcagggagtcatcgtgattgctggagacggtgaactaacactgtggggacccttgtgctaaacgtgtcaagtggcacaacaaggataggaacacgggtcctttggactccacagcttctgctccttccagattaaaccacactgctttctccaagttgttactgtagtaacatcattttggctgcagtttgtggatgggttggaagatgggaagtcaatgcagaagcaccgttgaaagtattccactgggcagggcgcggtggctcacgcttgtaatcccagtacttcgggaggccgaagcgggaggatcgcttgagcccagaggttcgataccaggctgggcaacacagtgagacctcgtctctatataga

SEQ ID NO: 238160 - DNA, 431 bp, Homo sapiens
tatgagaataaatctttaaaaattggcattttattactgctttctggaatctttaaaattaaataatttttatgcattagagtaggtgtatatatatctctgggaataactggaataaacaacataaaagagaaagaatagagaaaatttattttttataagtcttcattctgctcagtttaacagtgcccaaatacagagtaaatattgatactagtgaaataacttttcacaactttttttgggtactataatagaatacttggattttaaatagaatatagaatataaaatattgttttaaagaaagcagggccaagtgtggtggctcacacctgaaaatccagaaccttaggaagctgaggtaggaagatcacttgagcccaggagttgagaccagcctgggcaacatagtgagaccctctctctta

SEQ ID NO: 238161 - DNA, 827 bp, Homo sapiens
acataaatctttcaggtagtagtgattgtctaccaagaattctagaatttgagacttccagtgaattgagtgaatcggaaacagaggttgtgtatatcatatacatgaacatattacacaaatacacatataatgcatgttgtgaacacagatgaatacaagcaggttcaacattaacttagtgtttgattattaatcctaatacacataaatagataactttaatatcctcaaaactctcatacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggcatatgtaatatggcattgcttaatattactatgaaataatgatgcatttaaatataaattttgatatattctgaaccagagttcatttgatattttgaaccagatttgggtcctttgtaaagcagaatcaatcttgtaaataaattaaatcatgctaaaactgtagaagtcaaattaaagcaacttttagaatatctttgctgaatgaggagcagcatatcagattcaagattgaaggaagagaaccagaagaagggactccatacttggtgtgccaagttacctcttcattgagaaaaggaagtgagggctgacatgaagtgggatggtccctgtctgtccttggcatcactttgtagtggccctcagtatggaaccactagaatcagaaactggaagctgggaggttccacggaagtcattg

SEQ ID NO: 238162 - DNA, 331 bp, Homo sapiens
tgattatatccttctaactgtggtgagatattttattgtggttttgatttgcatttccctgatgattagtgatgttgagtattattttgtatacctgttgcccatttgtatgtcttcttcagagaaatgtccatgcagatcttttgcccatttcttttttttttttttttgagttatttgaattatttccctgttttggatattaaccccttgttggatgtgtagtttgcaaatattttctcccattctgtgggttgtctcttcactctgttgattgtttcctgtgatgtgcagatgctttttagttcgatgtaattctatttgtctatca

SEQ ID NO: 238163 - DNA, 352 bp, Homo sapiens
acaaatacacaagtagtgtgtgattgtctctgtcttcatatttagttgggacaagccgaagctgtatgatgatgtaacaggcattttttttttaaatggttagatctcttcttcactgagtgaccttataacaccacacacgtctcctgcagagaaccagtgccaatctccttcaccagaatattttctgctccacagatagtgatagttgtagcagtagttgtactcattggaaactgtcctgtgagtgtttagtatgtgctaggcactctcctgagcactttatgcatattatttatttaaaccttgtgagatcttagactaagttagcacagggaaaaaaggaatttga

SEQ ID NO: 238164 - DNA, 421 bp, Homo sapiens
tcccatgagatcacaatgttgtctctactctggaagcagtttaccctcaaccctggtgttttattaagagtggaaggatgtgtcctggtagtgggatgtcccatgtttgtagtgcaggacgctcgaccatcttcaacttaacaggcccagtctgaccaaggaggccctctccttctggaatctggggttccagttagtctagatgggtctcttggacagggatgtaaatatggaagccttgagattgcaatattctatctattttatggatggagaaggcaaggaaattggactagggaaagaagcacagatgagagacagagtctggatggcttatcagttctacattcccttatgctaccaaagcctggctgcattcctctatcttttaataaatatcttttcctttcctgtgagccac

SEQ ID NO: 238165 - DNA, 472 bp, Homo sapiens
tcctagtcaatacacgggcctgggaaccaggaactcttgagtcgtaacctcagcttgagcagtagccctcccaccttgtatgactttaggtaaagcatttaacttctcttccatctaccaaataggagttactgatgctgtccaggttaccaagtgactgctagtgactgctctccatgtgagaagtttgcagagtccagagcacacatctgatgggaggggcgaggctttctacagctgcttgacctttgcttggcttcactaattgggagtttcacgcagagttctcattggctgatggaaaacaaattctatgcaatttctgattgtaaacttagaaaattcagagagaaacagccgctaccaaccacctccacctccaccaccgctgccaccaccttgaatggaattgtcctcacttttgttgctgttgcaaatgtactaaaataaagacatctttggaagatgacga

SEQ ID NO: 238166 - DNA, 385 bp, Homo sapiens
agatctagggtcgagctgaacttggctgagtgactaatttcaccagtctgagctttccccagagttaaatgagaaaatatagaaagtgtctaataaattacgtggcccagatggatactcaattaatgtcattgaatgaatcttcatggagagagcacatgtttataaaaaaaagtcttcagtgaatcatgataagagtattgccaatggtctctaatttctttagattagaaaagaggttttcatgttgcttgcatttggtcttttccttatttaatgtctgccacactctgaagactttaagaatgtttaataattgaatgattctgtatttatatactcaaaccctggcataaaatattcttgctaattacataatgcactc

SEQ ID NO: 238167 - DNA, 501 bp, Homo sapiens
ggaatttttttgtatctgtatgttgatctctatagacagattggtgaaattttcccgaattatttcctcaaatgtgttttccaagttgcttactttcatctttttcaagaatgccaataaggcataggtttgattgcattacataatcctgtatttctcgaagtctttttttttttctcccatttccttaaattcttttttcttttgtctgactgggtggatttgcaggatcggcctttgaactttgaaactctcttctgcttggtctagtctattcctaaggcttccaactgtattttgaaatttttcaattccagacgttctgtttggttctttcttaatacagctatgtcatcttttgaattggattgtttttctggcttctttgtgttggatttcatctttctcttggacctcattgagtttctttgctccatatatattctgaattttatactgtcatttcagatatttcattctggttaggatccattgctaggg

SEQ ID NO: 238168 - DNA, 299 bp, Homo sapiens
ggaatttttttgtatctgtatgttgatctctatagacagattggtgaaattttcccgaattatttcctcaaatgtgttttccaagttgcttactttcatctttttcaagaatgccaataaggcataggtttgattgcattacataatcctgtatttctcgaagtctttttttttttctcccatttccttaaattcttttttcttttgtctgactgggtggatttgcaggatcggccttccaaagtgctgggattacaggcatgagccaccacgccgggccaagacaagagtccatctca

SEQ ID NO: 238169 - DNA, 2284 bp, Homo sapiens
ccctccaataacaagcccctctgtggctctctgcctgtggtccaccttcccactgtgaaccatgctggcaaggagctggggttatgaagggaaagagcagggcacaaggcaagtagggctcgtgacttttcccctttcattatgtgtgtccaccgagctgtcctgcttctgttttgtaatgggttcttccatggcaagctgacctttcggctgaataggtcaaactcccactgagcgttaaccctcagccctcctcacgtgagtgcctcccctgaggtgaggagcactggttaggaatatgactgggagggcctggtgtattccccaaagaagggttgccttttactgcactgaattaattctcagagaccaccgtgtgaggttatgctgaaggatccagattagaactttcctgctgacattgtggaggggcaaaactaattcttcagatacatgttttagactgtggttcccctgtgtatcttcccctttttaatgagagaaaggccaaatgcacagtcttagtgattcatcggatcattttggatttctgagacaatcagaattttcctagatgattttttaaaaaaccaataaacccttctccctgtatttctcttccatttaaagtctcttaaaactctaggtgttttatttttaacccttgtaaaacatgaaatagtagagttgtggtgtgtgttgataattatatactggacctacttttgttttaaatgtcataaaacattttttggactatttattaagttttgcaacactaattcccttatagtagctagaaattttcaacatcaaataggcatttagtcatgttgaattgaattttaagttgaattcctgtggcttgggctttcttttttatactagtttgtataaactgttcaactcctatagctcttacgtctcactctcagtgagctggtaacagaatcttcacagacaagtggttgcacattccatttatttagcaatgccctctgtgtgtgtgtgtgtgtgtgtgtgtgtgtgtgttgtgtgtgtgtgtataggttaattttgttagtgttctttaaatttcagaaaatagtcttttagttgaacaaacaaataaatgaaatatgtcagtagatcagatgaaactgtgacccgttcggcaatagtaagtatacagtgtgtctgggctaccagatggttttagaaactgtcaatttccaaaatacagaaatctgagagagcttcataaacaatgtattgctttgctgaagatgacagatcccattgaggaaatgcccctttagttgttttagatcattaatgatactctataaacataataagattaacacggagaaacaaaatacctgtgtttgcagtattctttagttatcagattattgtctcagttctcaaaatgccaaatgtgataggataagtgcaagataagaagtacatttttaacatctattcagttagcattaatgctcaagttaaagctgggctcctaccagggacataatgggctcctgtttaacatatttatgttggttgtaaaattaggaactgtctttgcagcccacatcacctgcataagtgcaaaacatataaatcaagagaagttccagtgacataaaaatgccatcgaatagaatagcatgaaactacttgcaagatacttgtatattatgctagggtgtatgggggtacacactcagatttctagggggtttggagaacaaagaataactatacagatagaactcatggatgaagacatttcctcagagcacagcctgaaccctagtggagaaacagcgggaaaagaaaggccatcagtagccagacttgaataaccgccccaccccccacacccccactgaagacaacagcgtctatgctttcagaaggcatttgagcagctttatgttgttactggagcttgcatcttgggcctcctaagtcagtgaacttttctgtgatgttttagggttccttataacctggtggctattactcccttgccccctcataatccagttctttgtagaatgatttctgttatctaaaattagtccttttttctttttttgggggaggggggaggggacgtgcagtgatttattttgaactttgtaattggagtccctgaagtgcccccccaaattatgagctattaataaggagctttctgaatcctaattactgtctcaaaaacagagtggacacttgagaagtttttcaactcccccgcttctccctcccaaaagccacccacccccataatctc

SEQ ID NO: 238170 - DNA, 171 bp, Homo sapiens
acgtttacacaattgcattgtgacctgccactcataaatacatcacttagtgtgtatgtcagttcaggtatcaggcagcaggaatgtttttgaataaccccagcaatatactcaggggaaagccacggtcatataatctgtctctaattattttcaacaaacagcaaagag

SEQ ID NO: 238171 - DNA, 440 bp, Homo sapiens
tgtcttcttgttccacagggaatggcaaggaacctgaggaaccagcgtgaggaaaacctggatgatctgacgtcttcctcactttatccctacctgtccacgcctccatccatccacccatccatcactgatcaagctctcactatgtctatagtgtagaaggtgccaccaaatgcaatggaacctcttgtctcatgtgtctacttgcatctttaagttgatacacggaaggcacagtccaagcacaggatactggaagctatggaggtacagtggcctctgagcaaactgaaaactctctatcactaaagggttgggcatacagggtatctcctctgctctgccacctaccttgaggatgctttacatgtggctaaaagtggaggcagagatatttggataaataaatgctagagaattggaaattcctaggacaagtc

SEQ ID NO: 238172 - DNA, 488 bp, Homo sapiens
tggtattttgttttgttttaattttacaagaaatatatgagtattctctcatttaaaaaggagaataagggagatactaatgtgatatcttcaattttttactctaggcatttccataaaccagataatatggaaatccctagagtaaaaattgaagttatcaccttagtatcatatcacccttactgtctccttgatatcattccccactgcagaagtaactaccgtcaacttttggtgtatatgcttccaggcttttatctatgtatttttatatacgtgtgtgggtgtgtcagatacatacaaaggtatgtgtatacaaaaagatatgtatgtgcatgcgtgcatgtatacatatttgtgaatgtatgtacatatttatgaacacatataaacacataactggactatcagcctacctctggtccctaactagtctttccacatctcttcttatccatttgcagttcattctttattctgtagcc

SEQ ID NO: 238173 - DNA, 411 bp, Homo sapiens
tatttaataaactatgttagaggctagatctcattcatgtctatataccctatagcatctactcatgtggcttacagatcataggaactagttatcttaaatcttaaattctttttgaagaaactgtagtataaaatatacatctataaaggaaagtagtgaattcaattaacgtttgttcgttagaactgaaggtgaagctaaaagaacaaccccctgtattacaaaaactgcattctgttgtgtatgataaaaaggaaatgcaaaatgcatagggacaatgaatcacctctcccctgctcaaatggtatccgttaagtgtgcatcagaaaggaattttttgtcagggcagctgctgttgtccagccaaaagagatacttggattccggaagaagccagcttacttttta

SEQ ID NO: 238174 - DNA, 489 bp, Homo sapiens
ggtctgccaacaaggtataacaggaagttccaagcatccctaaagtgttttgagaggaatgtggagaacttgagttggtctcaaggcctgtgatgggggatctagtgtagagctgaggatctctaggctgatgggaagttaaaagattgtaggtactgtttgcctgtcttccagtattacttaaaccttttatctttgttggggttgtgtttagctacctcagtagcctcttttcaaagatcccctggctcttggaaaatttcctcaaaatggtgtttctgggaccacaatttaaaaaaattgtttgtttatttattttagagatgagggcttgccatattgcctaggctgttctccaactcctaggctcaggtaatcttcccatcttggccttccaaagtactgggaattacagatatgagccaccatgcccagccccgtaatttttaagtaagccatttttctcatataagttcttttgcttatcta

SEQ ID NO: 238175 - DNA, 456 bp, Homo sapiens
tgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaata

SEQ ID NO: 238176 - DNA, 563 bp, Homo sapiens
cttgcagtcacaaccatccactgcactgtcagtcatctcagaaactatataaccttataaccttctctagtaacttgccagctattacacacccaaagatcctgttctctcacagtattaagtaatccctggtactctccaaagtcaaagagatcacatagtttaatgtgaaagagagcaaagctttagacctgacagaaaactgcccatgtctcttcagactccaaaagtaatccaaaatatcccaaaaagagtgtgttcaatgcttttttctgtgttcctgaagggtctcagcggttctagataactcttctagatgtctttacatgatattgaagatggcaaagaggaaggaggagcagaagtaaaggcgagtacaaatcttagaggagccattttcagaagactataggttttccaaaggggtcaaggaagtgttgcattttttcttcagcaaaattgtaccgacaaggaagaaaatgaacagagggaccaaacacataattaaaaagtgtcacaattgactgaaaaaaatttcccaaaatcaggatccaaaagagaaa

SEQ ID NO: 238177 - DNA, 400 bp, Homo sapiens
taaattaggaattcaagtcagaaacaggaaacgcagtttgctgaaaccatgaatgggaaatggtttttttgccgtccgtatttaatttgctaagttagcaaatttaatctgaagataatttaaacagtagttaaatctatccagatttatttcatctacctttctaaaaaaatgtgtctttttaatattcatgctggttttctatgaagtcagatgtagtctttagaaagggtttttttgttttttttgtttgtttgttttgtttttggctgggcggtagctcacacctgtaatcccagcactttgggaggttgaggcaggcagatcttgaggtcaggagatcaggaccatcctggctaacatgatgaaatcccatctctactaaagatacaaaaaatta

SEQ ID NO: 238178 - DNA, 366 bp, Homo sapiens
gctcagccagacagttcttattcgggttctcatgcagttatagtcatcatcagattgtggccgcgactggcataatctcaaaggcttccttagtatttctggcagttgatgctaggacctcagctagtgctggggctggaacatgtctacacatagcttccccacagcatggtggctaggtactaggagtgactgtcccaagaggaccaggcagaagcagttacattttatgacctagtctcagaagtctcataacatcacttccactaaagtcccaagcccccccagattcaaatggagggagcatatatcccatctcagtggtaggaatttcaaagaataaattctgtgaaactgtagtagata

SEQ ID NO: 238179 - DNA, 467 bp, Homo sapiens
ggagtctgatgtttctttgggatcattgttagaatgccagataaaataacatgtaagagttcattgtagatcacacagtctgatccgaggaagcaataatcccttcttttaaatgcattttctagtcacagtgtcctctgtccaggtgctgatctcccactctagaaggaggaatcagcaatggctgaaggcacaggtctcccaggttcacagtcccactgccgggcaattaaaaagccttggtacatcacactctggggactgttgtggggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataataataataaataaaaaagaataaaataaaataaaataaaat

SEQ ID NO: 238180 - DNA, 437 bp, Homo sapiens
agagataaaatgtagtaggcaagaagagaaaagagatcatctcagctggttttggatattggacatgagctcaaacctgagaactgagaagctgtctgctgcaggtgagtctggatgatggacagtgacaagcagttattcatgtgtgaatctggtcaacatgaacatttagatgctgaacacaaaagcttgatttttattagctatatttgttgcccatatattggaacagatcttaaagtggaagtcagacgtgtattatcagatatcatttggagtaatgagtgtattttcctaatctttccaacaccaacctaaaaactcatgtcaaaagcatgcatactaattaatttgttttccatatagtaataagattaacaacctcgcatttacatggggtactgagtcatgctcaaataaaacaagttctaatgaga

SEQ ID NO: 238181 - DNA, 646 bp, Homo sapiens
gtctgaacagctgctgccaccacttttttaagccaccttcactcaggaacgagccttgtgcagacatacagaacagtatccacaggcagagtcaaatttgcttccactgatccttgctaagtactggtctggggtcgtgctgcctcaccacacacaactgcagaagcacggtcgttctgtcctgccatcagatacacacacggcagaagccagtcagccggactgtggctagtcagggccgcgccctcattgtcccattaaacccttcaccagaaatggagatttggagagtcttaacttctggaaactgagtttgtgacttgcttcccatcatccgtactgtaacattgatcctattgacctgtttgctctcccatttgtctgtgagcaactttctgggggatggaccaaagatatggctcaagctgtgggatcagatggatttaagtttgaatcataggttcacgacatccaaagtgtgtgaagaaaggaagggaagtgtgtgttaaaagaagtgggcgagggccaggcatggtggcttacacctgtaatcccagcactttgggaggccgaggcgggtggatcacctgaggttgggagttcgagaccagcctgctcgtgccgaattcggcacgagcggcacgag

SEQ ID NO: 238182 - DNA, 487 bp, Homo sapiens
tcacacacacccacttcctcatcgggcaatttggggcaagctacttctctaggtgcctggagtttgatgtctgtgtgatggggagaagagttgtgcctactcagaatcactggaggtgaaatacaaacttacagagaggacctggcttgaaggtattcaagaacaagaggattcagaagtgttcagtcttactcccattcttttgctacagttatcacataagctttgttgttaaatgtgggtccatgaagcttttatcattactgtccccaaagtgtgttgatagcatttcctaggaggatttgacctttgttgtattgtgattttctaataagaggcatatgattggataaaagacataatattggaaaggagtgaaaagactgggccctgcctccaattttactgttaactgtaaccctggaaacactcttttgaaaaaaagttaattaaacgagatcatgtcctttgcagggacatggatgga

SEQ ID NO: 238183 - DNA, 1884 bp, Homo sapiens
  misc_feature (228)..(228): n is a, c, g, or t
  misc_feature (439)..(439): n is a, c, g, or t
  misc_feature (684)..(684): n is a, c, g, or t
  misc_feature (822)..(822): n is a, c, g, or t
  misc_feature (912)..(912): n is a, c, g, or t
  misc_feature (1041)..(1041): n is a, c, g, or t
  misc_feature (1063)..(1063): n is a, c, g, or t
  misc_feature (1219)..(1219): n is a, c, g, or t
  misc_feature (1354)..(1354): n is a, c, g, or t
ccttcggatggcgtttctgagtggacgtcctttttgttgatattgatgctatacctttctgtttgttagttttccttctaacagtcaggtccctctgctgcaggtctgctagagtttgctggaggtccactccagaccctgtttgcctgagtatcaccagcagaggctacagaacagcaaagattgctgcctgttccttcctggaagcattgtccctgaggggcaccngccagatgccagccagactctcttgtatggggtatcttttggcccctgctggggggtgtctcctggtcaggagacacaggggtcacggacccacttgaggaggcagtctgacccttagcagagctcgagcactgtgctaggagatccactgctctcttcagagctggcaggcagggacctttgagactgctgaagctgcacccacagccancatttgccccaggtgatctgtcccagggagatggcttcatctataagcccctgactggggctgctgcctttttttcagagatgccctgcccagagaagaggaatctagagaggcagtctagctacagtagctttgctgagctgcggagggctccagccagttgccatttccctgtggctttgtttacactatgaggggaaaaccacctgctcaagcctcagtaatggtggatgcccctcccccgnccaagcttgagcatcccaggtcgatttcagactgttgtgctggcagtgagaatttcaaaccagtggatcttaacttgctgggctctgtaggggtgggatccgctgagctagaccacttggctccctggcttcagccanctttccaggcgagtgaacggttctgtcttgctggcattccaggcaccactggggtatgaaaaaaaaactcctgcagctagcttggtgtcngcccaaacggctgtccagttttgtgcttgaaacccagggccctggtggtgtaggcacccgagggaatctcctggtctgtgggttgtgaagaccgtgggaaaagtgtagtgcctggaccagagtgcaccnttcctcatggcacagtccctcncggcttcccttggctagtggaggaggttcactaaccacttgtgcttcctgcatgaggcaacaccccaccctgctttggcttgccctccatgggctgtacccgctgtttaaccagatgagctgggtacctcagctggaaatgcagaaatcaccctcnttctgcgttgatctcgctgggagctgcagactggagctgttcctattcggccatcttgccacaagctgatgttagtcttttagggcccattagctctcaagccttcctgtacaactgtaagatggccattattantactcccgccagatgccagccagagctttcttgtatctaaacctgtgtttgttttttaaaactcatcaggagagttttttcctccaaagatcatcttaattgaagaactgaattaaaagcatacatgtgccctgtgtctacacttaaaactatccaaaacacaaacctttatacctaaaggaaactgaggcctggatttgctcagataatgctggaattcatacttaaaactctcagacataccctcaagaaattcagaagtaggaaagacagatatttaaacaaatatatgtgaaaatgctctttgaactataaagcaatttacaaaagtgtcatcaattcatcattgttgttatctttatcacagtcaataatattgttgcccaaattagaatggtttaacaaaacattttcttccttgccttagagcaggggtgtccaaacttttgactttcctgggccacattagaagaagaatgtgtcttcggccacacataaaatacgctaacactaataatagatgatgagct

SEQ ID NO: 238184 - DNA, 360 bp, Homo sapiens
acagagcagcacggtgactcaacgctcggtagtggcagcagctacacacagatgccagccgaaaacggctcgctggtgcacaccttggtaacagctgctcctccattttttgctgagaaaccacacagcatcacagcaggataggagagcttgagaagatcccagggatggctgagcagcaccttgtagccaggatagctggagtaagcctcagttcacctaccatctgttggcaggagaccagccgcatttttctacggtgtttttgtatatatttagatacacctgtaagtgtgattaagaagacagcacattgcacacccaggaataaacagaatgtggtttgggcaaactcaaagc

SEQ ID NO: 238185 - DNA, 364 bp, Homo sapiens
tgttctagaaaaagttattttttattcattgtttccatcacctacttgttagctttcttaagaaaaaaatttttttagtataaaaagaattgtgttcactaagccagctcacttctgaccacaatagtgtctttgtgtattcatagaaggtgacctgcctctaaatttcaatggggaattgtgaatgggccatgttatgaaactgtccgaacttcctacttgctagcatgggagacgaggggggcaatataactgccatgttctcttcttttggaaaataacttcaaactgtagactcaaaaagggcaatgtgctacaggtttggaaggaagcttttaaaaaaaatgtttctcagattgtaaac

SEQ ID NO: 238186 - DNA, 515 bp, Homo sapiens
taatttcgtatatacacacaccactcacatgtatacacgtatctctttctatacatattaagaaattttttctaatcttacaatcagttaaatatttgcctatgttttcttttgtatgtgtgcatttatggtttaattttttactctatatatttaatctctttagaatgattttctatattgtatgaagtatggagctgatctttttttgtcctaatcattgaataatgtactttctgccttgctttataatcttttatagtattaaggattatattaaagtctgtattaagtttttatatttttgttggtattatgaaaaggattttttccatatcatattttgttggtggtttctagctattggcttttatgtatttcatttttaactggccatctttctaaatttttatactggtactaataaatactagtagctcttagacttgattcatttgcatcttctaggtatataattatccagtttatagataaaaataattttgcttcctttc

SEQ ID NO: 238187 - DNA, 281 bp, Homo sapiens
ctttcagcactttgaaaatctcatcctgctgtctcctggcctataccgtttctgctgagaagtctgttgccagatgaattggagcttcattatatgttatttgcctcttttctcctattgcttttaggatcctctttgtccttgacgtttgagagtttaggtcaaatctgtttgggttctctgactttcctatacgcggatatgtctttgtcaagttttggaaagtttcctatttttatttctttggataagctctctaccccttgttctcattcaagtcc

SEQ ID NO: 238188 - DNA, 398 bp, Homo sapiens
ttttttttttgagacagggtcccactccgtcgcccaggctggagtgcagtgatgtgatcattgctcactgcagcctccacctcctgggctcaagtgatcctcctgcctcctctgagtagctgggactgcatgcatgcaccacaatgcccatctaattttcgtattttctgtagagatggggtttcgccatattgcccaggctggtctggaactcctgggctcgagcacttctcccgccctggcctcccacagcgcatggcctcccacaatttcttgacatccaaagatacttttgctgtcttaaggttttatattttccagaatgtaatacacgtggagttattcaggatatagccttcacagattggcttccttcactgagcaatgtacttttaagg

SEQ ID NO: 238189 - DNA, 339 bp, Homo sapiens
ttttttcgagacagggtctcattctgtcacctagactggagtgcaatggcatgatctcagctcactgcaacctccacctcccaggctcaagcagttctcctgcttcagcttcccaaatagctgggactacagggtctccaatatttgagaactgacacattcaatgtaaaaataatctgagtaaaaccatcatctagtccctttcctttgagacccattttttttttcctcatccacatcctacctataagggaggaagcaaagtgaagaacacagatttcacagatgggatgcctggctcaaattccagcttgaccgctggtagctgtgtgaccctcg

SEQ ID NO: 238190 - DNA, 410 bp, Homo sapiens
catattatcattttctaaaagtggggtaattaagggatcttcttttaatacttaaatacttaaataattttaaatacttagataattttaagtattctattgttttgcttttctttaaactctactactttgagtgatttattaaagccgaccacataatgttgtataaaaataatgaattaaatatactttgtgtatcaaagtggcttgctagagcataacaagtggttttaaagaaagtaaacaagcaaattaatcgccagttttctcgcagaatgtggcttcttaaatgatgaaaaccttgtaagacttctttcaggttttcaatggctataaacgatttggaagtaatttatcttcttagccattgttagtaccatatgcaagaatttgctcttctccagttttag

SEQ ID NO: 238191 - DNA, 1411 bp, Homo sapiens
agccaccgctcccctcccccgcccgacccctgtgcgacccccgcggggcgcggggtctgagccttgcgggcctccgatcccctcctcagcgttcgcgcggccgagcctgcagaaacagagctggggagaaagcgctctggaggccgctgtgcaccccttcctgcagggctcagactggcggtgtgatgtgggtttattgccttggcctgaggcaggtggcggctgcttctctcggagttttcaaagacagggaaagtgatgccgagtggctgaaggtcactgaggacagtgccgggagatacgtgaagattccttcccagggaaggaatctggaattcccacgcatgagtagagggctctagagagacccgcgcgctggcccttcccgaaaccccttggctccagtgcaccatgtgagtccctggccgcgctcggtgtctctccttcggcccagatttggggatgggaattcctaatggagaaatcgctcatttgcatagtcagtaccctcacgcctcctaagtgtagcctcattatcgacacagacgcctgcagagtcgtttctctataatgcaaattttgcaggatatttttgaacaacgtttttgagttatcatagtaaatgaaaaggcaattactagttatttaggaagaaggaaatggtttgaagtagagataacttttttacctctggggggaaaaaaaggcgaatgacttcagattccatggcaggtcaaaatcagaactggtaagatttctgcatatctggtgagtatccacataaataatcattttcctgaaaattacactctccttatttaatctgtatttttgcataaaaatgtgagattatacctgggtcataaatgcactgctgtccatttatttctgaagtttattgcatagccatggataatttgagttttatattcaatagcagaaactatttttctaaccacgtaagcagtcagaattgatttcagaagaaatgcgcagcaataaaagttaaggcttatttaataacagtttggggccaatttggtccccctggaaactatctttgacattgacaatccgaagagcaaaagtttaagaaaggatctaatacttcaaaatttagcttgtgggccggacgcggtggttcacgtctgtaatcccagcactttgggaggctgaggcgggcggatcacctgaggtcgagagttccagaccagcctgaccaacatggagaaacactgtctctactaaaaatacaaaattagccgggcgtggtggtgcatgcctgtaatcccagctactcgggaggctaaggcaggagaatggcttgaacctgggaggcggaggttgcagagagccgagattgcgccattgcactccagcctgggcaacaagagcaaaactctgcctcaga

SEQ ID NO: 238192 - DNA, 494 bp, Homo sapiens
gttaaaaattcgttcagtcacaaagctagtcaaagagccaggattctatctgaaacatgtcttattcactagtaactacattaggagaattgaaaagtgtattttggtaaattaaaactactgggtttcaaataatgtacataaaatacaaatattggcatattttacctgttaaaaattgtacactttgaagattaaagccattttgaaaatctagccagttgaaaatattagaattacatcattaaatgtcaagaatcgataatgcagttgaatacaaatcaaatcactcttaagccttagaaaaatcccaagactaacagaaatacgaaatgttacgtaagctacatggtacggcatacctgtagtcccagctactcaggaggctgagacatgagaattgagaatcacttgaacctgggaggtggaggctgcagtgtgccaaaattgcgccactgcactccagcctgggtgacagagggaaactgtctcaa

SEQ ID NO: 238193 - DNA, 2085 bp, Homo sapiens
  misc_feature (976)..(976): n is a, c, g, or t
  misc_feature (1379)..(1379): n is a, c, g, or t
  misc_feature (1866)..(1866): n is a, c, g, or t
ttacagccaagggtcaggattaggatgtaaactcctgggagtgtgtgtgtgttttatcctggtatctctcgtggtgactaattccttgcttgtgcatttcaagagctcaaaatatttttgctctttgcaatggtctgaatgtattctcccaaaattcatatgttgagacttaattgccaatgtggtagtaatgcaataaatcagattatatctttgtaagctttaagagataattaagttatgagggtagagccttcatggaaggaattaaggctcttacaaatgggcttaagggagtgggttcattaccttctatcccttcctccacgtgaggacacggcatttactccctctggagcatgcagcaacaacataccatcttggaagcagaccacagtgcaatcaaattggaacacaagattaagaaactcactcaaaaccacacacctacatggaaattgaacaacctgctcctgaacgacttctgggtaaataatgaaattaaggtagaaatcaagaagttctttgaaaccagtgaggacaaagagacaatgtaccagaatctttgggatgcagttaaagcagtgttgagggaaatttatagcaccgagtacccacatcaaaaagttagaaagatctcaaatcaacaccataacatcacaactaaaagaactagagaaccaagagcaagcaaaccccaaagctagcagaagacaaaaaaaaaaacatcaagatcagagcagaactgaaggagatagagatatgaaaaacccttaaaaaatcaatgaatccaggagctttttttgaaaaaattaataaaatagaccactagctagactaatagagaagaaaagagagaagaaccagatagacaaaataaaaaatggttaagggtatatcaccacttagcccacagaaatacaaacagccatcagagaatactataaacatctttatgcaaataaactagaaaatntagaagaaatggacaaattcctgggcacatacaccctcccaagactaaatcaggaagaagctgaatccctgaatagatcaataacaagttctgaaattgaggcagtaataaatagtctaccaaccaaaaaaagcctggggccagacagatttacagctgaattctaccagaggtacaaagaggagctggtaccatttcttctgaaactgttccaaacaattgaaaaggagggatttctccataactcattttatgaggccagcatcatcctgataccaaaagctggcagagatacaacaaaaaaagaaaacttgtaggtcaatatccttaataaacatcaatgcaaaaattctcaataaaatactggcaaaccgaatccagcagaacatcaaaaagcttatcnaccacgatcaagttggcttcatcaatgggatgcaaggctggttcaacatacacaaaacaatacatgcaattcatcacataaatagaactaaagacaaaaaccacatgattatctcaatagattcagaaaaggccttcgataaaattcaccatcccttcatattaaaaactctcaataaactaggtattgaaagaacatacctcaaaataataggcatttatgacaagcccacagccaatatcatacagaatgggcaaaagctggaaatattccccttgaaaaccagcacaaaacaaggatgccctctctcatcactcctattcaacatagtattggaagttctggccaggacagtcaggcaagagaaagaaataaaagctattcaaataggaagaggggaagtcaacctgcctctgtttgcagatggcatgatcctatatcaagaaaaccccatcatctcaggccaaagccttcttaagctgataancaaattcaggaaagtctgaggatacaaaatcaatgttcaaaaatcacaagcattcctatataccagcaacagacaagcagagagccaaatcatgaatgaactcccattcacaattgctacagagagaataaaatacctaggaatacagctatcaagggaagtaaatgaccttttcaaggagaaccacaagccactgcttaaggaaatctgagaggaaac

SEQ ID NO: 238194 - DNA, 1195 bp, Homo sapiens
  misc_feature (12)..(12): n is a, c, g, or t
  misc_feature (17)..(18): n is a, c, g, or t
  misc_feature (33)..(33): n is a, c, g, or t
  misc_feature (39)..(39): n is a, c, g, or t
  misc_feature (49)..(49): n is a, c, g, or t
  misc_feature (60)..(60): n is a, c, g, or t
  misc_feature (64)..(65): n is a, c, g, or t
  misc_feature (80)..(80): n is a, c, g, or t
  misc_feature (90)..(90): n is a, c, g, or t
  misc_feature (93)..(93): n is a, c, g, or t
  misc_feature (104)..(104): n is a, c, g, or t
  misc_feature (125)..(126): n is a, c, g, or t
ctggaaaggagngtcgnnatttcgccatgttgnccaggntgatttttgnatttttagtanaganngttttgccatgtggnccaggttggnccnaaacccctggnttcaagtgatctgcccccctnngcctcccagagtgctgaggcaggagaattttttgaacccgggaggcagaggttgcagtgagccgagattgcgccgttgcaccacagcctgggtgacagagcgagtctccgactcaaaaaaataaataaaataaaataaaaataaaatgggctcaataagaatctctaacacctaaagcaatggtaaaacaaagccttaccaccgctatcttcctgtgctgtatatagggctattcgccagagctggaggtattccagggagggaaaattgtccatgctctgggtctatctataacgctggataaaagatgcctagaacctaggctgcaaatgtacaagctttcctcattaaagaatggtaaaatgggtcccatttggtttcatcaaaaaggcagcaaatctttcacaactgaggaaaacaggtgaaccacgagcttcacattccaacagaactgtggtacctatgctagccacaaagattatttgttgactcaaatgtaattgtaccagtaatgaacaattagtatgctcagcgatgctcaggagagccgctccaaaaacttacattattccccagacaaacgttctctaggggcagccttgcgtatttctacaccttagtagacctaagttaggcgttcaacaccttgtcctggtccaagccagaaagaacccagtagttcagacttttcccaggtcagaaaaccacgaagggcctcctcacaccctgattaaacgttggaagcgggccctgtgctgtaataacgctctggccactcccaaaaaagcgaatcttcgggaggaaagcaggctcccttattagggctcacagcactccgctcaacttactgtaggcgtcggctccagcaagactcgtccctccaagcctttaaattatctgactgcgggccagtagcaaatgaacggcactggtggcggtgggggatggctgcgcgagtgaaatgacctccgtgtgtttgctaaccccgctattatactgccccgcttagaaacttaaagcgcttcagacatcagatctcactcgcttcccaaataggcttccgtccgcg

SEQ ID NO: 238195 - DNA, 445 bp, Homo sapiens
aggctccatcctgcccttcctctcagccacaggtgcaggatggtagatgggaacttgccagaaggatgcgaccctatttaagtagttgtgttttcttccagcccagcatccccaccaaaacaggaaaagaagtgctctcgtgcagggcttgttcacagtgagcctggctggctcctcatgatctctgagtttaaaatgtgccagcagatgattttaacgatcccatcaaaaattgttgtctggatcagtttcgagctagcgtttccttgcagaggccattcttccttttttgacaaaagttgggtcggccaggtgcagtggctcatacttgtaatcccagcacttcgggaggctgaggcaggtggatcacctgaggtcagaagttcaagaccagcctggccaacatggcaaaaccctgtctctactaaaaataaaaaataaaaat

SEQ ID NO: 238196 - DNA, 1198 bp, Homo sapiens
ttccttttttatttttaatttttgtgggtaaatagtaggtgtatatatttatggaatatatgagatattttggtacaagcatgcaatgtgtaataatcacatcatggaagatggggtctccatcaccttaagcatttatgcattgcattacaaacaatccaatgatactcttttagttattacaaatgtacaattaaattattattgactatagtcaccctgttgtgctatcaaacactaggtcttattctttctatttttttgtattcatcagccatcctcacttaccctccaaccccccactacgctttccagcctctggtaactatccttctaggctctatgtccatgagttaagttattttgatctttagatctcacacataagttagaacatgtgatgtttatctttctgtgcctcatttatttcacttaatataatgacctccagttgaatttattttgtctaaagtttttcttttaacattggtttttgagagttagtttgtatatgccagttccagcataccattcattgcaccttaggaaatagatacaacgctaggtacatagaaagtgtacagtaaaattctttattagagtgtactaagacttctgaattataacaatcccactattaggtaatgtgcacctgtccttttagcatatctgttacttaaatctagattttctaaactaaggaagtggagattctaatcttaagcatgttcatctaggactagaaacagagtgtatggaagagaacatagacaactaaaatatgggaggcatattgagagaaacgaaatccctgtggccaagaacaacagttttgttcagatattaaactttatcacaaggttatttgattgggtaatagctatagggagaaagagattgaaatgaaagctaagagctgaatctataaaaataaggtacaaaaacaaaatagctacctaaatgaggacagaaagcacagacaagaggggtagatacagcttatggagaagacaaacacaaaacaggagataaaaaggccagggttataaccatagtttcctaggctaatcttttttacatttcctagaaattaatgaaaacacctccttatagcctaggaagaaagtgaatgcaggaggccttttttttttttttttgtatttttgtctcccttcctttcccttcctcccttcctccc

SEQ ID NO: 238197 - DNA, 1145 bp, Homo sapiens
ttccttttttatttttaatttttgtgggtaaatagtaggtgtatatatttatggaatatatgagatattttggtacaagcatgcaatgtgtaataatcacatcatggaagatggggtctccatcaccttaagcatttatgcattgcattacaaacaatccaatgatactcttttagttattacaaatgtacaattaaattattattgactatagtcaccctgttgtgctatcaaacactaggtcttattctttctatttttttgtattcatcagccatcctcacttaccctccaaccccccactacgctttccagcctctggtaactatccttctaggctctatgtccatgagttaagttattttgatctttagatctcacacataagttagaacatgtgatgtttatctttctgtgcctcatttatttcacttaatataatgacctccagttgaatttattttgtctaaagtttttcttttaacattggtttttgagagttagtttgtatatgccagttccagcataccattcattgcaccttaggaaatagatacaacgctaggtacatagaaagtgtacagtaaaattctttattagagtgtactaagaatatctgttacttaaatctagattttctaaactaaggaagtggagattctaatcttaagcatgttcatctaggactagaaacagagtgtatggaagagaacatagacaactaaaatatgggaggcatattgagagaaacgaaatccctgtggccaagaacaacagttttgttcagatattaaactttatcacaaggttatttgattgggtaatagctatagggagaaagagattgaaatgaaagctaagagctgaatctataaaaataaggtacaaaaacaaaatagctacctaaatgaggacagaaagcacagacaagaggggtagatacagcttatggagaagacaaacacaaaacaggagataaaaaggccagggttataaccatagtttcctaggctaatcttttttacatttcctagaaattaatgaaaacacctccttatagcctaggaagaaagtgaatgcaggaggccttttttttttttttttgtatttttgtctcccttcctttcccttcctcccttcctccc

SEQ ID NO: 238198 - DNA, 1144 bp, Homo sapiens
ttccttttttatttttaatttttgtgggtaaatagtaggtgtatatatttatggaatatatgagatattttggtacaagcatgcaatgtgtaataatcacatcatggaagatggggtctccatcaccttaagcatttatgcattgcattacaaacaatccaatgatactcttttagttattacaaatgtacaattaaattattattgactatagtcaccctgttgtgctatcaaacactaggtcttattctttctatttttttgtattcatcagccatcctcacttaccctccaaccccccactacgctttccagcctctggtaactatccttctaggctctatgtccatgagttaagttattttgatctttagatctcacacataagttagaacatgtgatgtttatctttctgtgcctcatttatttcacttaatataatgacctccagttgaatttattttgtctaaagtttttcttttaacattggtttttgagagttagtttgtatatgccagttccagcataccattcattgcaccttaggaaatagatacaacgctaggtacatagaaagtgtacagtaaaattctttattagagtgtactaagacttctgaattataacaatcccactattaggtaatgtgcacctgtccttttagcatatctgttacttaaatctagattttctaaactaaggaagtggagattctaatcttaagcatgttcatctaggactagaaacagagtgtatggaagagaacatagacaactaaaagttcagatattaaactttatcacaaggttatttgattgggtaatagctatagggagaaagagattgaaatgaaagctaagagctgaatctataaaaataaggtacaaaaacaaaatagctacctaaatgaggacagaaagcacagacaagaggggtagatacagcttatggagaagacaaacacaaaacaggagataaaaaggccagggttataaccatagtttcctaggctaatcttttttacatttcctagaaattaatgaaaacacctccttatagcctaggaagaaagtgaatgcaggaggccttttttttttttttttgtatttttgtctcccttcctttcccttcctcccttcctccc

SEQ ID NO: 238199 - DNA, 507 bp, Homo sapiens
ctgtaaacccttacttaagggtttgtggttcactataatgaccataatcttttcttattaccttaacatttccaatggaaggaacccaaaggtgattcagaagataactaagtgtggctctaatctgttagctgagccagctccacttagcttccattgatgacaccaactgggctctggatattagccgacacctcatgataccttctgtacaaatgagcccgaattggtgcctccttcacacagcttgagactgtgatttcccccagtgtttatcgccaacagttttcaggtgttgcctgcatttcaggacaaagctaggtttaggaggaaaatgatcagtgcaaagagaaggtgctaggctattctagaaaagactctggctgatgcggtggctcacgcctttaatcccagcaccttgggaggctgaggacagaggatcacttgagcccaggagttcaaaaccagcctgggcaacacaacaagaccctgtgtttataaatgaaa

SEQ ID NO: 238200 - DNA, 901 bp, Homo sapiens
  misc_feature (190)..(190): n is a, c, g, or t
  misc_feature (392)..(392): n is a, c, g, or t
  misc_feature (620)..(620): n is a, c, g, or t
taccaactacatgtaaattcctgctatagaataaaacataaagatcattaactacctatggaataagattaagtaatgtaaaatattaagttctcctcttcctccccagaatgctcaaagtggtttggggttcctattgactggagtgtaaataagtaactggacacagtgggtcatctcttccaaggangtgtcctgttccatactgccagttttgagattttttagagtcattaaccaagagtgaacacctctatccctttctacctagacttcatggtagaatctattagagacgttgtctctaaaatttagagcatgatagtccctcttaaggatagtcaaagtgaaaaaattagtaagacctctcaaaattcattcaaaattcatgnttttgttgctcttttgaacctcataaggacaataaattggtgccctctcatcatcttgctaccagagacactctagattattatatggacaatctatgaaattgatttgtaataaatgtctgttggaggtcaaggtgcagctaagagcagctgggtgtcttttgaaaaaaggtcgtggctgttgcatacaaacaagcttgaaaactataatcacccttgaacggtctnttggtcaatgacaacttaaaagctatataaacccaaggagaattggggaggcacagaatagcctttaaaagcaagagccaaatgaacttgaatgatcaaagataactgggacagcatattcagttaacttatttatcaactaaaattaatgtactgacaaattaaaagcaacagtgaattacatgcattccctatctggcagagacatcacttggaaaaaaaataaaaaagaagatggataatgaaatgttttattttaatgttcccaggagatacatttg

SEQ ID NO: 238201 - DNA, 847 bp, Homo sapiens
  misc_feature (338)..(338): n is a, c, g, or t
  misc_feature (566)..(566): n is a, c, g, or t
taccaactacatgtaaattcctgctatagaataaaacataaagatcattaactacctatggaataagattaagtaatgtaaaatattaagttctcctcttcctccccagaatgctcaaagtggtttggggttcctattgactggagtgtaaataagtaactggacattttttagagtcattaaccaagagtgaacacctctatccctttctacctagacttcatggtagaatctattagagacgttgtctctaaaatttagagcatgatagtccctcttaaggatagtcaaagtgaaaaaattagtaagacctctcaaaattcattcaaaattcatgnttttgttgctcttttgaacctcataaggacaataaattggtgccctctcatcatcttgctaccagagacactctagattattatatggacaatctatgaaattgatttgtaataaatgtctgttggaggtcaaggtgcagctaagagcagctgggtgtcttttgaaaaaaggtcgtggctgttgcatacaaacaagcttgaaaactataatcacccttgaacggtctnttggtcaatgacaacttaaaagctatataaacccaaggagaattggggaggcacagaatagcctttaaaagcaagagccaaatgaacttgaatgatcaaagataactgggacagcatattcagttaacttatttatcaactaaaattaatgtactgacaaattaaaagcaacagtgaattacatgcattccctatctggcagagacatcacttggaaaaaaaataaaaaagaagatggataatgaaatgttttattttaatgttcccaggagatacatttg

SEQ ID NO: 238202 - DNA, 437 bp, Homo sapiens
cttcaagggagtctggggaagtgagtttttaacaaggtgtactgctaccccaaacaaactcgggactctgtaagtaagaaagaaaatgaactggatattgacatgggaggcaactagcttgactatttttatgttacagtaagatcttcttgagttttgtaaactcctggaaggtatgcgccatgtcgtgtgcagtttactcatccagtggcatagagctttattatctataccaagcaaacaataaatcattgattgtatatgaaactggtcagttgctgattcctttttatatgacctctcattataaaaaatactatgtgggctgaggcatgggggctcacacctgtaatcccagcacttagggaggccaaggtgggagaattgcttgaggccaggacaagaccagcctgggctacataatgagatgtctgtac

SEQ ID NO: 238203 - DNA, 441 bp, Homo sapiens
tacttttcattgacattgttgtagttgagttgtgtttaactaatttgttaaatgaactgacactgtacattctccctataaaataacagtgtgttttctattatgtctattgcctcaacttagcattatgttaacttatttacaagccagtttatttaggttgtattcaagttagtctttggtgacataaataaaatcagtgatgtggtcataatggagtggtgctatttatgtaaaaatatgttgggtcttgaaaagattagaaaaagctaagttgattaatgtgagggctaagcaatgtaaaaattttaagaaaaaattataaaattagaataataacaaaattttaataagctaaaaggtttttgcacttctgttactttaaatttttgttctactttaaacaaataaaaatttggaattctaattgacttgttatga

SEQ ID NO: 238204 - DNA, 445 bp, Homo sapiens
ttgataatggattggccatgaagtatggcaatgataaaatcttcggtttaaagatgcatcatttgtctgcgttagcatcctttccatctaatgaaattccaggagctttgaatgaatgaatgctacatttacctgaagaagccagccattactgactggctcaaaaataattgtgtatatgataggataagaagacacttatgcaacaatggtgctgtttgatcaccagtattgtttctgccaaatatgtggcctgtagatgagtgcattccaaataggtacctgggtgcccaaagtgacatagaaacacggcacagaagatggaaaaatcgaatagggaatgctcgtcgtgttggggtctattaaatcacagaagaatttcaaaaacagcagtgccatgtagaaaatgaaagtgaacatattctccatggggagccgtgcccta

SEQ ID NO: 238205 - DNA, 365 bp, Homo sapiens
gtagcagtggaaatgctacttgtaaaaccatccttagctccaggatcgtagagctatcactgagacaattgcgcagtgagtgacaagagagataagcggagaatgtgagccatctatgagacagaggacaacttcaataaaaaacaccaggtcagcggataagaccatgtcactcacaggtttgtgacttgaggcctgagcaccaatgatccactccacatcagtggagaatgttggaaagtaaggacgctgtggacattttctgaagttggagaaatggaatggtggagaagccagtattggggtaccatgagtggagcagagttgactacaaatctcaataaagcttttcaactgtaaaaaaa

SEQ ID NO: 238206 - DNA, 665 bp, Homo sapiens
tttccttcttttaatctctccacacacagagatcttgctcttccatgaatatccctctgtctgaaatgtcctgtatccagatagccacatggcttgctccttaatgttcttcaaatctctgttcaaatattactttctaatagaaccttgcctcaattaccctatataaaagtgcatccctcatgccctgcaatccctttcctgaattatcctgctttatttttcccttgatcatttactgtcatctaacatatcatatatttacttgtttgttctttattgtcagacttcccccatctccattctatcttgatcataaactccacgaggagaaggactttatctttcactgtcatgtcaccactgcttggtataactatttggaattcaataaatatccatagagtaaatgaatgaatacgtgaaaacattgacgaaggaaagaatatatgaggaaatagtatttaaattgctactgaaggaggaaaggatgctgccatataaaagtgaggaggactcatgcagagtgaataccatttgcaaaagccaaaacgtttccttaattcatttcttttcaacttttccattacaacaatcatagtgcaaattactgtcatccactgtggaccagtactacatcaggcagctccctgcaggcttttctg

SEQ ID NO: 238207 - DNA, 425 bp, Homo sapiens
gcccagtactacatccattctcccctttttctttagtaatagaaccactgaaccttagctggatgagtaataaaaccgctggataatcttggcctaacatggtgatatgatttggctctgtgtccccacccgaatctcactttgaattgtaatccctgtaattcccatgtatcaaaggaggtactaggtggaggtaattggatcatggggtggtttcccccaagctgttcttgtgatagtgagtgactctcatgagatctgatggttttataagcatctggcatttcccctgcttgcactcactctgtcctggtgcgctgtgaagaaggtgcctgcttctcctttgccttccaccatgattgtaagtttcctgaggcctccctggcaatgcagaactgtgagtcaattaaacttcttttctttat

SEQ ID NO: 238208 - DNA, 1625 bp, Homo sapiens
ttagctaccaatacccacagctgcatcatccacgcaaaagctacccatgcccacagctgcatcatccacgcaaaagtcaccaatacccacagctgcatcgtccacgcaaaagctaccaatacccacagctgcatggtccacgtaaaagctaccaatacccagagccgcatggtccacgcaaaagctaccaatacccacagctgcatcatccacgcaaaagtcaccaatacccacagctgcatcgtccacgcaaaagctaccaatacccacagctgcatggtccacgtaaaagctaccaatacccagagctgcatggtccacgtaaaagctaccaatacccacagctgcatggtccacgcaaaagctaccaatacccacagctgcatcatccacgcaaaagtcaccaatacccacagctgcatcgtccacgcaaaagctacccatgcccacagctgcgtggtccacgcaaaagctaccaatacccacagctgcatggtccacgcaaaagctaccaatacccacagctgcatcgtccacgcaaaagctacccatgcccacagctgcatcgtccacgcaaaagctacccatgcccacagctgcatggtccaccataacaacaatgggggcaacaacccacgcgtccatcaacggacacacaaaacgtggtctttctgcacagtgcagtgcagctcagccacagggaaggaggctccccactaggctccagtgcggggagccacgaaggccccgagctgacaaagccagacacaagggccacacgtggccccgtcaccttcatccgcggtgtccagaacaggtctcctcggcagaagccccttcatgtgccaaggacgagccagaggtggagaagggccgtgggccggccccgtggacgagccagaggtggagaagggccgtgggccggccccgtggatgagccagaggtggagaagggccgtgggccggccccgtggacgagccagaggtggagaagggccgtgggctggccccatggtgcagagtgagccctggtgtcacggctcacgctttataaaagctctcaaggggtcacagtgcagaggggatggggaggagggtttggggagggtaagcacttcgccggggcacttatcatttgtggaacattctctgaggctggctgtggggatcccctgtgagtctggacagccaggtcataggtcatgcttcctcctggcccggttttcacaccgtggtaccccacacgcatgcacacgtgtgcacaccatcacacactcagactttacacacatgcacctgcacgtgcgcccctggcaacggcacccgacgcagtgaccttggggctgctgtcgtcgggaagacagcctgccaggtggcccctcacacggcccctgcttccccctcacacggcccccacttccccatcccggaaaacaggcagagcacacacttccaggaaagaggccgccctggcgctggactcaatgaccataaaacagcctcttaagctgggtgcagcggctcacgcctacaatcccagcactttgggaggctgaggtgggaggatcgtttgagcccaggagcttgagacagcctgggcgatgtagcaagaccccatctctacc

SEQ ID NO: 238209 - DNA, 266 bp, Homo sapiens
atgccaagaacagggtcaactgttccttcaggtagttacatgcttggtatagagctaactaacacatccaaggatctttaaagcaactgactcgacatccagtcaagaatacccacaagttgaaatgtgtctttcagtttactgtcccctttccatctttgtcagaaaacattaatgttgccatcccagacataatgaacttgggaagaatattttagaatttaaatcaaagtgtcaataataaagggctcataatcttagatgaa

SEQ ID NO: 238210 - DNA, 392 bp, Homo sapiens
ttttttttttttagtagagagaaggtttcaccatgttggccaggctggtcttgaactcttgacctcaggtgatctgcctgccttggccttccaaagtgctaggattacagatgttttgattccatagtttaattaattctgtgggcaatttatttcggcattccaatttgaacacacaagcccactatgaggcccattctctctctctctcacacacacacacacacacacacacacacacacacacactctgtccctgctctctctctctcatttgcttgctcatcaaaacatctgctctgtatctcactgaaatatctgtcttctgtttcattcctccaagtaaaatggtaacaacgcgttagaaagagttgcataggccagacatggtg

SEQ ID NO: 238211 - DNA, 1772 bp, Homo sapiens
  misc_feature (440)..(440): n is a, c, g, or t
  misc_feature (445)..(445): n is a, c, g, or t
  misc_feature (463)..(463): n is a, c, g, or t
  misc_feature (782)..(782): n is a, c, g, or t
  misc_feature (873)..(873): n is a, c, g, or t
  misc_feature (925)..(925): n is a, c, g, or t
  misc_feature (940)..(940): n is a, c, g, or t
  misc_feature (949)..(949): n is a, c, g, or t
  misc_feature (1073)..(1073): n is a, c, g, or t
  misc_feature (1075)..(1075): n is a, c, g, or t
  misc_feature (1077)..(1077): n is a, c, g, or t
  misc_feature (1122)..(1122): n is a, c, g, or t
  misc_feature (1381)..(1381): n is a, c, g, or t
  misc_feature (1490)..(1491): n is a, c, g, or t
aatttagaatgtcttacactgtacctattttttcctgtgtaagtctcaaaaacttgatttagacttgaaggttttatgaatgtccctacttttttgttttaagagggaggaagagggaaggagagggaggccatttgattgagaagggcataaatcgcagtggatgagttaccacaaagtcagtccatatgggttacaacagttcaatcaagaactaggccaggcacggtggctcacgcctgtaattccagcactttgggaggctgaggcgggtgtatcacctgaggtcaagagttggagaccagcctgaacaacatggtgaaaccccctttctacaaaattagctgcgcgtggtgctgcgtgcatgtagtctcagctacttggggggctgaggcaggagaatcgcttgagcctgggaggcagaggttgcaatgagccangatcntaccactgtactccagcntgggcaacaagagcaaaactccatcccaaaacaaaacaaaacaacaacaacaacaacaaagaactaaaacataatagcaaccaggaagcccccgggtaggctcgctccctggtaaccattgtcctgacctctattcccattttcttgttttggaactttgtacagatagattcactcagtatggattcttttatacctgacttcatttcctcaacattgtattgagatttgtccatgtcgcatgtagctgtagttcattcctttttcttttcttttttttttttttttgagatgaagtcttgctctgtggccaaggctngagtgcattggtgcaatcatggcttattgcagcctccacctcccaggctcaagcgatcttcccacctcagcgccgcgggtagctgggactncaggcatgtgccaccatcctcagctaaatttttttttttttttttttgtagngacagggttttgccntgttatccnggcaggtcttgaactcctggcctcaagtgatctacccatcgacgcctcccaaagtactgtattatagatgtgagctagtgtgcccagcccattttgacttctgtataatactatagcatgcatntntntacatttactcatgtgtcctacttttgatgagatttgtgttgctngtagtttggactattacaaattattatactgtcattatgccttttggtatatatgtattttcatttctctagggtatgcctcagagtggacttgtaggattgggttagactatgcatttttctaatcccaataacataattttttttgagaaggattctcactctgtcacccaggctggagtgcagtgacgtgatcttggctcactgcagcttctccctccacggttcaagtgattctcctgtctcagccacccaagtngctgggattacaggtgtgtgccaccatgccaggctaatttttttgcattttttatatagagatggggtctcatcatgttggccaggctgttcttgaacttctgacctcnngtggtcctcccgcctcacacctgtaatctcaactctttgggaggctgaggcaggcggatcatgaggtcaggaggtcgagaccatcctggctaacacggtaaaaccctgtctctactaaaaaatacaaaaaaattagctgggcgtgatggcgggctcctgtagtcacagctactctggaggctgaggcaggagaatggtgtgaacccgggaggtggagcttgcagtgagccgagtttgcgccactgcactccagcctgggcgacagagtgagactctgtctc

SEQ ID NO: 238212 - DNA, 618 bp, Homo sapiens
cagttgcccaggctagagtgcaatggcgctatcttggctcactgcaagctccgcctcccgggttcacgccattctccagcctcagcctctggagtagctgggactacaggcacccgccaccacgcccggctaatttttttgtgtgtgtatttttagtagagatggggtttcaccatgttagccaggatggtctcgatctcctgacctcgtaatccacttgcctcggcctcccaaagtgctgggattacaggcgtgagccaccgcgcccggcccatggggagcatttttaacagttgagtaatatcccacccccaaactgctgccagtttctctgtagcataaacagacattactgtgtgcagtttttttcaggttggcaacagtttccttcgacgggattcccagaagccagattagtaggtcaaaggctgaatatttttatggctcatgacaggctttgctaaatattactcagccgtcaacacccctccccttgaaggataggcttgcgggtttccctggggctcagccagtcctagaggtggacaccttccatctctgctctagatttttccacagagggagggccaagcacctttgaggcatgcagttttgtca

SEQ ID NO: 238213 - DNA, 279 bp, Homo sapiens
agtattagggatgaaggggcataatgtctgctacctactctcaaatgatgtgtgggtgtgtgtgtgtgtatacgtgtgtatgtgtgtgtgtagcaaaagagaagggggaatgagagagaataagaaagcaaatggcacaaattgttcacaaatggtgaaacgagatgaatatgagaatttttatactattcttgcaacttttctctaagtttaaacttatatcaaaataaacatttccaaaaatgattgaataaagttaaaatatattataagtccaaa

SEQ ID NO: 238214 - DNA, 841 bp, Homo sapiens
  misc_feature (282)..(282): n is a, c, g, or t
gcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgntctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaatatatctagccataactgaatgtcatgcaataaaacaaatgacttttgtgcata

SEQ ID NO: 238215 - DNA, 895 bp, Homo sapiens
  misc_feature (282)..(282): n is a, c, g, or t
gcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgntctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaatatatctagccataactgaatgtcatgcaataaaacaaatgacttttgtgcata

SEQ ID NO: 238216 - DNA, 275 bp, Homo sapiens
acgcacctgtaatcccagctactcaggaggctgaggcaggagaactgcttgaacacatgagggtggaggttgcagtgagctgagatcacaccactgcactccagcctgggtgacagagtgagactctgtctcaaaaacataagaagaataatgaatgaaagtccatgttatttagaaatataaacattactgtttttttcctaactgcaaacataaatatgctcattattaaaacttaaaatgcagattaaacaaatcaatacaccccatcatct

SEQ ID NO: 238217 - DNA, 691 bp, Homo sapiens
cggagccgagctcagaacgctggtgatgaaaagcaggtacactgacgtggtggtcttggacgtgcgcgacaggtcccgaccgagctccagctgctggcgcagcacggtgcacacgatccagcacacgaagggcacgaagcacagcgcgaacagcgtctcgttctccttcacgaagcggtaggcgcgctcggccctcctctcatcccggaagaacttgtagaaatacttcttcttgtccttgtcggagaagccgcgcacctcggcgcactgcggggaacacaggcggccctgcagcctcccgggggcggcggcgcgcgtggtcaccagcaggagggccgtgggcagcagcgccttgctcagcagcccgcctagcacccgcgcgccgctcgccgcctcgaaggggtctgtgcagggcgcggcctcggggccccccagcgccggcagctcgtccgcgccgtccaggatgaagagcagccgctgcggctgggccagcatctgcggcaccggcgcgccgcggtcggggcactggtccaggatcaggtcagccaggctgcgcgtgcccggcctctccagcagctcgccgcagggcatgaagaaggcgaagtccacctggccctggtacagcttgcccgccgcccagtcgtacaggatctttttggccgccatggtcttgccgatgcccgccgggccc

SEQ ID NO: 238218 - DNA, 176 bp, Homo sapiens
attgtattatgtggtgtgtctatacatttttctgggagctccatagcacttaattgctctgtgacccccacctacccccaaaaaagtaaacagtaacttctttgaaagtagcatatgtcaccatatcaactgtcaagtgttttgtgtttttgagtataatcctagacaaattttaa

SEQ ID NO: 238219 - DNA, 217 bp, Homo sapiens
gcatttttagtagagatgaggtatctccatgttggccaggctagtctcaaaactcctgacctcaagtgatccacctgtctcggcctcccaaagtgttgggattacaggcgtgagccaccatgccttgcctccctcatcttttaaaatcatttatgtgttggagtagaaaggttttatttgtgtaagtttattattcgaattgtagaaaccttatgtt

SEQ ID NO: 238220 - DNA, 487 bp, Homo sapiens
aaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaa

SEQ ID NO: 238221 - DNA, 498 bp, Homo sapiens
tctctagccttatcgggccagaaaatacggatgtccccgggcagaggttggagaggcgggggaagattaacgggcggcttattaaagagccatccgtcagctcctgcgcgcgggagatagcggcagagcaggcacgggacacgcccgcccgccctagccccggagcgccgagagccgcccgccgcctgggtgctctctgcacctgatcttcccagcctccctgggtcccggggcgagggcggtggcagtttgcagtcagagcagagtggccgctttggggaactactcccttccctgcttggccgcgccgcgccctccctgcatttctggggctctgtcctctagaccctgggactcggcgtttagggaggaacaggcgctccattcctagacccagccattttccaccgaaagcccagccctgccgccgggcggcctgggagtttggccttctccccagcgcaggacgcccgtggggcaaggccagggctgcatccc

SEQ ID NO: 238222 - DNA, 540 bp, Homo sapiens
aatacctaacctagcttagaaagcactctatatagtccgctcccctaccttctcagtctcttctcttgacacttgccctttctctactctgtgtgcaagtcaatcttgacttcttcatgttgcttgaatgctatgctctttccagcctcaggctattgcacatgctgtttcctcaacctggaatatgctgcgctcacatcagcattctgtggctgttcatttttcaggtcttagtttaaatgtcagtttttcagagaagttttcccagactcccagatatccacccctcagccccaacgtgtttagaacccttttgctatatatttcaagatttccctataccttctatttgataacacttaacattgttgtaagtccttgtttcatgtctttcttccctgctagactgcaatctccatgagggtaagtaccatgtcttttctttttccctcttattctctagcccatatttggctcatataggtgctctataaatgtttgttgactcaaaattgagtgattaaaatgtttgacattaaa

SEQ ID NO: 238223 - DNA, 1120 bp, Homo sapiens
caggccctgggctgacatgtgcccccttgcaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaacacactgtttaaatg

SEQ ID NO: 238224 - DNA, 242 bp, Homo sapiens
caggccctgggctgacatgtgcccccttgcaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccc

SEQ ID NO: 238225 - DNA, 1758 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacaccccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccc

SEQ ID NO: 238226 - DNA, 2636 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacaccccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaacacactgtttaaatg

SEQ ID NO: 238227 - DNA, 3585 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacaccccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggcgcctcagggaccctcctccacccagagggtctctgtcttcccggttttcctggcgtaattcagacttggggagagaagaatcatcatccatcacacacccagacccaaagagactcaaagccaggaggagccgggtggacccagaggccctcaccctgccagcctaaggggcatggcccaaggtctccacccccagcccccagagcacagctgtgtgcaggtcaccagaagccccaaataatgacagcagcccagacagtcgctaccgggccctggtgcagtgtgaagcctctggcacctgcctgggctcattccaggggccatgagagggtcctgttatggctgcaccatcacacccaccgggcagctggggcccagctctgccatggatcccagccaggcagcagccgccctgtgggctggagaagcttccgctcctgctgcacaactgcgaaggggcctggagggccgggagcttgtgacggtgacaattccgcctggcgcctcctcctccggggcagccgagcaaccctggacatgagggggcttcgtcccacccccaggagaaaatgcccagtcctccgagagtccagtgagggcttgcagccagggaccaagacccagtatggcctaaaccaggcctggtcaccaggggtcaggcgggaccttatacagggctcagcagagagacctgcccgctaccctgctccaggggagatgggggtgggggccttcatcccactcgggcatgacagaggagagcagccagccagcatctgcacgtctcaaggcagggaaaggcctgaagccctgggaagcgaagctccgccctcaggaaacaggtcccggcctggctccctcacagcctcggactgccccgtggaccgaaacccccaggcaccttgcgccaggactggcctgatggtggagacgccacaccatgagcagtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaacacactgtttaaatg

SEQ ID NO: 238228 - DNA, 2707 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacaccccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggcgcctcagggaccctcctccacccagagggtctctgtcttcccggttttcctggcgtaattcagacttggggagagaagaatcatcatccatcacacacccagacccaaagagactcaaagccaggaggagccgggtggacccagaggccctcaccctgccagcctaaggggcatggcccaaggtctccacccccagcccccagagcacagctgtgtgcaggtcaccagaagccccaaataatgacagcagcccagacagtcgctaccgggccctggtgcagtgtgaagcctctggcacctgcctgggctcattccaggggccatgagagggtcctgttatggctgcaccatcacacccaccgggcagctggggcccagctctgccatggatcccagccaggcagcagccgccctgtgggctggagaagcttccgctcctgctgcacaactgcgaaggggcctggagggccgggagcttgtgacggtgacaattccgcctggcgcctcctcctccggggcagccgagcaaccctggacatgagggggcttcgtcccacccccaggagaaaatgcccagtcctccgagagtccagtgagggcttgcagccagggaccaagacccagtatggcctaaaccaggcctggtcaccaggggtcaggcgggaccttatacagggctcagcagagagacctgcccgctaccctgctccaggggagatgggggtgggggccttcatcccactcgggcatgacagaggagagcagccagccagcatctgcacgtctcaaggcagggaaaggcctgaagccctgggaagcgaagctccgccctcaggaaacaggtcccggcctggctccctcacagcctcggactgccccgtggaccgaaacccccaggcaccttgcgccaggactggcctgatggtggagacgccacaccatgagcagtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccc

SEQ ID NO: 238229 - DNA, 1666 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacaccccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgaacacaccacggtgcatgaacacgagcagggagaccaaggcggtggcgcagaacaaagcaggattgaccgggctgagtggcccgtaagtggaccacaggcgagggtgacgtggcaggtgcgcaggcgggacgggctaccagcagcaaaagacgcggtggccaaacggagggcacacccaagtccaaagaggacggagagactaggccggcatcatggcgcaggg

SEQ ID NO: 238230 - DNA, 310 bp, Homo sapiens
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtactgtgagtgccgggcgggcccgggacatccgccagtgtcacctccgcgcaccacgacccccgccctccctcgagactcctccgcgcggtctcgcggccgc

SEQ ID NO: 238231 - DNA, 3033 bp, Homo sapiens
  misc_feature (738)..(738): n is a, c, g, or t
  misc_feature (1337)..(1337): n is a, c, g, or t
  misc_feature (1692)..(1692): n is a, c, g, or t
  misc_feature (2062)..(2062): n is a, c, g, or t
  misc_feature (2339)..(2339): n is a, c, g, or t
  misc_feature (2386)..(2386): n is a, c, g, or t
  misc_feature (2535)..(2535): n is a, c, g, or t
  misc_feature (2543)..(2543): n is a, c, g, or t
  misc_feature (2549)..(2549): n is a, c, g, or t
aaatgtgccctgctctctcccctcttaaaaatagcagcaacccatctttgcaaagaagcttgcctatagagctggcactctgtgaatggactgtgcttttacgaccctacagggtatcaagatactgtgcagctcgccaacaaggattaattgcaaggactggtagatcgaatttactgaagacttggagctcgcttctgagaacaaacgcaaaaggacagtaaactgtggaccttgaagttagcagggtttcactcttgttgcccaagctggagtgcaatggtaaaatctcggctcaccacagcctccgcctcccgggttcaagcagttctcctgcctcagcctcctgagtagctgggattacaggcatgtgccaccacgcccagctaattttgtatttttaggagagatggtgtttctccatgttggtcacgctggtctcaaactcccgacctcaggtgattcactcaccttggtctcccaaagcgctgggattacaggcatgagccaccgctatgccgtctttgttttaagatctttgcctccctttctgcccaaatgtgtagattcaatctgctccaccccctttcctttcttctctggtgatttgtaaaatgcccatccatgagtcatggtcccctgcactctgtgaattttcaggcttcttttaaatagattctaccctactagatatatccacattttactatcactttacaccattatttagattcttgnataacagcacctgcacttacacacacacacacacacacacacacacacacacacgtgctccttcctctgatcctagacatccaccctgggaaattagatgctctattactcaaaagctcttaagaccacaaagttactcttcaaagttgcccaattaggagaggaaaagagcaaaaaatgaagaaagcaactcactgctactaatgagctatgagcttactgtctaaatgggtgtgacagacatgtaagcaaaaagagtaattacagcaataacagaaaaacagagagccaaatcatgagtgaactcccattcacaattgcttcaaagagaataaaatacctaggaatccaacttacaagggatgtgaaggacctcttcaaggagaactacaaaccgctgctcaatgaaataaaagaggatacaaacaaatggaagaacattccatgctcatgggtaggaagaatcaagatcgtgaaaatggccatactgcccaaggtaatttatagattcaatgccatccccatgaagctaccaatgactttcttcacagaattggaaacaactactttaaagttcatatggaaccaaaaaagagccngcattgccaagtcaatcctaagccaaaaggagaaagctggaggcatcacgctacccaacttcaaactatactacaaggctatagtaaccaaaacaacatggtactggtagcaaaacagagatatagaccaatggaacagaacagagccctcagaaataatgccacatatctacaactatctgatctttcacaaacctgacaaaaaacaagcaatggggaaaggattccctatttaataaatggtgctgggaaaactggctagccatatgcagaaagctgaaactggatcccttccttacaccttatacaaaaattaattcaagatggattaaagacttaaatattagacctaaanccataaaaaccctagaagaaaacataggcaataccattcaggacataggcatgggcaagtacttcatgtctaaaacaccaaaagcaatggcaacaaaagccgaaattgacaaatgggatctaattaaactaaagagcttctgcacagcaaaagaaactaccatcagagtgaataggcaacctatagaatgggagaaaatttttgcaatctactcatctgacaaagggccaatatccagaatctacaatgaactcaaacaaatgtacaagaaaaaaacaaccccatcaaaaagtgggcgaaggatatgaacagacacttctcaaaagaagacatttatgcagccaacagacacatgaaaaaatgctcatcntcactggccatcagagaaatgcaaatcaaaaccacaatgagataccatctcacaccacttagaatggcaatcattaaaaagtaaggaaacaacagatgctggagaggatgtggagaaataggaacacttttacactgttggtgggtttgtaaagcagtccaaccattgtggaagtctgtggcgattcctcagggatctaaaactagaaataccatttgacctagccatcccattactgggtatatacccaaaggattataaatcatgctgctataangacacatgcacacatatgtttattgtggcactattcacaatagcaangacttggaaccaacccaaatgtccaacaatgatagactggattaagaaaatgtggcacatatacaccatggaatactatgcagccataaaaaatgatgagttcatgtcttttgtagggacagggatgaagccggaaaccatcattctcngcaaactnacgcanggacagaaaaccaaacactgcatgttctcactcataggtgggaattgaacgatgagaacacatggacacaggaaggggaatatcacacactggggcctgttgtggggtggggggaggggggagggatagcattaagagatatacctaatgttaaatgacgagttaatgggtgcagcacaccaacatggcacatgtatacatatgtaacaaacctgcacgttgtgtacatgtaccctaaaacttaaagtataataaaaaaaaagaaaattaaacaactttaaaaaaagagtaattacagcactgtaataaatgaaccatgcacatgggagtattcatagagaatgataacttcaacctaaatcttgaagtataagtataaatttgccaggttcacctcttgattatttaagtgtgaaagaggatgcatagatcaccttcaagtagctaaggcataatgagataaggatgctgaactaagttggtt

SEQ ID NO: 238232 - DNA, 292 bp, Homo sapiens
acccgcctcgacctccccaagtgctgggattacaggtgtgagccaccacgcccagccaggacccattcatttttaaccaccttgctttatctgttcaaaagagaaacaaattcagcatgtgtaaataactctgaccaccctcaataggaagcagacagggccttgagtatttctctcatctcctgactcagaatcgcagcgtgtgtgtctctcttcaccataccgcacgggtcctgctcgctgacccagcccgcctgctgtccaggccaatggttggtgggtaccgagctcg

SEQ ID NO: 238233 - DNA, 591 bp, Homo sapiens
agtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggagaaaaaagatacgttaaatacagtaacaaagaatcgcagcgtgtgtgtctctcttcaccataccgcacgggtcctgctcgctgacccagcccgcctgctgtccagggcttcctctgtctctgctctgggacctccccatggccacgcattccgccgcatggtctggatccctcgcggtgtctgggttcagccatgctcagcctctgtgtcggtcaccagcctagaaaccctggagcaccccgggccggaacccttccctcagatctgtcgtgagttccctttcagagatcaagcccagcctggctcagtcttgcaccccttgggatccacg

SEQ ID NO: 238234 - DNA, 482 bp, Homo sapiens
agtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggagaaaaaagatacgttaaatacagtaacaaaggtaagaattccagcctgggcaatatggcaagacctcgtctctacaaaaaatacaaaattttttttttgtattttttgtattgcccagtgtggtgacacgagcctgtagtcctgtgggcggagaattacccaggtgccgaggcaagagaccgaaggcacaaactatttcagtataataaaatcgttacaata

SEQ ID NO: 238235 - DNA, 458 bp, Homo sapiens
gctgagattgcaaggccttcagaaaaggccccagcttttcagattagtgtgatgtaaaatgttttattaaagagatttttttcttagaacttagcattgctgggtgcagtggctccctgctgtaatcccagcactttgggaggctgagatgggagtatcccttgagcccaggagctcaaggctgcagcaagctatgatcgtaccaccgcactctagcctgtgcaacagaccgagatcctgtctcacaaaaaaaaaaaaaacaaacaaaaaaaacaaaccttagcattatgtaacatctgaatctaatagaagcaacaaaaactatgtaagagaagtttcaatagaatgtggaataggatttcatgatatggctggattgattttaagaaaatccaaaaggactttagacttcctagaagagatcttagaagtttagcagccataaaatctctttcctt

SEQ ID NO: 238236 - DNA, 1389 bp, Homo sapiens
  misc_feature (364)..(364): n is a, c, g, or t
tttatcttatgctctctcaaggagggggaatgctgcaggcctctaatagggtcatctttctatagctagagactcgtgggtataaagaagctgttcccagaattcagctagccatcttaatcccttccttctggcactagtgaagtacttttcattaggttggcatggtatgatctgagactcagttttaaactttggggcaaaaataggtgaattaggtttccttcacttcagaggttcttgtcctttgaccctgtaccccaaacctcaaaaggaggcaagaatcctctgtgtggtccagccaacatcaccatggctctgcattgaggttagggcataactctatcttatcaaaactgaggantactttccttgacttgactggccaatgtcaatccaaattctcttgtccagcactttgcaagaaggatgattgattcatagatggtttctgagttccttagctaaaacaacctcttaatacactcctagtcacaccatcatgaagaaaatgtgtttgctaagctaacgaagacaagatgagcattgattctttgagggggtaccatttatgtttttcccacactgtatcttcactgccttatacatagtaattgctcaatatttgtttactgaaataatgaatataaaactgaccagtaaaatctctaattaccctgttcccatgttggtgatgataatgtgaggctgtgacagatgctttgcagtgcctgataagtaccctacgcatttccccaaacagccacagctaccagcactgacccacttctggctggtaggaatttgaggaattggattctatagcccaaagaattaacaggacaggtgttcatatttaagcctgaatattttttaagtatttcaagaagtcttactcaatagttacttggacatctggaagaggcagcattttaaatcacttctttatatgcattatgcatattgtacatatgaagtttgaaataactgtttgtattctatatacaaatggttatatttataaaccaaagacatctcagctatatctcagttgcatattgaaataattgagtgggaacatcttaaattaacgtatttggggtttgtgtgtgtgtgtgtgtgtgtgtgtgtgtgtgtgtgtgtgacattcacatttagaattgtgtgcagtgtgctgaggagttcaaaaccagcctggccaagatggtgaaaccccgtctctactaaaaatacaaaaaaattagctgggcacggtggcaggcgcctgtaatcccagctactcaggaggctgaggcaggaaaatcacttgaacccaggctgcagaggttacagtgagccgagatcatgccactgcactccagcccaggcgacagagtgagactctgtctc

SEQ ID NO: 238237 - DNA, 355 bp, Homo sapiens
ggctggctccgcctgctctaggctgtgtctctaaaggtggccccacccctgccttgcactaagtctttactcaagaaaatgcaatgctaccaaaccacaaaatgtgcattgtcccaacccagcttgcaccaaattgttttcaggaattctctagtgaccccttctgtaatttccatttccacataaaccccaggccctttttgttcccccttcttcacttccccagcatccctttttgttctctctctgttctcccttcagaagcctcagtcccctttaattggggctgagttctgtctgacctggaatctcccccaaagcaggagtctgaataaaacctgtcttgccacctttc

SEQ ID NO: 238238 - DNA, 474 bp, Homo sapiens
ctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgtgaggttgcagtgagctgagattgggccactgtactctagcctgggtgacagattgagactccaatctttagaaaaaaaatatataaaa

SEQ ID NO: 238239 - DNA, 277 bp, Homo sapiens
ctcaagatcacacagccaaacagtggcagtcccagagccacaacgcatgtggaggggatttttctcttgtctcctgaagctatagaggatccttcctggaagcagggcgtctctctggcactaggctcatccctgcctcagagcctttgcacctgctgctccctctgtctggacaccctgccagctcccccatggccagctcctctcatccttcaggttttggttcaaacaccccctcttcagaaaggctttccaggactccttcattttccagcca

SEQ ID NO: 238240 - DNA, 116 bp, Homo sapiens
caaataacgaagggaattatatactaatctttgagaagtggaaagtagtattgcccatgatggacaaaataagaaataagctaaaaattagaaagattgtaattgatagagaaacc

SEQ ID NO: 238241 - DNA, 338 bp, Homo sapiens
agcaggtaagccccggccccgcgccccacgcccgctcgccctgccttggccttacacgcccggacacgggggcggaggggagtcacctgctccgagtccctctttatcctgaaacatttggtcgggtgtgcagcttgtcaagggtgacttttccagcaccccattccctccctccctcccctcaattattcagcagacttttccagccctctctggaaaatgttaaaaagactggatggtgtgaagcttcacctatggaagggtttttagtgcacggcagtattatgtaatttgcgattatgtaaacctcagctctaattaaaatgtagtttctagta

SEQ ID NO: 238242 - DNA, 1527 bp, Homo sapiens
aagaaaagagcagatatggttgagcactaaaaccctctactgtgggtagtgaacctaggtggacacagttgctcaccgggacacttaaaccagctttgcggggctgtcggggttgggaagcacagtctggaaagatttcccaatggaggaagcaccaattgtgggtccctgaagctgaggggatgatgcccaggcaaggccgaggcagtctgcagagggctggggaggtgggaaagacgattttgctcagaggaggcagagatggggtggtggctgagagagatgcagggtcaaggaaaggatggcttcagagaggagagatttgctggggcaaaaggccacaggatggggaggctgcggggtccaagaggacagctgatggagcgagaccctgcaggcaaggaggagatggggtgactcatggcagaatcgcaccagagttcccacagccctgtgcggccactatgactagtcccatcctgtacatggagaaaacgaggctccttccagttgtccctcacgcctcccttgatttatgtactacctgatgtgtataaggacaggtggtgacaaacacatggtccctacccttcaaggacatataatccagagctaagacaagaccttaacacagggcaaagtactatgctctgagttcatttgatgagcgatgggagaacgggcttgatcctagccatgcgggagagactggaattcaagagagtcaaatgtgctgggaaagactttctgggcaaaaggaataagcaaaggtgtgcaaaggtaaggaagcaggaaacctttgcacatcttgagaactcgccggccagaggcctgtgaaggagcgcagtggtcaggcaggagaggcagtcggatgcaggctgagaccatcctggagggtcttgaggctggcttaccccaggctgtgagtagtgggctcagcctagtcccggctcctgggttagtgctcacgtgtctctctgccccctcagggcctggaggaatggccttagagcccccaccaaccacgctcaggaaggcattcctagctcagagtaccctcctggagtctacactggaaggggctcctgagtgggccgcgccacgccccgaggagcagaggcgcagtcctcccgcgtgctcccagcacactccacccctacccagcacacccacggggcccccaccttgctcacctggggggaaccacccactctgcgccctctcagggagaggtggtggccgctgctctatcccctccctctcttcctcttccaccttctctctcttctcatctgggtgctggaacccaagggtgaaactgagagtcagaaagtctcagtctcaaggcagagcggggcaactaatttaaaacggcttctactccggcccccagtgtgactaatctccttctcttcgctccacaggtctataaatgggccacagtaggcacccctttttaaatctgtaaaatccccaaatccattaaaagtgacttcagaggtcccagatagggaccaacatttgttt

SEQ ID NO: 238243 - DNA, 505 bp, Homo sapiens
ataacataaaaacataagtggattgaaggtaagggacagaaatagttatattctgaactattaaaagaaagctggggcagagatgttagtatcagataaaatagacgtccgaacaaggaatattaccagagatgaatagatacattatatgatcctgaaagtgccattctggccaggcacggtggctcacacctgtaatcccaaagtgtttggatgacaggcgtgagccaccactcctggccagaatacacacttttgtacaaatgcacatggagcattcaccaagatagaccatattccaggccataaaacagatctcaacaaattttaaaaagtgaagttatgtgaaatatgtggccacaacagaattaagccagaaattaatagtatgtctcttcaaatatttggaagttaaagaacatattttaaaatgactcatagatcaaaaaacacaaatacttctccccctcttcttctactctctctctccttcttaaaacaaaaa

SEQ ID NO: 238244 - DNA, 1684 bp, Homo sapiens
ttgtaatggatgaagaggcatgactcagtagatggttgatttgggaataaccacatccagtctagaagggagctgaccctcagaatttctagctatgggatagacagacctgcctaactaagagacagtttactgatagactgtggtaaattctgtatggagatatacagacaacagaaggagaacataattcctggttgggtggggaggggagggtgtgcttgtggttctcagccctggatgtgtttcggaatcacctggagataaacatatagaacctgggctccatgcctaagattctgattttcagttctgggagtataacagggccatcagaattctcttttttttttgagacagggtttcactgtcgcccaggctagagtgtagtggtggcaattatggctcattgcagcctcgacctcctgggctccagggatcctcccacctcagcctataactgggactacaggcatgcaccaccatatctggctgattttagtttttgtggagctcggatatctctgtgttgcccagaaggtggccatcagaattaacaagcttaccaggtgatcaggacctgaagccaagcactaaacataataataacagcacatactataaactggacatcttaggtattttctcttattctcataaccatccctaaatgcaatttatattatccccattttacaggcaggaacactgaggtttaagtaatttggccaaggtcacacagcacagcccatattttaattaagctctcagtctaaaggcctaagttattttgccatatcccatacagcaggaggtcagcctggaagaatcttcccagaaatttaaattaagataattaactcagatgtaaactgtaaaatctgtacataatgggtcagacaaagatatgcaagcggatttaaagagacacaaaggctccgagctagtgaaagttcgaccttaaccctacggcatcgattaacatatcaaaaggaagaatgtgtcctttggggtgggagggcgcttgggccagttagtctgatactttgtgagctgagggagggttcctggccctggcagcattgtgatctggtattaactctttcccgtggcttctggtttctcctgaccttcctggctgttctgtttccttccgtttctccacctaccccttaaatgtggatgttccttgcattccactctccccgtattcccaggatgactgcatccacttcggggcacagctgcctgtgctaaggacttccagaggcgtgcactcctgaggtcctgactcaaggcatcaaggcaatccaggggagtgggagaggtgttctcagacaggactggagttcacatcctagctgggcgtcttactggctatgggtcttagaagttacctattattgctgggtgtggtggctcacgcttgtaatcccagcactttgggaggccggggcaggcggatcacgaggtcaggagttcgagaccagcctgaccaacatggtgaaaccccgtctctactaaaaatacaaaaattagccaggcgtgatggtgggtgtttgtaatcccagctactcgggatgctgagacaggagaattgcttgaacccaggaggcggaagttgcagtgagctgagattgtgccactgcacgccagcctgggcaacaaagagcgaaactctgtc

SEQ ID NO: 238245 - DNA, 385 bp, Homo sapiens
gaggctagttgattgaattatgtttacacaatggagcactgagctgtctataaaagggaatatttttgtgtacttctgtggagttattttcaggatatgttgttaagtgaataaaggaacagaagaatgttaatagaatgctaccttttgtatgatacaaagaaatatgaatgatcatatttgtttatatttttaaaagagaatgatgaatggacaaagtgaaaactaatgaaaatggttaattttaggagaggggagagaaaaatgtggagaaacagatatggaaacaagatatctaggattataccttgattatacttagatttgactttggactcatcttgctgtttacatactaaatgtaaaacaaaaaacaaaaaacaga

SEQ ID NO: 238246 - DNA, 472 bp, Homo sapiens
agaggaggggtctttctcaggggtggcagaggcagaagaaaatttgtgtataagtggacttgtacattttaaacccatgttgttcaagggtcacctgtatttaaaattccacattcaaataaatttgacccttgtgtatattattaataatatacataattcttagaataataaatgaatgttagattgtaaaatcattggcctagaggagttgcctaaagattgaaataaaccagcttcttggcttctttattttttaaatgaggggcagacacaaagtaaatttccaagtcaccttgaaatcaggcactttgaagcctagctatgagtaaactcagttatactgtctaatacccattttagcttttctgtttacagcataaactttaaggccggttttagttcttttaagaagtcaaaagcagaacctctctagcagaagtgtttttcaaacattaaatcctaaaccaaa

SEQ ID NO: 238247 - DNA, 465 bp, Homo sapiens
actcttaatagctatttaaatgcttcctatatactaggcactctctgttaggtactttatatatgttatcttggttaatctacacaaagcttatgaagacagttcattttacctgtgtattagttttgtattgctgctgtaaaataaaatgaaacaaacaaacaaaaaacaaaagatctggccgggcgcggtggctaacgcctgtaatcccagcactttgggaggccaaggcgggcagatcacgaggtcaggagatggagaccagcctgaccaacatggtgaaaccctgtctcaactaaaaatacaaaaattagcagggcatggtggcgtgcacctgtaatcccagctactcaggaggctgagacaggagaatcgcttgaacctggaaggtggaggttgcagtgagctgagatcacgccactgcacttcagccagggcaacagtgtgagactctgtctccaaaaa

SEQ ID NO: 238248 - DNA, 317 bp, Homo sapiens
actattatgagaatagcacggaaaacaccagcccccgtgattcaattacctccccatgggtccctcccacaaggggaattctgggagatgcaattcaagttgagatttggatggggacactgtcaaatcacaccaggtggctttgcagggctatttcaaaatatgccaaagatatttatttttgggtaaaatattttaatgtctctcagggtctgctatttgtcatatgatgttggaccagtgtcagtttgaaatgtgatattttattgccacaaaaagtctgttttgtgatctctgtttcaacgttaaaaaaaaaa

SEQ ID NO: 238249 - DNA, 452 bp, Homo sapiens
tctcagctcactgcagcctctgcctcccaggttcaagcgattctcatgcctcagcctcccaaatatctggaattacaggtgtgtgccaccacacccaactaatttttgtgtttttagtagagacagggtttcagcatcttggccagactggtctcgaactccttgcctcaagtgatccgcccacctcagcctcccaggtacagtcgtgagccaccgtacctggccctaggttatgactcttaaagattcttcaggagcagtatttaaattacttcacacagagattttctactgaccaacataacttccaagattcacaaattgctttatttgctattcctcccctagagtaatctggttgttctggaataaatatggtagagaacaaacataaataagaatgtttccaactgaaaatttttgtttacttcccccttcaatttctagagctc

SEQ ID NO: 238250 - DNA, 355 bp, Homo sapiens
ctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaa

SEQ ID NO: 238251 - DNA, 383 bp, Homo sapiens
cattctcgcttgtacctgttaactaaataccttaatggcagcaaggtcatcagaattacctgggcagattccttaaaatacacattcctggaccttacccctggatattctaattcagtgcagtataaaaagtgtgattcagcaagacttgagaacctctttgtttatggaatttttggtttgagttctttttttttttctttttttttgagatggagtctcactctgtcgcccaggctggagtgcagtggtgcaatctcagctcactgcaagctctgcctcctgggttcacgccattctcctgcctcagcctcctgagtagctgggactacaggcacccaccaccatgcccggctaattttttgtatttttagtagagatag

SEQ ID NO: 238252 - DNA, 1083 bp, Homo sapiens
attcctagaggatcccggtattgagtggccatgtgaacacacagtgagaaggcagctgcattcaagctaagaagacagtgctcactagggctcctcaccaaatttgccagcaccttgatctgggatttctagcctccagaactgtgagaaaataaatttctgttgttcaagccacccagtctatggtattttgttatggcagccctagcttactaaggaacaactactgatataatcataaactagctgcaatcgtcagttagcttcagactttgtaacgtagccagtggagtgatcttaaattccatgtaatttgtaactcaagtaaccatgtaacttgaggtcgccctgcctcagacctgggtaaacttggcttaaacctccagtttcacagcatatgaaagaccattgccttctatttaatttattcaaatttctaaacttagtttttcatgatccctgtggattcattcctgcaaccctaagtgttgtatcagttccactcatctgccagctggtacatggaatatcaggagcttcaccattgtccataagaaattaaattaaattcatgattttgtgactgttccaactttaattaagtctccaggagttgcggaaggaaattatatcccacaccgcgcagtcttctgcctcctaattggtttccctttgacactgcattggcttccaaaacttactgtgtgatcatcctcacaaccctcaaagaaactctagcatcccttccccttactaagcctaattcacttcctcagccctttacacagaaatctaaccatgtcgcttccttgtgtgaatgaaagcgataatgccatctcctaactgccaatatgcagtgacttgactctggtttagcaattccaggaccgctgaagttttcttcctctagcctccaacatatatcacccacaaatgatacccataaagcaccttccccctaatgggcatggcagctactctgtcctggacctagatgcctggcccagtgatgtcaatgctatacttttgccttcttcctcactgctctttaaggaccagcccctcccctctctcaggccaccc

SEQ ID NO: 238253 - DNA, 181 bp, Homo sapiens
ccgtcccctccaccctcattcccatttgtgtgagaatgtagactgtgccttggcatttcagggacacaaatggtccatggcagagaccagtaatgccagatatgactataaagtaaagaaaggtacctgaagccactgatttatatccacagttactttaaattaaacacagacctttgca

SEQ ID NO: 238254 - DNA, 428 bp, Homo sapiens
ctgcaacatgcttaagccaacagccaggctcattcccaccctcttatgaataatcacataagctttccataaatgagatttcctaatgtcagaggggactgtcttattctcaaggaacccagtttgacctggcttgcagagtgtcctttcgctttgcaataaatgtctttgcctgcttttactttggactcactctcaaattctttcatgtgggtcaagaacatgaagcagcccactgacagcagcaccatctacaacacagagcccttcacactttgggcagaatgcaggatttctccacctttgtatcttggcctgagacaataaatggggctcatacctgggagcaaagaaaaaaagagaagtggcaggaggcttttgggttggaagaggacaggaccctcttaaatctggaaggggcaaaacca

SEQ ID NO: 238255 - DNA, 598 bp, Homo sapiens
tgtggtcctgtctccattctattaaaacaacattgtagagattagcactgagtctttccagccatgtgcatctgttcatttccatctccagcttgagtttttctgtgtattacaaaataagaaaacaaaaatgacacaataatctattttgtctggttttgctctttattagtagaaatagacaagtgaggagttggaggaagaaattgcttctgatctgttttagatacaggtgaaactctccctccctccccgccctacccagtctttctctgtctccctccctgagcctattcttgcttcttccctttacaaataattaactgctcaggtcatgttgaaccaaaaaatagcgtctgtagcccctgtgtgcttactttaagtatatgttactgaaaaatgcggagtgagcacttaacaactcattctcctgggaaacacagtgctactataccccaaatgcttttctttatcattttaatttttatcttctttacttacatttccaacatcagttaagagggtcttgtagttttctaactgaaaggagactgtaaaatctccttgctcgtattatatctggtttatttcaaagtca

SEQ ID NO: 238256 - DNA, 477 bp, Homo sapiens
aagaaaactatcatctaagactcccttggccagtaactttcttttatgcaaagagaaaaggtcaatttacaactaaacctaaatgaaatggaattcaaatggtcagggtcaaatcctggggggaggcactgaggaaaggacagctgtctgggggtcggtggcagggactgaagctgagcagcaccaggcggtggcagggattgaagctctgcagtgccagtcaaggcagggatcgaagctctgtggcaccagttgatggcagggtctaagctttgcagcgctaggcggtggcagggatctaagctctgcagtgcagtcggcggcagagattgaagctctgtggcaccagttgatggcaggggtctaagctttgcagtgccagttaatggcagggatctaagctctgtggtgccagtcggtggcaggatctaagctctgcagtgcccatggcccattggttcatcctggccgagcctc

SEQ ID NO: 238257 - DNA, 393 bp, Homo sapiens
ttttccttaaaaacctggtgaaatgaggaagaaaaaaacaatataaataattataggctgaaaatgctaagttttgtaattgaagaacagaagtcatctgggtggagactgaaagcactaaagcattacttctgtccagggagatggggcatgtgtcgtgggaggagggattggagctaaccttggaaaaattgaggtgcatgctaaagtgtgtagacgtgaaaatagatgagtctcggatttccttaagatgtttcaaaaagggaaaagagaacaagaaaaaagttactgagccaaatgtatgacatagtccttcttgactcgaggtgagctgtacatggatgtttactttttcattccaactttcatagatgttggaaaattttcaaatta

SEQ ID NO: 238258 - DNA, 366 bp, Homo sapiens
cttagctttctccccgagccacattcttaagactagtgaaggtcattgtgagatccagcatctgtctatcttcatttcagatgaatggctgagaagacagtgggtggaggaggctggaacagcagcacagttggcctccgtccacagctgtagcctgatctccttctgggattcctatacgcagcggaccctgtctccaaatatcatggtcctctgctcccaaaatgctgttatgcagtattcacctggttcttatacagacttcagtgtaaattttaacaataatagctatgatagcatgttatttaagccaaaatattatgcagaaataaatattgaaaaaaaattgatctgaaaattaaattt

SEQ ID NO: 238259 - DNA, 379 bp, Homo sapiens
ctcagcatgtctgagggcctgtgaggggctggaaatgaccagtctgggtgaggcacatccccctcctcttctacaagccaacagtgtcctgctgacccccacagctgcttggggggaagcagctgcataatgaatatagaagcaagaagcagacgagctgtccaggggaagtcacagtggcacaggaagggacaatctgcctgcagatgctggccaggcctgctcccaggaggcactgaaccaaagtcacctggagaagccaggcaccagcacagacacctcctggccaggccaatgcaggtcccacatctgatgactccatcgagctcccttcagcaactcctgctggcaccatgccagccctagccttgggagcagg

SEQ ID NO: 238260 - DNA, 358 bp, Homo sapiens
aagctttctcagtgccaggtgctatccatttagtcaagtatctgacctctgtggattaaagtggagtgcttatatggggaaaagggtatatgtgattcttgtaactacacctatttatacctccaaccctctgctggcagcctgagttttgggacaagggaaattggtaatgtaggttttttaataacgtcaaatataacagcattggagccatctctgcaagatggagagacttgaccagccttgactagctcccaggtatgggtgcctctgtggtgaatggtattgatgactatgatgcctttgttgacaaataagctaaaataaattgaatgtgtgccaattccatggcctgtag

SEQ ID NO: 238261 - DNA, 282 bp, Homo sapiens
taaagagacagggaccccactgtcacgaggctgtagtacagtggcacaatcatagctcattgcagcctcaatctcctgggctccagtgatcctcccgcctcagcctcccaaagcactgggatttcaggcatgacccaccggacctggctacaaagttcaaaggagtaccaaaaagctcagcaatggtaggccaggtgcagtggctcacccggcactttgggaggcccaggaaggaggatcacttgaggccaggagctggagaccagcctgggcaacataggg

SEQ ID NO: 238262 - DNA, 303 bp, Homo sapiens
ctgtgcacgccctgggaagcccgggcctgtaacataaaacacgccctcagcacggctcactcaccgaccccctggcacatctgcatcagcatgcctattatgggagtgttttgaggaagtagccaaagctttagtggaaaaccacccaggaaagcttcaccagagagtccttctccactacagcaatgcccctgctcactcctcatcaaacaagggcaattttgcaagcgtttccatgacaaattattaggcactcaccttatagtcctgatatggctccttctgacttctttttgtttccta

SEQ ID NO: 238263 - DNA, 250 bp, Homo sapiens
ccgcaaaactgtgagagaataaattcctgttgtctaaagccacccagtctgtggcattttgtcatggcagccctagcgaactaatgtaccagctacgaactccttgaggacagagctgtggtgtcttcatctgtgcacccccagctgtccacagggttctggctcatactcatactcagtaagcaagggtctaattgagttgcattccacttgcaacagggagggtaatgatggaagaagcaccttgtgg

SEQ ID NO: 238264 - DNA, 335 bp, Homo sapiens
cttcaaaacagaagggcaaatggaaaagggggatataaaacaaaccaataaaaataccatctgagggtgttactgtccaaaattaaagaataagatgcatcactaagccctttgcactcgtgttgacctcgtaagtaaaaattattacttagaataataataagtggtgcacactacattccctgtccctcttctagacttttttttttgtagaagaatcagaaaacaatttactaacctccctgtttgatattaaaaactcaataggaaggtttttaatattttctgtcagtacaagttgaacttgattgtgtcaactgaaaccctagaggttt

SEQ ID NO: 238265 - DNA, 351 bp, Homo sapiens
ataaagaatgggtagaatatcagagctactaattttctcagtaattctaacttgatttttctaattttcaagtctcaattgtctctagtcaaaagtaagtataaaagagtatatacatcgaggcaggcagatcacctgaggtcaggagttcgagaccagcctggccaacatggtaaaaccctgtctctactaaaaatacaaaagttagctaggcgtcatggcacccacctgtaatcccagctacttgggaggctgaggcagagaatctcttgaacccaggaggcagaggttgcggtgagctgagatcgcaccacagcactccagcctgggtgacagggagactctgtctga

SEQ ID NO: 238266 - DNA, 680 bp, Homo sapiens
  misc_feature (628)..(628): n is a, c, g, or t
  misc_feature (660)..(660): n is a, c, g, or t
  misc_feature (680)..(680): n is a, c, g, or t
gttccaggaagataacatggaaatggtggtagactccagagacagggaagaaggaagtttcaacatagccctgccctggggctgggtgggcagagtccaggctagctcctgctcgctgcctggggaccccatccagccccttgtccaggggtgcctgcaggcagacatgagagtgaggccccactaggaggacaaaatgcaccacagcaagccagggagactgcattcttcagttgggaacatccttggggtctagtttcatggctaccaaaggtagtgggcaggtcccaggcctcctgccaagggcgggcaggcaggcatctctcctccacctagaggatcattaagccctgcccagggccacaggaaggattcattcccctgggaatcgggctgctctgtaaacccaggcctgtttctacgaggagcttcctctatggagaacccacgcaggttcataccaggccagagtctccctcctggcccactgacatggttctgctctcagattcagggcccaatgtgcctgactgactagaacagaaatcctcaatcctcctacctcccaaacaggttaagctcgctttaaagtgaggtccggataacttcgcatgtatgggggagtagntctcggtatgcctgtgtgaaaattgaactgtntctgtacgtcatgtacaccn

SEQ ID NO: 238267 - DNA, 854 bp, Homo sapiens
caagtagctgggattacaggtatgcaccaccatgcccatctaatttttgtactgttagtagagatggggtttcaccatgttggccaggttggtctcgaactcctgacctcaggtgatccacccgtctcagcctccctaagtgctgtgaggcgtgagccactgtgcccagcctgaataggtcttaaaaataatttgctaagatgctcaaagcagaacaaaggagaaaatactgcttaataacttcatggaaagaattcagtaaaatctctacaattcacagatagattagtatactaattactgacactgatttttttttttgttaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacaggtggtcagtctgaccaaggatacgggtctaaggatgaacttataaaggatgatgcagaaattcatgtgcctgaagaacaggcagcaagagaattgataactaaaaca

SEQ ID NO: 238268 - DNA, 558 bp, Homo sapiens
agatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcaggtggtcagtctgaccaaggatacgggtctaaggatgaacttataaaggatgatgcagaaattcatgtgcctgaagaacaggcagcaagagaattgataactaaaaca

SEQ ID NO: 238269 - DNA, 464 bp, Homo sapiens
agatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggcaagtataacaaattgacattgtttctaaggtaaattttatttttgtacttctaataaaatttgggtgtaagttgctttaaagtgtgctcaagcattttcattaagcaggaaaggtaaaactattactgtttcatggagctggtgcatattacttgtttattttttattttaattattgatttgtttttgtgacagagtctcactctgtcacccaggctggagttcagcagtgcgtccttggctccctgcaacctctgcctcccgggttcagacagttcttgtgcc

SEQ ID NO: 238270 - DNA, 409 bp, Homo sapiens
acagactgcctttgtagtattaacaaattagccataggattagagattatggtttaggagtcatgtagctggaggccacaagattctaagcctccccagttgctcctagggatagcatcactattggaaaacctgagattggtgctgaagatatttttcagaccctgcagttgatggatcagctggcgtcacccagattgagaaactggctggctggtcctgtggcccctacccaggaatctgcttagcgcaagaggaccacttggaggctctgtgattttgtctctgaccaaaccaatcagcactccccactccctggccctctacccatcaaattatcctttaaaaacactagtctggaattttcagagagactgatttgagtaataataaaactctcttctcccga

SEQ ID NO: 238271 - DNA, 365 bp, Homo sapiens
ggagctgctgctgctgttctagtgtgagggtcatggagctggaagaccgcgggaggagctgctgctgctctcctagtttgaaggtcatggagctggagacccggaaaggagccatttgaacagcagcactggcccctccccaggtctcaggctccacgaccctcagacttaaaaagctgtagtacgggcttctccctgggtctccagctctacaaccctcagacatgaacagcaccaccggctcctccccctgtctccagttccacgaacctcaaactacaacagcagtaccagcctgggcgacagagcaagactctgtctccaaaaaaatagaaaaagaaataaaataaaataaaatgtaaaaa

SEQ ID NO: 238272 - DNA, 502 bp, Homo sapiens
ctgtgtgtttttgcagatgtgattaagtgaaggatcttgagatgaagcaattataatagattatccagatgggctctaaatgctgtcacaaatatccttttgggaaagaggcagaggaaaagtagacacagaagaagggaaggtgatagtaagatggaagcagaagtgcgataaggccacaagctcaaggaaggcaggcagccacaagcgcctggaagagaacaggagtagattctaccctggagcctcagaaggaagcatgatcctgcctacaccttgacttcagcccagtgaaactgatttcggacttcttgcttccagaattgtgagatcctacactttcgttgtttcaagccaagtttgtggtagtttgttacagcagccatagcaaactaatacacacaccttttcccctataggaaccactgacgttcctcatgctctctgttagctatattttgtctaaaaggagaaataataataatcatcctttatatggaaa

SEQ ID NO: 238273 - DNA, 2511 bp, Homo sapiens
  misc_feature (1140)..(1140): n is a, c, g, or t
agaaaagaggacagagtcattttgctcagaagaaacagcatgtgcaaatgtgccacaaccattcaaagcaagttgctgcttaagtcttgcccacaacttttcatctgaaaagtggagtagctgaagcagccaatgctggtggttataattcttgaggatgcaacagtaagaacggaaaggaaataacccccgaagcctttgcaactaaggacatgtatccttcagacaagtgtttactgggcaacttcttcgtgctgtaattgagtgtggccgattgctcacaaagatgtttgcaaaatccctcctgtcccctaactcacttctccttgcagtgtcactctgccaacttctcctgtcgattggtgaagactgtttctcctcccccttgaatatgggctgggcttgtaacttgcttgaccaatagaatgcagagaaatgaaatgcagccttcaacattcaaggctatgctcaaggagtctaaccctgtggatatgctgttgtcaaatgagggagcttcgattagcctgttgaagacacacagacgacccgacaggcaataccaacattcagatatgcaagttatgctgtcttagaccatgctgcccaggtgaacttttagacgactgcaatttgtgagtgactctaggcaagaccagaagaaacttctagctaaatctaaaccaaatgccaactcagaattgtaagcaaataaaacggttgttgtttaaagacactaacttttggggtgttttgccacacctcaatacataactgttacactaattatttttcattgtgaaatcttcagcgtcttattctgtaatcaaaccagaatgtccttgccttcttagcactttgccacagtccagtggggtgaatagacagcagctgctcatttatgctcatgctcatgttcataatttgcatttggactaaaaggagctctgttctccaggacagaactattctaaagctcttcaggaacaggaacaggagtccatcacagacagcgaaatcaaaagcgccctacatagaggcatccagactgagagctgaaagggatctgggaaatcatttagtctcactccctcattttccattcagaccacagggatgaaagaacttgctgaagttctcacngctctgtagtggcacagtcagaacaaggatcccaatctcctaactactaacataaaatgctttcagcatgcaagttgagcatacaatgggacagtttaaatttaaatggtgttttgagcaaggggagagtctaattaattacttcaaagtataattttggagtcaccagaaaggcgttaaagacaaaaaaatgctttggaacctaggtgcttcatatctgaaattggggcaggtacaggtgtattcctaccactaaagggtcattagttggttgggtagtcctttagtgttcttggtactaagcacaaaacatgggtaagatggttcaaggctggttgtggtggctcatgcctatagccccagcattttaggaggccaaggctggaggatagcttgagcccaggaattcgagacaagcctgggcaatatcgcaagaccttgtctctacaaataataatttcttaagaattggctgggcatggtggcacacacctgtaggctatttgagaggttgaggtgggaggattgctttagtgtgggaggctgaggctgcaatgaggtgatcacactatggtactacagcctgagaaacagtgtaagatcctgcctcaaaaaaaaaaagtttatgttctcaaagtgctcataatctagtggtagtacagtatttgagatattagagcagtttctcctccttttgcaactaaggacatgtatctttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttttacagtttttaagataacaattacataactgaaatgcacaaatcttagctgtacagttttgacatatggatacacctgtgtaaccaatgactgtatcacaacatagagcatttcatctccccagcaagatccatgtgtcttttcctagttaatgcctctttatttctgagatggttattgctctgcttttgtttttcatgttaggctagtcttgcctgttctagaatttcatataactgagaacatacagaatgtactcactagtagtgtctgactttttcacaaaggataatgtctgtggtattcattcatgctgttgtatgcatcagtagtttattttctttttactattaagtagtgttctaaggactattttaatagcatcccacaaagggggtatgatatgttctatttacattattatttggtttgtaatattttatattttctcttgtgatttctcctttcactcatgaattattataataaattttttaaagtgtattat

SEQ ID NO: 238274 - DNA, 2955 bp, Homo sapiens
  misc_feature (1140)..(1140): n is a, c, g, or t
agaaaagaggacagagtcattttgctcagaagaaacagcatgtgcaaatgtgccacaaccattcaaagcaagttgctgcttaagtcttgcccacaacttttcatctgaaaagtggagtagctgaagcagccaatgctggtggttataattcttgaggatgcaacagtaagaacggaaaggaaataacccccgaagcctttgcaactaaggacatgtatccttcagacaagtgtttactgggcaacttcttcgtgctgtaattgagtgtggccgattgctcacaaagatgtttgcaaaatccctcctgtcccctaactcacttctccttgcagtgtcactctgccaacttctcctgtcgattggtgaagactgtttctcctcccccttgaatatgggctgggcttgtaacttgcttgaccaatagaatgcagagaaatgaaatgcagccttcaacattcaaggctatgctcaaggagtctaaccctgtggatatgctgttgtcaaatgagggagcttcgattagcctgttgaagacacacagacgacccgacaggcaataccaacattcagatatgcaagttatgctgtcttagaccatgctgcccaggtgaacttttagacgactgcaatttgtgagtgactctaggcaagaccagaagaaacttctagctaaatctaaaccaaatgccaactcagaattgtaagcaaataaaacggttgttgtttaaagacactaacttttggggtgttttgccacacctcaatacataactgttacactaattatttttcattgtgaaatcttcagcgtcttattctgtaatcaaaccagaatgtccttgccttcttagcactttgccacagtccagtggggtgaatagacagcagctgctcatttatgctcatgctcatgttcataatttgcatttggactaaaaggagctctgttctccaggacagaactattctaaagctcttcaggaacaggaacaggagtccatcacagacagcgaaatcaaaagcgccctacatagaggcatccagactgagagctgaaagggatctgggaaatcatttagtctcactccctcattttccattcagaccacagggatgaaagaacttgctgaagttctcacngctctgtagtggcacagtcagaacaaggatcccaatctcctaactactaacataaaatgctttcagcatgcaagttgagcatacaatgggacagtttaaatttaaatggtgttttgagcaaggggagagtctaattaattacttcaaagtataattttggagtcaccagaaaggcgttaaagacaaaaaaatgctttggaacctaggtgcttcatatctgaaattggggcaggtacaggtgtattcctaccactaaagggtcattagttggttgggtagtcctttagtgttcttggtactaagcacaaaacatgggtaagatggttcaaggctggttgtggtggctcatgcctatagccccagcattttaggaggccaaggctggaggatagcttgagcccaggaattcgagacaagcctgggcaatatcgcaagaccttgtctctacaaataataatttcttaagaattggctgggcatggtggcacacacctgtaggctatttgagaggttgaggtgggaggattgctttagtgtgggaggctgaggctgcaatgaggtgatcacactatggtactacagcctgagaaacagtgtaagatcctgcctcaaaaaaaaaaagtttatgttctcaaagtgctcataatctagtggtagtacagtatttgagatattagagcagtttctcctccttttgcaactaaggacatgtatctttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttttacagtttttaagataacaattacataactgaaatgcacaaatcttagctgtacagttttgacatatggatacacctgtgtaaccaatgactgtatcacaacatagagcatttcatctccccagcaagatccatgtgtcttttcctagttaatgcctctttatttctgagatggttattgctctgcttttgtttttcatgttaggctagtcttgcctgttctagaatttcatataactgagaacatacagaatgtactcactagtagtgtctgactttttcacaaaggataatgtctgtggtattcattcatgctgttgtatgcatcagtagtttattttctttttactattaagtagtgttctaaggactattttaatagcatcccacaaagggggtatgatatgttctatttacattattatttggtttgtaatattttatattttctcttgtgatttctcctttcactcatgaattattataataaattttttaaagtgtattataatatatttagtgaaactgtattatttgatttactaatgtctggtgcttttgtatctggtgttgttggtttctaatttaattacatggttttcagagaatatactctgaaagattttaatcttttgaaatttatatatatactttatagcctagcatatggtatagcttggtgaatgttctatgtgttcatgaaaggaattctgaagctactgggtatagttttctacaaatgtcaattaggccaagttgcttgataatttttttcaaatattttatatctgtattgatggtttttctggatggtctttcagctactgagtgaaaaatgttaaaatctctagttttgattgtggacatgtctaatttttcctttagttttatctgtttttgttttacgtattttgaagctattattagattaataacattcataattgttatac

SEQ ID NO: 238275 - DNA, 265 bp, Homo sapiens
gataccgtacttgtctaagaactgaaaataattcacagactgatcccatgcccagtcctggccatgctttgagtggctgtattggagcagaaaagccagggtggctcacctggggtgagaatgaggggggtgaatagtaagaggggtcgtgtaggtcttcttcaggatttgcttatactctgagtgaaatgggggactattttagagaatttttttaaagtgggttagaatttacgtacaataaagttcacccatgttagtgttc

SEQ ID NO: 238276 - DNA, 1224 bp, Homo sapiens
tttcagcacttcgggaggttgaggcggaaagattgctgtgttcaagagttgaagaccatcctgacctcaggtgatctgccctcctcagcctcccaaaatgctgggattacaggtgtgagccacagcgcctggcttgaatgagccttaaatgagatccagagatatgaaaagcaggtagttagttaccatttggagagggattccggaacctagagagagatgaggctgaagaggcgggaagaaaccagatgttgtttcctttcattcatttattcatatatctggtacatatttttgaacacgtgggatatgctaagagctagagatacagtagcaagttagacacttgtgatccatgacctaagggaacttaatattttagcaaaagaggcaagcataaaacaaatacaatgtgtattttcagagcaaaattagaggacctcctttaggggacctgggaaggtcaccttgaagaggtgacattcaagaactgtgagatgagaccctatcccagagtgagccatcagtaagtactgactgaatgaatgagtccatgtgtgaatgcttgcttgaatggtcatcagccaagtagaaaggagaaaagaaagagtcgtgatttattatgcactgaggaaccagaaatgttattgaaagatgtctaaactaagagtcaatagggggacgggcatgatggctcacacctgtaatcccaacactttgggaggctgagacgggtggatcatttgaggtcaggggtttgagaccagactggccaacatgaaaccctgtctctactgaaaaatacaaagagtcaacaggcactgagtgaggtactaatagaatttatggcattaattttggctgctgtgggggctgttttattgccttacttaagatcttgagttgctagacaactgaaggatttttcattatcactgggctaacctatacgcattcagtttttacttcatcctgcaaaaagcaaaaccagccacatatggcccaagtgtctgaaggttcctccaagttgcccgtgtagttctgactccgagctcctacgcatgtgacttttctggcacagccgccagaatcaccttgaaaggttgtcacctacctgttccttaacaaagccatacagctctgttcagaaaagacagcaggcctgcctcttaggcattatggcatgttgtgaaatgccttttcatttgggtcctattattgtcc

SEQ ID NO: 238277 - DNA, 720 bp, Homo sapiens
tttcagcacttcgggaggttgaggcggaaagattgctgtgttcaagagttgaagaccatcctgacctcaggtgatctgccctcctcagcctcccaaaatgctgggattacaggtgtgagccacagcgcctggcttgaatgagccttaaatgagatccagagatatgaaaagcaggtagttagttaccatttggagagggattccggaacctagagagagatgaggctgaagaggcgggaagaaaccagatgttgtttcctttcattcatttattcatatatctggtacatatttttgaacacgtgggatatgctaagagctagagatacagtagcaagttagacacttgtgatccatgacctaagggaacttaatattttagcaaaagaggcaagcataaaacaaatacaatgtgtattttcagagcaaaattagaggacctcctttaggggacctgggaaggtcaccttgaagaggtgacattcaagaactgtgagatgagaccctatcccagagtgagccatcagtaagtactgactgaatgaatgagtccatgtgtgaatgcttgcttgaatggtcatcagccaagtagaaaggagaaaagaaagagtcgtgatttattatgcactgaggaaccagaaatgttattgaaagatgtctaaactaagagtcaatagggggacgggcatgatggctcaccgcgaattgaactgggtaccg

SEQ ID NO: 238278 - DNA, 729 bp, Homo sapiens
gaggattcattcaagttgcggtgagccatcagtaagtactgactgaatgaatgagtccatgtgtgaatgcttgcttgaatggtcatcagccaagtagaaaggagaaaagaaagagtcgtgatttattatgcactgaggaaccagaaatgttattgaaagatgtctaaactaagagtcaatagggggacgggcatgatggctcacacctgtaatcccaacactttgggaggctgagacgggtggatcatttgaggtcaggggtttgagaccagactggccaacatgaaaccctgtctctactgaaaaatacaaagagtcaacaggcactgagtgaggtactaatagaatttatggcattaattttggctgctgtgggggctgttttattgccttacttaagatcttgagttgctagacaactgaaggatttttcattatcactgggctaacctatacgcattcagtttttacttcatcctgcaaaaagcaaaaccagccacatatggcccaagtgtctgaaggttcctccaagttgcccgtgtagttctgactccgagctcctacgcatgtgacttttctggcacagccgccagaatcaccttgaaaggttgtcacctacctgttccttaacaaagccatacagctctgttcagaaaagacagcaggcctgcctcttaggcattatggcatgttgtgaaatgccttttcatttgggtcctattattgtcc

SEQ ID NO: 238279 - DNA, 431 bp, Homo sapiens
ggctggagtgcagtggcgtgatctcgggtcactgcaacctccgcctcccggttcaagcaattctcctgcctcagcctcctgaatagctgggattacaggcatgcggcaccacacccggctaattttgtatttttagtagagacagtttctccatgttggtcaggctggtcttgaactcctgacctcaggtgatctgccctcctcagcctcccaaaatgctgggattacaggtgtgagccacagcgcctggcttgaatgagccttaaatgagatccagagatatgaaaagcaggtagttagttaccatttggagagggattccggaacctagagagagatgaggctgaagaggcgggaagaaaccagatggcaaggactttgtctcatgcgcaaagcatataatttatagaaagcagagaaaaatggaagct

SEQ ID NO: 238280 - DNA, 5702 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238281 - DNA, 5648 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238282 - DNA, 5733 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaaggttggcttttttattcaaactgagcattttttgagttaaaagcatttttatttggctatagaattgacaggtgtctactttatagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238283 - DNA, 5611 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238284 - DNA, 4772 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatgaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238285 - DNA, 5155 bp, Homo sapiens
acagccgcggtgatagtgagtactctctgcttgtgaggaatcgtacaactctgctctcttcttacccttgactgccgggtactgcacacacacacacacacacaaaatcttattcagggaaatgcaaattaaaatccatcataccatcatactggaaaaaaacgttataaattaagcgcaggcaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238286 - DNA, 5890 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagcaaaaaaaaaaaaaaaaaaaaaaaaaattttgtgcggcggctgggaccctgaaaaggtttttaaccattcgtggggggcgcggccaggttggtttagtgcaccttggcctaagttgtccaaaggaaccctggccagaccagggtgtggttctcccattaaaagccgcggcgaccgccgttctgaacaatcgaatggcgtcgggcatcggctatacgggccacggcgtgtcccccccgcttggag

SEQ ID NO: 238287 - DNA, 5534 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagatctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238288 - DNA, 2183 bp, Homo sapiens
ctggagtggcatataactccaaaccacaagagaaaagaacaagagaagaaaaatgaccaacaaaaacaattcgaaaacaataaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238289 - DNA, 1984 bp, Homo sapiens
ggtcacagtagaaaagatttcctttcacaagattattagtcttttcaaacaacaataataaattgatacttttaagaagtttaggagttgtgaatgtggtaaaactgaacctttccagtgatttagtggaaaggtcttatcaatcttaattttttctttttcatgaaagtttctgcatttgtataaatcatcaatattttctgttctagggaggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238290 - DNA, 1076 bp, Homo sapiens
ctttgagttaatatttgtcttatatttttataggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238291 - DNA, 1067 bp, Homo sapiens
cctactactactaaattcgcggccgctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238292 - DNA, 4247 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggcctgaatgttcataaagttgattctttgtacaacaagaaaccccaaaaaaagggggggggaaaataccccgggggcccaattagcggaccccgcttctggaaaagggcccaaaggggcgcataaagaaggacgggcggaaacagggag

SEQ ID NO: 238293 - DNA, 1056 bp, Homo sapiens
  misc_feature (1)..(1): n is a, c, g, or t
  misc_feature (14)..(14): n is a, c, g, or t
  misc_feature (25)..(25): n is a, c, g, or t
  misc_feature (37)..(37): n is a, c, g, or t
  misc_feature (53)..(53): n is a, c, g, or t
ntttgtttgtaganaaacgatgccnctgggggggggnacagataactttcagnaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 238294 - DNA, 3207 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatgtaagaatctgaacattcttcttgaggattcattaatgagaaaagtgttatccttgttaagggaatgaatagatattgggctaggcatagtggcttatgcctgtaatcccagtgatttgggatgccaaggcaggaggattgcttgaggccagcctggacaatatagcaagaccctgtctcttaaaaaaa

SEQ ID NO: 238295 - DNA, 1932 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaagtaagtttttaaaagcat

SEQ ID NO: 238296 - DNA, 1455 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagagtatttttgatactttttgggttgacatataagggtgaccaaccctatttgtttttatcttaaaggacaaagatagtgatttttaaaaaccaaaatgctatattttgtattttaaattgctaattttaatttcaataagtttaaataaaagtctgcatgcatgtgt

SEQ ID NO: 238297 - DNA, 236 bp, Homo sapiens
ggcgtttgtagaagaggagcatctgctccaggtgggttcggatttctgtcggttttgcacaagggatcctaaaggcgattgaaatggtacttagagaaagaaaggatcggggccggggctgttcattttgggccgcgcaagcgtggctgagtgttcggcgagagcgtgaactgggcggcgatgaggtggcggcgcggctgtcacttaagttgaatagggcggtgccttgtggggcc

SEQ ID NO: 238298 - DNA, 4322 bp, Homo sapiens
  misc_feature (4180)..(4180): n is a, c, g, or t
  misc_feature (4190)..(4190): n is a, c, g, or t
  misc_feature (4199)..(4199): n is a, c, g, or t
  misc_feature (4275)..(4275): n is a, c, g, or t
  misc_feature (4306)..(4306): n is a, c, g, or t
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacnaaaaaattcnttgaaaaanttacaaccaagtcccctttgaaaaagtgggtcctcctctcaacaaagcctgtcaactgggtcctaaattagaccancaagggaaggaaataatctgaaaagccctgnaaaacctcctcctggc

SEQ ID NO: 238299 - DNA, 4331 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaaggtaaagtaacgtttcaaattctagcaaagagataaaataacttgtgatatggtaaatatgataattttaaactatggcattattcttctgcaagataatttgtacaatgaagaaagttctgttattaactaaattttccattagtcattcaacgaatactagactgagttttctccatatacggttgtgctgttctagatgttgtgggagctacaaagacgtacaaagaagtgggagctacaaagaagtatgaagatctctttgaacacatgcagattatgttaatgatatgtgataaagtaatgtaacactgccacatagtaatcattagctatgtgtttttgaatcccaaaatataattttatttaaaatcagcttaaagataaggcagtaagaactagaacactgctaatatacaaaaatgtaattataaatatgaagtcactgacactcta

SEQ ID NO: 238300 - DNA, 2042 bp, Homo sapiens
tcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaaggttggcttttttattcaaactgagcattttttgagttaaaagcatttttatttggctatagaattgacaggtgtctactttatagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggtttttttgaatcccgtgtccttcaagcgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaaaaaaa

SEQ ID NO: 238301 - DNA, 532 bp, Homo sapiens
cactccaaagccaagacaagcagtttcctggaaaaagaaggctgcgcggagcccagagtggcctggatcctgcctcatttcctggaccagctccttaggtggttactggattgccaataaagcagagcttattaaagtcaacgagctcaggcttcatcgccgccatggtatccaagcaccagtctgtctgggatttcatttgccagatggacaaaggagaggttgttccaatacatatcctgagtggtgggggtggggagagaaggggaagaatgctctctagagaattctctttgtcctctgaagtaaatagagatcatgtcttccccagccacactcagtgatctgaatctcttggactgtggatttttcctttacctgctgtgaagccttgaaaagtatgaattagcttgataatgatcctctaaagatgttcaagagttaaagacgtgtttaagttcttcaggcaatccaatatgactacgggtttccaaaaatttgaaggaaactgaaaatcatagttcccaaacca

SEQ ID NO: 238302 - DNA, 608 bp, Homo sapiens
tggagaggaagtagaatttattggttagtattaagaggggaagcacagtgaaagccctcatgagtgcagggcccggcacttgtccacagggccacaactggggatgtacttgaccccacagccatatgagccacttctcagccaccatgtcttcaaattcatcgacattgaacttggtgaagccccatttctttgagaagtggatcgtctggcagccagagaacttgaacttggccctgtgcagggcctcaatcacatgctccttgttctgcagcttggtgcggacggacatggtaacttggccaatgtgacccctgaccacagtgccctggggttttccaaaggcacctcgcatgcctgtttgaagcctacattggggtaatgcaaggtcagagacatgaacatacatctgaaaggcctattatcaaggtcccttagagcaacctatagaggaaacaggctgcatacaccaccaaggaagctgctgtttgcagccattgcacactgggcccccataaggaaaggaactcagtacacttaattgactgcagaggtaatgacttccattgtggaaccttggtcctaaatgtttctgtgtacaggataat

SEQ ID NO: 238303 - DNA, 436 bp, Homo sapiens
gaagggggccgccaggcagggaggacagcggttcccgaggaaggtttcggagagtgaaagagaccggaggggaggcggctgatgtccacgcccgagccaagactctcaaatcccacatcaatttcccgaggcgactctcgcaatcgccagaacggcacccatgaccgacgctccgcgaaagccccacgcgcggaggcgcgggttcagccccggccgcgcggccctcccgccgcggcgagcaggtgccggacgcttacccagggcccaggtgcagctctccttgatggctttgtacttgctcccggacgcctccttctgcagcttcctcaggatttcttccatcttgaccttccaggcgccgggccgccgcccacagggagagaagcgcgggcgagccgggccggggaagccgccgctgcctggccctgggcgccta

SEQ ID NO: 238304 - DNA, 323 bp, Homo sapiens
tgactcaatgcaacctcgacctcctgggctcaaatgatcctcccacctcaatacctcaagtagctgggaccacgggtggatgtcaccacgcccagctagcagttttaattattttttgttgcccagcctggtcttgaactcctgggcttaggtgattctcccaccttggcctccaaaaatattgagattacaggcatgagccatggcactcagcccctaattctcctttttaaaattttcaaagtacttctttctcctcctcatgccatttatatagcaggtgctttgtttatactcatcatctaatctatttgataatgtgg

SEQ ID NO: 238305 - DNA, 482 bp, Homo sapiens
attggtattttaataataaatatctctgctctttgaaagaggtactaattgtgcgtctctgtaatgaaaaaccgagaggaattaaactggttcaatagtaactgattcctgagtaccactgccaggtcttaccctggccaaaattagtaaaagactgatgtctatatgtggttcaaaactgcttttgtattatcgttggtgaatgaccactgaaaatattaaagcagtggtaagataatacagttgactcttgaacaccatgggcgttagggacattgattactcatgcagttgaagatctgtgtgtaacttttgactcctccaaaactttactcatagcctgcagttgtctgaaggccttaacaaataacatagtcagcacatattttgcatgttgtctgtattatatactgactgtattcttaccataatctagagaaaagaaaatgttattaaaatcataatgaaaatatatttactct

SEQ ID NO: 238306 - DNA, 459 bp, Homo sapiens
agattatattgccaccatggaagaggaggagctggaaggagattctgaagccttgggacaaagctggtgctgcggcagtcagagcagagagacagaatgatgccactgattgctgtgcttttggagactgttctacttctgaatttccaattcagtgaaataatgcctgtcctcatttattagccttttagagctctgctgctgtcctgtccataaggttatttgttggtaaaatattaaactacaggaaacataacagcctcagaaaagcatgactcaacatgagcctgggacaactcagggtctctctactgtgcacagcatttgttctgctttcaaggctccccacagcatctgaagctttacatccctggaggcaactgcccatatgtttacctttattaccaactgcagtttccaggcatctgctaaattacaattttgagtgcttaatggtga

SEQ ID NO: 238307 - DNA, 578 bp, Homo sapiens
cattttgtctttctttttgtagctgcaatttggtttgcttatactttctctttgtctctttgaaaactgagtcagtttcactttctcaggacaggatttaataaccataatataatttagtataattccttgatttaggcaaattatgcaatttgtgtttagtatgaaatgtacctaaaaataagtaactcctctttaacaccaccatcctcaaactaatataacaaataacagttatcctaaaataaattgtctacttccaccatgcagcactcaaattttaaggttgctatgactgcagacagtattttaaaattcctctctggaaatggctttgtttccaagatgatttaggaaccaaagaggtgaccatctcttgtttaatgaactctcaaatcataaacctgggaagtgttttagtttcctactgctgctgttacaaattatcacaaatgtgttagctaaaacaaacacaaaattattattttacagttctagagatcagaagtcaaaaatgggtccacaaggtttcattccttttggaaactctaaggggcaatctgtttccttgtcttttc

SEQ ID NO: 238308 - DNA, 553 bp, Homo sapiens
gtggcctcagagcccaccccacacagcaagaggcccagaccctgcccctcctggcctcgtcgccttctggctgcatggtgagtcatctgctttataggccgtggtcccgttgtcacccgtcttggatgagagctccctgacctgtgtcctaggctggcccctgcacacccctggctccatcctgagcccactgtggcagcatcctcttcaggtctcccctctgccccgacctcctgcttacctcctttacccaagacggagcaggtgaccctggcaggatcccaaaggctggcttaatacaaattagcatctccactgtaccctgcaggcaattcataactgccctaccccaggtgggggcaagatggagcccttgtcagtgctcagcccaggagaggtgagggatggccacagagatgccctgcacagagaggccgcttaccagctcctcatcccctgcccctgggattccttccctcctgtgcctctgtaccctccccaagccatgcaaatccattccagactgagtttcccaagatgaggagaccccaga

SEQ ID NO: 238309 - DNA, 268 bp, Homo sapiens
tttcttccccccaaattactatttcccccagtttactatttccttctcagtagcttaggaaagtgcttttagcctgagggattctgtgatcccacacttttgcagccctaggaacttggcatctatcctccttagacttttatgagtaggtcccaccatataacatgcatctgcacctgaaactccatttatgtaataatgctacaagagtgcccatgctgtttcagatgctcttctagctcctggagatacatcagtatccaaagca

SEQ ID NO: 238310 - DNA, 247 bp, Homo sapiens
actttgggagactgaggagagaggatcacttgaggccaggagtttgaaaccagcctgggcaacataggaagaccctgtctctataaaaaatttaaaaattagcccggcatggtggcgcacacctgtagtcccagctactcaggaggctaaggtgggaggatcacttgagcctggaagactgaggctgcagtgagccgtgaccagtgccattgcattccaaactgcaacagagtaagacccaatctcc

SEQ ID NO: 238311 - DNA, 414 bp, Homo sapiens
tttttttttttttttttttttttttgtagagatggggtctctctgttacccaggctcctaacaccattttaaaaagataacaatatttgacaatatatcattaactgccacatgaaaggccttgataaatgctatggtcagaaggaaaagacacattttagctagaatgatcagaaaatcagagccaagatgggcatggggatagagtgggaatgttagctatgccagtaataagaaagaatacctgcataaactggaaataggaaagggaggagaaaggggcaggataaaaggctggcaagcaaaggtaaattccaaggatagtgattaggctaatctcagaaaaacataagaagagaattgcaatccatcttttccaacaaaactttaaaaaccttacagaaatgtatcctt

SEQ ID NO: 238312 - DNA, 858 bp, Homo sapiens
aagattgtttcttaggttgtccatcagttttatttaaatattttctaatacacggtaaaacagctttattattgccatattgttacatttccattttaatacactataccaccagtacatcctgataacacttaatcagtcctttctgaaatgtaaaattgtctctacttcttacatttctgccagtaataatgatgatgttattaacatactctacaattcacaaagaaaaacataagaaataactacattacttattcacctcccatcactctgctgtggtaatggattactatttggtgaacaatgtttcaccttttgtgtataatgctgacatctatggtaccaaagacaaccaaaaacctttaaattaaatagccagatatctttggtagccctcagataaaagtaaaaacatgatttttctaataagtacagatttgtttcctgtaacaatagcaaaagactgctatccactaaccacactaaccacagaatacactgaaattttcataatcatattctattaatatgtctattctcaatacagggtagctactatggttaagacatgaaaattcaataaataaggttttaattgaaagacttaaaaaatgattcttcattttacaataaaccacagaaaatcctagaaggagaaatttataaacttcaggtaacaactttacccatcgttaagccaataaaccaataaaaggaccaaaagaacaaattatctgtatagtagttcaatatgtccaaaaggcacatgtatgactacagaaatgcagaaactcttattaccacacaacctcattagtaggcaatgaatgttgcaagggcaacttagccttcatc

SEQ ID NO: 238313 - DNA, 392 bp, Homo sapiens
gctccagggttggagtggtggtgggaggtgcttgtgggggtttggaggtttgcaaggtgcgtacccatggctgctatataaagttctagaactgtcttactagaccgcagataggtgtgaatcttcacctcagtaggtgctaactgtgaagtgaaaccaattatattcacatggaaaaaaaaagtatctctctagtagacgtgacctcaaaggaaggaagcaaaagcagcaggagggccttcaccattagactccatctttaccgcgcttcattcttcgcagcctcctcctaagacactaactagcaattccaaatatttcatcttcactcacaggttatactcctttatatgacctccgaaggctagctgatgtatttttcccttgaggat

SEQ ID NO: 238314 - DNA, 354 bp, Homo sapiens
gaagtccaaagatatggcagttctcctgagttggcaaaattctcttttgtcatttttacggaaaaagacagtagcaacccttccaaatagcacattctcatacacctttatttagagcagtgaaagggaacttctttgtgtctctttttgggagcttcaaaatccttctcaatcctcctccagaggcccttaaatgtcccttcccagaattgcatcacatgccaacatttaaaccacgcactgaaaacagcaacaacaacaacactgggactgcagtgattccttggttaatctacattatatttaccattccatcccatcccacaagtcacaaggggaagcacatgacctcag

SEQ ID NO: 238315 - DNA, 287 bp, Homo sapiens
ctggattgctcaaactctattgtcagtgacaaaacccagtgtaagctggcctaatatattaatagtaatatgcgagtcctcccggggtggcgggcactgacgtaagtgctttacttgggtcttctcatttcatcctcccagcaacccaaagagctggcggcgtcattcccattttacaaatgcgaacacgggctcagagatggagcgactcacgttgtaagcgatggaactgggatttgaaaacactgtatcccgcctggcagaaaactggcaaggttaggatggag

SEQ ID NO: 238316 - DNA, 385 bp, Homo sapiens
tcatgaactataccagcaaaacaggaaaataatggagtaagaggccatgtatttccatacactgtagacagaaagtcactttgccaatagaccaagctgccatacatgtaccaactgagcaggtggcagctatgcaggagctacgtaagagttatcgattaatgcccaagtgtggtggctcacgcctgtaatcccagcactttgggaggccgaggcaggcagatcacctgaggtcgggagttcgagagcagcctgaccaacatggagaaaccccgtctctactaaaaatacaaaattagccgggtgtggtggtacatgcctgtaatcccagctacttgggaggctgaggcaggagaaccgcttgaacccgggaggcggaggttgc

SEQ ID NO: 238317 - DNA, 934 bp, Homo sapiens
ttgagatggagtcccactctgtcgtccaggctggagtgcaatggtgtgatatcagctcactgcaacctccgcctcccgggttcaagtgattctcctgcctcagattccagagtagctgggattacaggtgcccaccaccaagcctggctaattttgtatttttagtagagatgcgatttcaccaggttggccaggctggtcttgaactcctgacctcaggtgatccacctgcctcagcctcccaaaatgctagtataacaggcgtgataacaggcgtgagccaccatgcccggccaagaaatacattttctaaagtcagagcctctctcccctaaaataattgagatgttattttatgataaatgttgcttacctgacaatctaaatagtacactttcgatcagcattcttaattttgtgtttttaaacccctagagcagagcctctcaaacagtgtcctctaaggataggttatgggtgtgccaatgtattgcttcctcttagtttcttgggtgatagagtgcagcatggggaagttctgaggaaatgggcagggattctggctgtaaactttgttcatttagtatagcattcaaatgttaccattttctgtggggaaaatgacccttgaacagcgttgctcttaatttgaggtcctcacaccctcaagaaacctgaagatagaataggggtagggtagtcggtgaacttggattggaaaaaattatgtctttattttcactaacttccaactggcatttctttcaatcatgaatatgtctacaaaccacagtagaatcataagtatctgcagctttgtcattcatagaaatcacaaatatttctaaattattaatatattacagatgtactgatatcctcccaaatttttatactaatttcttcttcaaaattcctggctggccacaatggc

SEQ ID NO: 238318 - DNA, 2101 bp, Homo sapiens
  misc_feature (147)..(147): n is a, c, g, or t
  misc_feature (164)..(164): n is a, c, g, or t
  misc_feature (744)..(744): n is a, c, g, or t
  misc_feature (1299)..(1299): n is a, c, g, or t
  misc_feature (1837)..(1837): n is a, c, g, or t
  misc_feature (1905)..(1905): n is a, c, g, or t
  misc_feature (2051)..(2051): n is a, c, g, or t
aaaataaaaaataaaaaagcaccattgactttgactgtagttagttcctgaaatactcagaggtctagtcagataaaaaggtcaggtgtctcagagattcgcccttccaggtactccacatggggcagcagagtcacatctgaatgnatgggatgtaatggaangcagttaaagactaagatacagtgtgtagaccaggcctgtatgcgtgggtggccaggtaagtgcctcagaaaaaagacctgctaccattcctaaagaaggcagaaggctgggaagcatgaaactcaacagactctcattatttcagatctcacggtcacttagttctatgtcccatcaggtaacactccacaacagggctttgttgctgagcttactataaattctgttcgataaaaacccttgcagagcacagggcagctctagtttccatgcctgtggacatttaaaacaccaaaataactattgattttttaaatcccgaggaattaattgtgttttaatgtaatataaggtgtcttaaagtataatggattggcaaaaggctctattgatatttaagggcctaggaaagaaactgatgggaaaaaaaatgtttccttggaaaagactgttatatattacaaggtttaagacacagaggtggagaagtaaagatgggcaaagtctcagctagaattcacagaccagaatagcaaaaaaacaagtgtttgaaatgcaaattagtttcttactttttanactgtaggaaaagaaactatcttaataaaatagaggtctatcataataacagtttgaaaatagaatgattgataaaacaagctcatgttttaaaaaaaagtgtttcttaaaactaaagaaaaccacccacccataggctaatattcttgaaaaggggtaggtattttgcttttcattttaaccttttttaaacgttgggggacaattttctctctcaaatatttcttgacatagtagataaaaattcaaataaaggggaataatctctctttttgaatacaaatatttatagccgctttattcacaaattcaaaaaactggaaacaattcaaatgtccatcaatggttaaataaatggaggcatatccacacagtggaagtctacacatatcagggaactcacatgtggaacgacatagatgagcctcaaacacactatcctgagtaaaagaagtcagatggaaagagttgtacactgtatgattccacttacaggaatcgtgaaaaaatctaacctggaaccacaaaacggaccagtcaaatgcaacactatanctagaaagaatgcattttgttgtatgtaaattgttcctcaataaacctgataccttgaaacttctggcagattggcttttttatagaaagagagaacaaaaaaagagagagagaggagaaacatgcaagagaaaagaaggaaaagaaaagagactgatatcatggaaaagggagagagatttttgttaagattctttggtaaagcaatgtaatttctagttgattataatagaaggatggtgcttaagatacatgtcaaggatatattagagaaacaagagtgtccataaacttggagaatttcccccaaataagggtaaataaaatatatttaaaataaaagttatgtcactggagagtaacaaaaaaatgatgcctattgcatttgtctatgacacagctctgttatgaacacctccaggccagaaggcttgtgttatctgcacagctaagaataaaacaggtatattcaggacattggtcccttccccacaccaccccagggaaaaatctctttaaaagaggcatccaggccggncgcggtggctcacgcctgtaatcccagcactttgggaggccgaggcgggcggatcatgaggtcagganatcgagaccacggtgagaccccgtctctactaaaaaatacaaaaaaattagccgggcgcggtggcaggcgcctgtagtcccagctactccggaggctgaggcaggagaacggcgtgaacccgggaggcggagcttgcagtgggccnagatagcaccactgcactccagcctgggcgacagagcaagactccgtctc

SEQ ID NO: 238319 - DNA, 418 bp, Homo sapiens
tagatcattctcaaggaattccagcccctctttctagtgcactgtgttcctttatgctgcaggaaactcggatcaagagtccggactaagcagggagcagtggcaagtgcctgtagtcccagctattcgggaggctgaggcgggaggaatgcttgcgtctaggagttcaaatccagcctgtgcaacagagtgagacccgatctctttaaaaaagagaaagattccaggctgctacatccccttctgcttttcccttcttgtcctgcctctcttctatttgaccacaaggggaggagtgagagagaagtagaggaaagaccacagttcaattagcagagctcttggtgcataaagggttgttgagaaaggtgaactggtttccatctttccactagggaagggtcttccactgaactta

SEQ ID NO: 238320 - DNA, 455 bp, Homo sapiens
tgaaacagagtcttgctctgtcacccaggctagagtgcagtagcatggtctcggctcactgcaagctccgcctcccaggttcaagcaattctcccacctcagcctccgaagtagctgggattacaggtgtgcaccaccatgcctggctaatttttgtatttttagtagagatggggtttccccatgttgttttcccatgttggccaggctggtctcaaactcctgacctcaggtgatccacccacctcggcctcctaaagtgctgggattacaggtctgagccaccacacccagcccctgctttggtttttttatggactccacttaattatttactgaaataagccattcaatcaatgggcaataatccttggatataaatgcccaggctttgccacccactagggtgactctaagccaagtcacttcatctatgaatgcctcaattttcttat

SEQ ID NO: 238321 - DNA, 755 bp, Homo sapiens
cataagtttctctctgactttctcccactttcctgtctctagcccctcattctcccctgaggctagccaaagaaactagaattcctctttttttttttttgagagggagcttcgctcttgttgcccaggctggagtgctgtggcgtgatcgccggctcaccgcaagctccgcctcccaggttcaagccattctcctgcctcagcctcccgagtagctgggattacaggcatgtgccaccacacccggctacttttgtaaggtcataagaccccgattccagagaaagtcctgccctgtacctagaaggaaggaatgttgcacagaaaggccaagaggaatctagacaggcagaccctgctgtctccccactcagtctgttattgttatcagaaaggggccccaatctagaccccaaaagagggttcttggatctcgcccaagaaggaattcaggcaaaatgtgaaaagaaagagatcatctaaaggaaggacttaaaaaaaaatccggaacttgcaagttttgaaaattcccagcttccccagatggcaaatgatgctactgtgaaaaaatggcttccaggcaaggaaaaactccaggacattcccagcaaaacatcatcaaatgatgaagaatggtgcttcaattcatgtttcaaaagcagacacagaaataatttccagagaaatgagctgggggaaaacagaaatgtgtatggaattggaacaaaataaacctgatttttttcaacattgta

SEQ ID NO: 238322 - DNA, 296 bp, Homo sapiens
ttttagatgtaatgctatttcagacataatgtagactacagtatagtgtaaacgtaacttttacatgcaccgggaaaccaaaaaatttgtgtgactctccttaaagatagttcctttattgtgatactcactttattatgatgatctggaactggactcacaatatatccaaggtatgcctctatatataatatgttaggtatatataagctattatgtattatgtaggaataaaactattttaagagaagtatatacagatatattaaaactggtatacattatttcagaacata

SEQ ID NO: 238323 - DNA, 347 bp, Homo sapiens
tgcactttgttgaatatgagtggtaaagagatattcttgctttattcttgatcataggggaaaagcattcagtctttcaccatttaatgttagcttacaggagttctgtatttttatcatgaatgggtggtgaaatgtatcaaatgcttttattccactgattaatataatcgtgggattttttttctttaattaatgtggtggattacacttattgatcttcaaatagtgaattgactttgctaccttgaaataaacttctattgtttggggtatataattctttttatatactgcaaaattctgatattttgttaaggacatttgggtttatcccacaaagtata

SEQ ID NO: 238324 - DNA, 387 bp, Homo sapiens
tatgaacagatttgttctataagcattattttactattttaacattatttcctagaatattttttcactgttattattttcacacacctcagattaaattttaaatttccattaaaacacctagaagaatgattgaaatcaaaacataatactttctttttatgataattacttttatccttgcagttaaaaagacttgaacataaggaagtgcttaaaatgtacactaatgtgaatatacatgcacactcacagttacattgtcactgaggtaaataagaaggtagagccatggaccaggcacttggcctcccataatcccagtgctttgggaggccaaggcaggaggattgcttgagcccaggggtttgagagactctgtcttaa

SEQ ID NO: 238325 - DNA, 908 bp, Homo sapiens
aggaaacagagaaggtggctgtctgcaagccaggaagagagccctcaccagaaactgaatctgctgacaccttgatcttggacttccccagctccagaacttgagaaataagttcctgttgtttaagccatccaatctgtagtattttgttatggcagcccaaggtgactaacacaagaaggaaattttaatttcccctttcatttggtttatatatttatgtgactaaacactacactccaagctgatggctatgactggcctttgaaaaacatcagcttgtctaatcacgttatgtacatatatgcatagtatggaatgtccaaattgaaattatgcctcttatttagagagtcatagattctcacaggtgaaagagactttggagaatctctggactaactcatttcccagatgagaaaactggagccagagaagggaagtgacttgtttaaggccacaccatgagaaaaggcagagctgaggcttgggctgggtctacacacactttgatcagtgtccttctctaacctccatccctcacctccctgtcaatccaccccagcttcatttcccagagcccagtgtccactgggcatggtggccctggaggcccaagtgctttcactacctctgttgaccaaccttcaacagaaatgagcatggaaggaacattcactctgcagctgtgggtactgcccagctagttagtagctcattccagttaacatctgagtttggctctgatgagccaacgcttctggggagataatttgcaaaagttcctcagttccttcccgttgtttataagcagcttagtaaataaggatgttactagcttacactggcttaaaaaaacataagaaaacaaataataaagacttcctttttcttttgccattgtctga

SEQ ID NO: 238326 - DNA, 3568 bp, Homo sapiens
  misc_feature (1660)..(1660): n is a, c, g, or t
  misc_feature (2159)..(2159): n is a, c, g, or t
  misc_feature (2933)..(2933): n is a, c, g, or t
  misc_feature (2943)..(2943): n is a, c, g, or t
ttgacactgttaactcctccctgtttcttgaaatcctctcttctcttgttttctctgtggcaccctttgctcctgtgttcctcctttttctatgcatccttaggggttcccgggggttttgttcatggtcctcttctttctcaatctgttttcgagaaacttgcaaaagtacaactcagcctaacatgcctgtccaagttccagacctgaagagctccagcctcctcgtggatccctttatctcaacacgtctggaacagaactcatgtgggtctctttctgggcttcttatctcagtaaatttcaccaccaaatatccagttctgaagcaagaaacactgggcttcacttttgattcctccctccctctcaatgcccaaatctcatgggtctaaagtcccatcaatgttatcacttgcatatttttgaaatccacaccattgcaacccatttccaaagtagactactgattgccaggggctgggggctaggcggggcaggggaaatagggaaatgcttccattttcattctcaccaatgctgtcctggaccactgcaaagccttctgactggtcttcatgctctcctcacctcctctttctaaagcatcctgcttaacattgctaaaataatttgtctaaatggaaatttgaccgtattactccctagcttaaaatactccgggggttccgcattgtctcctccatagcatggccataaagtcctgcaagaatcacatgctttggcctttgtcctcctccagcgtgtcattccttgcaggtgaccccttctggtccagtgggtctccatcctggtgtgtctcaacctgtggatgatgcttgagccctcctctcagagattctggtctggaaagggccctaaacgttgttgttgttgttgttgttttaagttcccagagctgctaatatgcctccaggggtaggcacaactgtgaacctagccctacatgtgaagggtttgcaagtgccaggtcccgaacctattgagtagaaggaaccaaagtaagcagcattgcctccgtcatttcccaccctcttatgatattttaaggaaagggtttttcactcagctatgcagcaaatattcctggaaatcttgcctgggtcataaggaaatgagggctcttgtattgcctagctcccttccttttgcctgctagagaggagatagggtagaggctttcactgcgtaagttgagcagatagttgtatgctccttatgagcaattgggtgagggtggcagcgggtggaagatgaccatcaagaatggtctgtctcccttccattgcttgaattcctatctacctgatggtttgctacagctgcagtaacagtaacaaagaccacaaactgagtggcttcaacaacaaacacttagtgtcttacaggtctggaggctggaagcctgagatcaagggctgattccttctgagggctgtgagaaagaatctgttctctgtgtctttcctagtttctggtggtttgctggcacagtcttggtgttcctgagcttctagatgcatgaccacgatctctgcctttgtgttcacaaggtgttttccctgtgtgtgttggtatccaaattccccctttttaaaaggataccaatcttactggattggggcccaacctattccantatgacctcatcttaactaattccatttgcaatgccctgatttccaggtactggaaattaagacttcaacataggaattctggggggaaacagttcagctcataaccctaacaagagagtggcaggccagagacttgccagactgatacctaaaaagggcagctacacattcaaaacagggagtgagtcatccctcttctcttgtctgtccaaaacaattcaaacccaagaggagaaacgagaaagagaccacctttgcagataaaccccaaatccctaaccccatacattctgaagtcatcttaatttccttttaatcccccaaatcctgttgacatctcagatcccagttgctaattagccatgcttctattcaatgtgttatatgcctagttattgggcagatgcatactctcatttgataataactagctaaacccaaaatgccttttatggatgtgatatttcatcattcaaatctgattaataagaccagctngaagaaattgcgggaactgatgttttagttgaagggttaaaaagaaaataacatttggaatagtgacactgaaattaagtgacattaagaacaaatatctaagtttctctctccacaccgtggtagccagcccctctttcttttctctcattttcatggggtatgaagaacttttacttacatcatcctggtgcagcgtttttcccccttgaactactgacatttcaggctgaatgactgtttgtcgtggagtctgtcctgtgcattggaggatgtttagcagcatcctggcctccacccactagatgccaagagtgtctccagacattgccagatgtttcctggagggtaaaatcaccactgtcttagaatatacaaaagcaactttgtcactctaaaatactatgcagatgtgtggaattatctcatttattacttccaatagccgagtggtttgtgtagatgggaagatggggagagttgtttaaatgacctgcttcagatcccactgcagatctgtcttagtcctatgctcatgagattacactgcaatcaccacaagcttctattctaaagggttttaatcattctttcagataggaaagggtgttgtccccaattcaccaccagaggacatctctgagagttagccgtgatattcctgggcttgataggacatggagcccatgctagcttttcatctaaatgctgctagcactgctcacatatttgcatacagttcttataggacaatgcagccatgcgcttgcttgnagaggagacntgtagatctttcctaatgtttattttgggttaagttctctttgcaggggtatccataactactgagaattagatccttatgtttaaatggcataaaatgcaatgtgtgaatgaggtatctccccgccctccaaaaacaaaaaaaaaatacatagcttttcatggtcacgagggctaatctgattctggctgccactgtggaaggcttagttaatctaattaaatgaagctagtgcctcctgatttcctagtcctgctctcccttctccatcaaggaatggctttaatggcccaacaaagggctcagcctggtgcaccatgaatttgaaataatgtcccgcactgggttaactgaactcttctgccagcagagctgatgccatctgcccatttattgacagccttgtcagcaaaaatctggagtctgagggttggcaggcagccaacttgctttccactgtctctccagtgtctcagtaacagatgttgtgcctcatgcctggagctgctgttggcaatcgctgcatgctcatgttatttatcagggcgtggagggagggcaggaagggatacatgttttccaggaaggaatttgtattcctttccaggttcttggtttgcagatt

SEQ ID NO: 238327 - DNA, 437 bp, Homo sapiens
gtggtatgaaaatgttcacaatattaagttgtacatatatatgctgtagacatttttactttcagtttctgttttcgtcagttaagtttttacatagctactcttttttaaagtcagggaaggcagacattttctttgtactgagtggtatgagatgctgcatttcctgtcaagtatatgctgatcctgtcgaagttttaccacctgcagttaccactttttcatcttttttactgactcgtagaagatgtgtgtgaagttttgacatatttccccactgtcctataaagtgactttgttggtcgatatttaacttccagaacattgaagagaatcatcttcgggtgacataattttgagttagggtgtgtatgatagaaattgttatgcttatcagaaggcatttattaaattttgtggccatttacttaacatat

SEQ ID NO: 238328 - DNA, 451 bp, Homo sapiens
tttctcctgcagatgtgtggagtttcccagcagcctggggtacctgggaagctcacctactcctactccagttcttttgttttcagggttgtctcattaagttttaggctgttttgccatttgcctgtgtggtaggcagaatcatggccctccaaagacatccacatcctaatcccccaaaacttgtaaatatgttagattacacagcaaggggaagttaaagttgcagatggagttgagattgctcatcagctaaccttaaggtaggaaaattattttggattatctcggtgggcccattgtaatcacaggtgtccttagaagtgtaagagaggctggacacagtggctcacgcctgtaatctcagcactttgggaggccgaggtggaaggatcacttgagcacgggagtttgagaccagcctgggcaacatagggagaatcccatctct

SEQ ID NO: 238329 - DNA, 464 bp, Homo sapiens
ctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctg

SEQ ID NO: 238330 - DNA, 392 bp, Homo sapiens
gtgacctttaggaaggcatccatctggacatttgcaaagtggattctcatctttcagtctgtatcatttcaatatcatctgctacagagaggcaattagataaggaaacaggagtttccgatcacccccaccccccgatggccgtgacttccacggaagcatcctactctccggagagcctggtttgaatcgcacctttgcagagttccagaaacctgtttaggagtctctgagaagctcccctcactggagccacaaaatcccatctccacatgcagttttctcctggcttgtttgatgcggctgaagcgctggccacagccttgcaggaagcctcctggagtggagacagttgttaaagggcctgaataaatctgttcttggacaactat

SEQ ID NO: 238331 - DNA, 951 bp, Homo sapiens
gtcatgtccttattgggatgggagggtgctgagtgctggggctgtgatcagcagtggcaacctgcaacagtattggttagttttaaagaatgtctaaaaatgaaagcctgagtgttctgatgctagctgtccaaagagccaccagataattttaatagtgacctgcatactgtagcttctgcctttatcaaagtttctcttcactcccttcttcagtaaagaatagaggacataagtcaattctgtgtgccatctgttgtcgtttttacaatttctcaaattaaagagacaggccaaaaatttaatgtcgtgttggatcctagaagctcctctagaagagagaaaattgcaactgaatttactttgtctctcttgagggggaaaaattgcatattgctatgtcataaccttttacttgtagtcccaatttggtgttttgaattggattatgagggcttctgcatggaaagactgatgtgtttgggattcagcagcctttgttcacatggttctgagtgacattgtggtaaagttgccagtacagtggtggtgcaatggcttttcatgggggtaatgaaatgcatagtctcctcaatgcaaaaacattttaagacgtttcaagatatttcaaattacatcagacaatcctgtttaaaaagaggttcacctcagatagactgagaaacttacctcccagattatgagctactaactggcagatacattttaaaaataggtaattgataggcagaacacagagtttttagggcagccaaactgctctggatgatactacaatggtggatacgtgtcattatacatttgtccaaacccatagaatgtacaacaccaagagtgatccctaatggaaagtatggactctgggtgattatgatgtgtcaatgtaggttcatcagttgtgacaaatgtgctactccggtagggggtgtt

SEQ ID NO: 238332 - DNA, 2195 bp, Homo sapiens
  misc_feature (737)..(737): n is a, c, g, or t
  misc_feature (2058)..(2058): n is a, c, g, or t
tggtctcgaactcccagcctcaaacaatcctcccaccttggcctcctaaagcactgggattattataggcatgagccaccatgcccgaccctctaaatccctttgaaagtgggttcatgaagcatctgcacaaagggcggctgcctccttggtggcaggggctggattcactgtcttcaggtggctgggacaggcatgccaccaccttggcttctggctctccagagcttgggagcctctctgccgcttgtcccctgttcatgctgcacttgaacccacagcatggaagagccgctcactgccacttcaaagtcaagggccagtttcattcagatcaaggtgatgatttcccaaattgaatgtctccaagctgacttgctcctctctgagaacttctcattatggccaccggtagaagccactgtgtttgacctgggtttgggttttgtttcagcagcaatgtttgagagatgaatattttacactctagctggtgagagctgcaaggaaatgtgggggcattcttattgagctcccccccaccactttatggaggaggaaactgagtctcagaatggggacaggactagggggctaactagctgcagagacagacctgggttttggcccctgatggcaagtttccccccagatgcctgtgctgaactggggaccctccttaggagggggatggggatcttcctttcaccaatgccagccaccccaattctgcttcnaggcttttgagaaaagaccatatgattctgaggtctagggtgtgacaagcacaggcctcaagagttgacagggctcaggttctagctctgtgatcctggggccatcgccttgcggggcatttgactcacccgtaaaatggagcaaatagtactcccttacagcgctgttaaaattaaatgagccactttattgagagcacctgccacaagtgctctgtataagttcctttcatttattccccactctgggccaatgtacttccacactgcagcatcgtggttctttctcacctcaacctgtaggtgggtgctgtttgtgtaccccttttccagatgaggaaatggaggctcccaatggtgacatggcttggtcaaggtcacaaagctaataagagttggaactagaactagaacctcaaggcttttcagacatcagatctacgttcagaacgctgatcattctcttactagccaggtggagtcctggggaggcgccctgttccctacagcaacgctgtccaccgacggttcttcagtggtgggaatgtcctgtgtctccactctccaatacagtcgctgctggccacaggctgctagcgagcacttgaaatgaggctggtgccactaaggaaccaaattgttaattttgtttaatttcaactaattgaaatttatagtgaaatacccacatggggctgtggcttccacacaggacaacccaactggaagccactgtgtctttgcattacgtcagaggctaatccttgccatcagagccagtgggtgtggtgaggctctgtgtgtgaggccctggacatttctcaagcacctgctggtgctcggtgagtattaggcgccccttcctcccgctggctggctctgtaagtggggagaccaagtggttgtgtctctagaatggaggctgaggtgtgttcgtggcacatctgcccagtaatgcggatcagcaggaggtgtctttcctgcacccaaggaggcctcccattgcacctgggggcttggcttcacctatgtgacctcacatccaggcctgcgcacccgtatctgagctggcattgtaagaagccctggatggccccatgaactggctcctgacagcagcgcttgtggcaaaccctccctgcccacaaaccccccagtggccacacctacaagagtgccccttaccggccaggcgcggtggctcacgcctataatcccagcactttgggaggccgaggctggtggatcatctgaggtcaggagctcaagaccagcctgaccaacatggtaaaaccctgtctctactaaaaatacaaaattngctgggcagggtggtgcatgcctataatcccagctacacaggaggctgaggtgggagaatcacctgaacccaggaggcagaggttgcagtgaactgagatcgcgccattgcactccagcctgggcgacagagcaaaa

SEQ ID NO: 238333 - DNA, 644 bp, Homo sapiens
ttggtatgaggcttaagatgataagacatgaactctaagaactggtggaagatgttgagttggtgcaaaggggattgcagttttgccattgcgtttaatgcttttaatgccagtggcaaaaacagttccctttgcaccaacctaataaatgatctcacttgatttatagttagcttcctccaaatgtcttccctctttgtagcggatatagattatggaggaaccagtctgggcctgggctgaaactgtagctgggtcagccctccctcccatcaggcctgcattcccctacctctgcaggtgctgctctcttcccagggcacaggccacctgaacacacttggttgaccaaaacattttaatgcaactatgacttagtaataatacagagggttggtaccatccaaaaacatacctaaatgtacattgtctaataaactctacccttaaaagcacaatctgatgggtgaattcactgtggaaatagtgaaacttaagttgaagcatctccacacatacctacaaacacatttaaaatttgttgtcatagaatgtaattgtgaaaaagtcctaaagtgtacattagtagattgttttataaattgtactactaagtcccaaaagaatgtcactgaagtggtgcg

SEQ ID NO: 238334 - DNA, 619 bp, Homo sapiens
ttcatcttctcaccccgtcctcaccacttccttgtcttcttttggactggcttgtgtttacaacattggattagcagttgtaaggtcagcaatgaattcccaaatagcattcagcacctattttcagcccttcttaatttttctgtgacatttgtacctttttaaagctcttttcttggttctgatgacctgagatatcttgattttcctacctcattggttcttcaactttcttcctctggctttgccattttctcctttctcctcgtcttcattgggggtcccatctgccctctgggaaggttcagcagagggtatctatacctactccgcgttttcaagggcctgcttaatgaatataaatgctccaagggcaccaaatcacaatttctttttacattgcaatccagccccttctcctgactttccttggcaattttactaacctagctcttgtttggcttcaaattctgttttaaaatggaatctacctgctacccaatgagctaccagttcttatcagttttccttcatttcacattgaatgtttttgccttatttttggcctatttctcaacaatagtgttgctattcattctatataactctttcctccccc

SEQ ID NO: 238335 - DNA, 834 bp, Homo sapiens
  misc_feature (310)..(310): n is a, c, g, or t
aaaaaaagaaaaaaaaaaagggagaagcaaaatttacatggggatcttttggtaaatgtttttccagtttgtctttttaaaatggtctctaccagaaaaaaaaaaaaaacaaaaaatctccgctcttttgcccaggctggatttctttgttcctattctttttcttatttactctttctgttttcttgtttttatccatctacttcttttcctctataatctttcttatatttctttttcataatatgtacattatcttatttcaatttcatttttcctcttattcttatatcattttcccctccacatntaatctctcctctctttccttaatctagatttattattctcatctttcttcttcatttatttcctctatactactctctttctctacatactatgatattcattacttgcccgtcctactatctcattatcccgacgtctcgttagtctacatcactctcgatctctctctttctcctcttatacatgactctattatctttctactattacattccattatactactactctactctctattctactgtagtctgtatattctcagctccttctcctatgctatctctatgctcctccgtgttcttattattacattcgtctcttcatttactttatatctttccatttcctttctgtactctactcgtcttatcatcttctatactttagtctatgttactctcattatctatacttcctcctaatctacttttgtctcctctgttctcttatactttactattctttactatactatctctatactcgtcttctactctctctatctctgtatcatatccg

SEQ ID NO: 238336 - DNA, 381 bp, Homo sapiens
ctaattctcaaagcatcctcttcaaacctcaactttttttacctcaggaaattgatgtcatgaaaatattttccatatcccgcaagaaaaggttcccccccaagaaatttttcaaggtattcatatgcttaatataaataaatttaaacttttatatgcaaataaatataagaatgttatgaaaaatttgaatgaagggaagagcgattgatagaactcaaggaagatacagttcaaatcaggaagataaacgaaacatgtattacaatgatcccaatcagaagaaatctatggaatcatgggcctcctataggaaaagaaataaccaaatttcatttttatacaaataataacctgaataaattgaaaaatacaccaaaa

SEQ ID NO: 238337 - DNA, 1479 bp, Homo sapiens
  misc_feature (127)..(127): n is a, c, g, or t
  misc_feature (449)..(449): n is a, c, g, or t
  misc_feature (453)..(453): n is a, c, g, or t
  misc_feature (538)..(538): n is a, c, g, or t
  misc_feature (562)..(562): n is a, c, g, or t
  misc_feature (1101)..(1101): n is a, c, g, or t
  misc_feature (1242)..(1242): n is a, c, g, or t
  misc_feature (1316)..(1316): n is a, c, g, or t
  misc_feature (1457)..(1457): n is a, c, g, or t
  misc_feature (1474)..(1474): n is a, c, g, or t
gcagagggagaggagacaggaaggaaagatgaaccctgagtttgagcctgagcacctgggggctgatgcattggacaggcccttcacaagaggctggcatggagtggcctgttaataatggaagagncatctttctaaagtctttgtaaaacgcaaatccaaccaagtcctcccctgctttgaagcctccgtgagtcccctttgccctgctgagaaaggctgctcaatttccctagcctgacccatcaaagcatcctcctgattccctgggattccttcttcccactcctccaaccctatggaatgactccagagcacccagcaattcctctctttctcaaatctacatctttgccgggccgctaccctggtcttctccttgccacttttcaggactcagtagaaaggtcacttcctctagtgccagggtctctgttccatctcaccanttcntatggggcttttatcttcgcttggacctgtgagttcccagaggccagctttgtgtctcctgctcactgctgtacagctaagtccngggatggggtagccactccgcaangctttgaaacatccaatcaacacagtaaatcctggagatggggaagacacaggggtactagaggagaagggtgagggattggggtcagggtgtggagacacctaatgtaacaaagtcgttcggcttctgcaggaggccattagctctgcacagctcctagtctgctttcagttccaaaaactcaaaagttgcaggttcttcagatgacgctgggtgatgttaggtttctggatgcaccaatctgactgggctcgacttggaagttaagagtacataatgttcccatttctatgaacagctcagaaggaatccaaaaagcagaagtcaaaaacagggattgggaagtaagcacccatacttggtagaaacagaactcaagctgttcacttttaccatccctttaaaagcaacaagaaaatccttagggaaaaagatacacatggtgccttcagcggcttcttccagcaatgggacagaaaggccatgtgggcacacgggctttggagtcagacttgctggctataattttccactttagncctcaacgtcctcatctgtcaaatgggagcagtgttggctcgggatgaaatgaggtgtgtgctcagagcctggggtgacgcacctgccttgacgcgtttgaatgcaacatgagctgcccttattgtgtggttctcacagtntccagtgacatcagagcaaccacagtgacaacagtttcatttttctgtgcacccaccagtaccctgccatgggncaatagtgcgtgagtaaatgcagccagtttacaggcatgctggctcatgcctgtaatcccagcactttgggaggccgaggtgggaagatcatttcaacccaggagttcaagacctgccagagcaacagagtgagacccctntctctacaaaaaaaaanaaaaa

SEQ ID NO: 238338 - DNA, 1394 bp, Homo sapiens
  misc_feature (803)..(803): n is a, c, g, or t
  misc_feature (847)..(847): n is a, c, g, or t
ggtagtggctgctgtgaccgtctcccagcatatcctaagaatggaactttctcaggattcttcatggctcatggaagaaaacatataagagcatgcagatcctgtgtatctacggcagggaacattagctccctgctcagcctccatggaaccacaggattgtattgtatattcctaggagtgaaactgctgggtcatatggtatctgtgtcatctgtttgaggaaccaccagacggtttttctaaatgcagcatttttctgttcctaacaacagcatatgggggttctgatttctccacatcctcaccaatgcttgttattgtttgactttttgattctagccaccccagtggatgtgaactgatatctcactgtggttttgatgtacatttctgtattagtcagctagggctatcataataaaataccataggctgggtagtttaaacaacagaaattctcatgattctggaggctgggagtccaaaatgaaagtactaataagttggtttctggtgaagcgtctcttcctggcttgaagacagccactttcttgctgtgtgtccatgtggcctttcctctgtgcacatgcagtgggagagagagaatactctggtgtttcttccgcttcttataaagatatcagtactactggattagggtcctttcctgtgacctcatttttaccctttttgcctccttgaaggccttgtctgcaaatacagttacactgggggttagggcttcaagataagaatttgggaaggacacaaataagtctataacaatttccctggtcacnaatgatatcaggcatctttttatatgcctattaggctttgtacnaataaatgattccagaaatcttaaaaagttatagttttcaatgtcatttttagaataaaaaggtaaaatcatcttattagaagtgaagcacaattaaggtttttgtttgaagccataccaacaaatagcatcacataaagagtgacataatttagatcaagtatgttgctgagtcactaaatgtaaattattggatcatattgattgtctaaaaaggatatccctaaataagtaacatagaaagatcattataaaagatcagtaaagttgggccaggcgtggtggctcatgcctgtaatcccagcactttgggaggccaaggcagacggatcacgaggtcaggagatggagaccatcctggctaacacggtgaaaccctgtctctactaaaaatacagaaaattagccaggcgcctgtagtctcagctacttgggaggctgaggcaggagaatggtgtgaacccaggaggcagagcttgcagtgagccgagatagcaccactgcactccggcctgggcaaaagagcgagactcagtcccaaaaaatt

SEQ ID NO: 238339 - DNA, 741 bp, Homo sapiens
  misc_feature (734)..(734): n is a, c, g, or t
ggtagtggctgctgtgaccgtctcccagcatatcctaagaatggaactttctcaggattcttcatggctcatggaagaaaacatataagagcatgcagatcctgtgtatctacggcagggaacattagctccctgctcagcctccatggaaccacaggattgtattgtatattcctaggagtgaaactgctgggtcatatggtatctgtgtcatctgtttgaggaaccaccagacggtttttctaaatgcagcatttttctgttcctaacaacagcatatgggggttctgatttctccacatcctcaccaatgcttgttattgtttgactttttgattctagccaccccagtggatgtgaactgatatctcactgtggttttgatgtacatttctgtattagtcagctagggctatcataataaaataccataggctgggtagtttaaacaacagaaattctcatgattctggaggctgggagtccaaaatgaaagtactaataagttggtttctggtgaagcgtctcttcctggcttgaagacagccactttcttgctgtgtgtccatgtggcctttcctctgtgcacatgcagtgggagagagagaatactctggtgtttcttccgcttcttataaagatatcagtactactggattagggtcctttcctgtgacctcatttttaccctttttgcctccttgaaggccttgtctgcaaaaaaaattttttanccccccc

SEQ ID NO: 238340 - DNA, 954 bp, Homo sapiens
attttaagtacctggaaaaaaacggaccagatttttaaaggcaattaataacagcttgtacgagcgcttgtttcatttgacttggcatcaagtaaaggaagagtaaatacgccgtgaaagacgccatcgggcttttcctccacttctcccagaccacacagcacatcagcagccacccttgctgcccactcaggaatcactgtagattccaatttttaaatggctgcttagacgacgccaatagagttctttctccttacagtaaggcggcagtgaatgctaacaggtatcgagttctctgatcaggaacaaagaactccttcaggaaactcactcactttcctggtccttgttaacctgtcacgtaaattctttttattggcacacctgtttactaattatgattgattgctatttatgccaagggagcatttcccaggcgtgcctcatctgtttactcatgacacagtgagcctactttatttacacagtgccgtgggtttcctcttttttcttttctgtttttggtggtgggggtggcactatcacttgttatttatcagggtagatcatacatttggatcgaaaagagaaaccggcaactagatcctaaaacacatttatcaacctgagtcacatcgggaaacatatagactttaattccattttgttgaaaattcattcaactttggtgcttgtccaaggacttatgatgtcaatttctgacataaatcataaccccgagtatatatgtattttcaaaagaaacaagtcatcttaaagtaatatttttctatatgctaattgatacatttttatagcaaattgaaaattctgagcaaactgaaagtatgcttaacaacaaaataaatacagcatatatggttagcacatacatttcttactgtaaaggcagaagtgaatttgtgtcttacaataaatctgtaaatccag

SEQ ID NO: 238341 - DNA, 402 bp, Homo sapiens
cagagtttgcagtgagctgagattgtgccactgcactccagcctgggcaacagagtgagactccatctccaatttagaatatgtaaattctaatcataatacacttcatgagaagtgtattatgtaggtaaatgctgcaggataaaaaaatgctacgggataaaaattccaggtgaacatctatagtcttttgcctgaagtaaagagactgtcatcttggttaactttcccaagtaacaaatataatttatactgtacattgagcctcactttgatgtctcaaacttccctactgcatttgtccttccacatagaccttttgtgttcctagacacagagttaccttcggaaaccctttaactctcatggcgatggaacaaattactgtttcttcagttgatc

SEQ ID NO: 238342 - DNA, 420 bp, Homo sapiens
tgctttgaccattactgattttgaaggccgaggaatgatcacatagaaaaggcaacagagcctggaccagaagggctcccagatgaaatgcattttggctgatggctttcattggaacactgacatgaaggagctgtcagggctctgggcggtttccctagggtgtgaaggccaggcaggtcatgtggttacttttcatcctctgcactacttcctgagagctggacagtgtcattgagtttgggcccatggacaacgcatacaagggaaatcttggaactgcctgaccgttgttcagggcctctggtgctgaaatcctgcaaatctccaggacagaagtcaagatgttttctgagaagtctccaaagtctctccaatgaataagaaaataaagtcaagctagtggcttctccttcgaat

SEQ ID NO: 238343 - DNA, 404 bp, Homo sapiens
tcactcaagtttaatgaccttcactaccagaagcccagaagcccagagttctagagttaactgcatcctacttgaccctggtgtggtattggccaacaaagaggcagcaggacaaagaacacacaatggagcttggggctcaacaacctgggatctggggccagactccactttgaaactttgggcaagttatttcacctctttcggcttttattccttcctctgtaaaattatcctctctccccaaaaataactgtttggtgaatcttaacctcttttatgattccgttacattttacaattcttccttcaagagagagctctgcacaagactctgagtaacaattgaagagatggatccaagcctcagttgggctgatgagagaacttccttggcctcccta

SEQ ID NO: 238344 - DNA, 286 bp, Homo sapiens
attgtgaacctgagattggccttttgagatgtcttttcaggtttttccatttctgacaagtggttggcctcacctggacctgccaaccagttctgtggcactcacccaggaactgactcagcataagaggatagcttcgactgcctatgagttcatcctcaagccaaccaatcggtgctcctggctcactggacccctacccaccaaattattcttaaaaaccctgatccctgagttttcttttcttttcttttctttttttaattatactttaagttctggcaaa

SEQ ID NO: 238345 - DNA, 505 bp, Homo sapiens
ttttttaagattatccaattccaagagaggagggggctggattggcaggacaatttgagatggtttggaggagggggaatacctaccttgacctccttctctcttttctgtccatgaatttgccttcctccaatcctgtgaccacttacgcctaaggccactcattccaaacaactagcttggtcagattccatgctgaccaacacaatggtgatcatctgggtggacagggggactacaacccaccctataaaggtctttgcctcctgtgaatctgagatttccctctcctagattacacatgtggaaggtagaagcttaggaaggaagaaaaaactgccttacttgagcatgcactaatgccaggcactgccctaggccttttacacttgccgactcatttacctttcatgaggacctttggaagaaggtgctattacctccattgaacaagtaggaaaactgaagttcagagatgataataaatttgaacttgcctgtaaaa

SEQ ID NO: 238346 - DNA, 443 bp, Homo sapiens
attttggcacatttttaaaggtaaagaaactcgaaaaatagcaggtgcatgaagagcactttgccctttgtgctgtttcttaggagagaagatgaaattccagtatgaaaggcactctgtactagaaggaaaggcaacatcctaagcttcaaagacaagaagtagaatactgtacagaacttgctaaaatttattatttaagtctccccacataatttagtcacacaatgtcaatttaattcttggacccagcagagaccctaacagaatggaggtgtaatttttctacccctagagtagagcatggtaccatgtatactatgtaatgttaatataatatatagttcatactctgtattgtgtctactaaatatagtatgttaatttggatgtatactatttatgtagtatatagttgattcaaataaatactgtttaatgat

SEQ ID NO: 238347 - DNA, 728 bp, Homo sapiens
tcagttagtttttttttttttatagatcctcaattgttgttagtgatcactgtcttccctggagaagttcagcctctttgcagaaggatcttccagtccacttaagcttggctgctgtctgctcttttggagttagatagaatgaagaaacactcagggcactcacacaaaccaaacataatcacacacatatgtctgatgactctggatttttggtttattttcttgagaagataaatgtctggacttccaaaatgaatgtgtcataaaggaattgcttgactgcctggcttggagtagagacttggggatttaattgcttattatacagactttgagataatattcctattttcagaccataacacacttcatcttctatggaacctactacttctaatagctgatggtgtctggattctactaagctaaaatagcttatttttattttcgagacagggtcttgctctgtcatccaggctggagtgcagtgggcatgattacaacttactgcagcctcaacctcctgggattacaggcatgagctaatgcatccagcctcactttctgttttgctggtagaatagtcattttgaggccaggtgcagtggctcatgcctgtaatcccagcactttgggaggccgagacaggtggattacttgaggtcaggagttcgagactagcctggccaacatggtgaaacctatctctactaaaaatacaaaat

SEQ ID NO: 238348 - DNA, 632 bp, Homo sapiens
tcagttagtttttttttttttatagatcctcaattgttgttagtgatcactgtcttccctggagaagttcagcctctttgcagaaggatcttccagtccacttaagcttggctgctgtctgctcttttggagttagatagaatgaagaaacactcagggcactcacacaaaccaaacataatcacacacatatgtctgatgactctggatttttggtttattttcttgagaagataaatgtctggacttccaaaatgaatgtgtcataaaggaattgcttgactgcctggcttggagtagagacttggggatttaattgcttattatacagactttgagataatattcctattttcagaccataacacacttcatcttctatggaacctactacttctaatagctgatggtgtctggattctactaagctaaaatagcttatttttattttcaagactccatctcaaaaagaaaaaaataacctagctgggcatggtggcgtgcacctgtaatcccagctactctggaggctgaggcaggagaatcacttgaacccagagggcggaggttgcagtgagctgagatcgcaccactgcattcacagccttggtgacacagcaagactccacttc

SEQ ID NO: 238349 - DNA, 564 bp, Homo sapiens
ataatttccataaattcctgagtgctcttggtttttatgtattctttacgttcttcttccttgaatcttatgacgtctctaaagagagctcgttggatgacaagtgatgaaaacaggaggtccttattcccattggcactgttagtttggctttcagtatccaccgtcttagtttttctggcagccattctgataatacctctatgtgtatagagaactatttcagacagttttcaaaacaatgataagctctataaccatgtcagtgtcccaaagtatctaaacatcgattacatttttcatgagcctagatttttctatagacaaagaaaagtttgccctctagtctttttttaatcaagctccagagctaacttatagtgagttgcttagaagtggaagaccctagtcattgcctgactctggggcccaagtagatcatgtgtgcatttgactgcaagccacttggggtcttaaacaactccaggtgtggactttctgtgtatagtcaagacattcttcccaaaatcttaaataaaattgcttgttgcccattaaatttta

SEQ ID NO: 238350 - DNA, 611 bp, Homo sapiens
ttctcctgcgtgctttccccgtgttcttctgcactgttatctttcctcttcatctgaggccatgtctttaccttatgtggtgctgatgtgggccggggaagctgtggcaggggcccgggaaccaccccagggggatgcagagggagtggaccctgtggggctcggccatggcagaattctgctctgattggctttagatcgtcgcctgtgacagcgtttcctccgaggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctga

SEQ ID NO: 238351 - DNA, 479 bp, Homo sapiens
tcttatctaatgtaggttcattcatttatctgttcatttaacaaagatctgagagctactacactcacaacttcctgcatgatctagttaccctgggaagtacagagtcgtaaatttggacatatttcagagtgaaagggatgctattaagaattactaagggacaacaggcgaaatcaggacatatggtcactatgctagggaaaatgtctgggataaggaaaaaaagtaaatagtcaccctttaaagctttttctgtgcccccactcatgtccacactcattcccccctattccagagtgtcagtctatgatgaaataagaagagtattatattccgtcaagaattaggaccaatcacattttggagaaggcattgtactgaagtaaatgtttttattgtctcatattaccatagtgggttaattttgtcagacacatgtggttgaaagtgaaaaagccccacaacaatcaaattga

SEQ ID NO: 238352 - DNA, 510 bp, Homo sapiens
agtcacggtgcagctgggaacactcacgtctctagaatcaggataacttgttccaaaccgcctttcccaggacagcatgaaaggacttgatgtctttttgcctcagacaataggatgtttttccttagccaaggtctaggggttgagcaatctcctcggaggaaggataaaggggtgggcagtgtttgaccatgcttctccctggtgtgcacatcctctgtgcacatctgctctgagaagtgtggaagacacagaccatttttccaagtctcccaaggggcttgggagcagtgagactattgcagaataagtaagaaaagcatttctgaggatttggccttagttggctaaagaaaattttcttggggacccaaaatattaacttcttattctaactagcattccccatttatttaagatggctttgtaagattgatttcaggtgattacatcaattcaacgagaatgtagaaaaaaatttcatttaaagggctctggaaaaaaagttac

SEQ ID NO: 238353 - DNA, 173 bp, Homo sapiens
atattagacctttgtcagcagcacagtttgaaaatattttctcccagtctggagagaactcccagttgcagttgcttgtgaggacttcgccaaaaattctttgccaaggccaatgtcaagaagggtatttcccaggttttcttctaggatttttaatagtttgaggtcttaca

SEQ ID NO: 238354 - DNA, 527 bp, Homo sapiens
caaaagaactggttcaaaaacaagataaagaattccacacgccagaaacacagcaaaagcgcaaaacgtgggacgagaatgaagctgtgggcttgttgcatgtggggcctggcaatcgggctgagagttcagctgctgtgggctgaaggggtctgaataaactccagcatagaggggacagggccagctcactgcttcctcccgtttcatgcaaaccagcaaacagagacaaaggcaaactgccgctgctgtgcacctgggctatggcttcgagaacaaacgactaaggagatggaaactcaccaagccaaacccacttcatgggttctgaacagggtctgtgtgatcttcctaggttacccaggccagagtcccaaactgccattcgaagatcagaccgtagaagtgtggatgccccgatggacaggagcgggtagctgcagaagcattaggcaggaaagagcaaaggagcacagtgaatttgtgaattgatcatgtctctgctccaaataaagaaacaaactaca

SEQ ID NO: 238355 - DNA, 971 bp, Homo sapiens
caaaagaactggttcaaaaacaagataaagaattccacacgccagaaacacagcaaaagcgcaaaacgtgggacgagaatgaagctgtgggcttgttgcatgtggggcctggcaatcgggctgagagttcagctgctgtgggctgaaggggtctgaataaactccagcatagaggggacagggccagctcactgcttcctcccgtttcatgcaaaccagcaaacagagacaaaggcaaactgccgctgctgtgcacctgggctatggcttcgagaacaaacgactaaggagatggaaactcaccaagccaaacccacttcatgggttctgaacagggtctgtgtgatcttcctaggttacccaggccagagtcccaaactgccattcgaagatcagaccgtagaagtgtggatgccccgatggacaggagcgggtagctgcagaagcattaggcaggaaagagcaaaggagcacaggagagccggtgaaagagcagctccttaggcaacatgtttgcctcctcctgtttccatggaagacatcacaggggtgggtctctcacctgctggcctttgctgtaaagggatcgggtggcaagtgagcctcttcactgaggccccagatgttactgttcggggctgtctattccagggtgactggtttctctagagatgactcctccggtctcctgcctggggaggaggacgtgcctgagccagggtacgcctgcatgtagatttcctggggacagacagcaggaaggaaccgagctttcagagcccaggcccccagccttaccttttctcctgctttcctcccctgctccttctcccagcctgcagctttgactcaggtcctcagtcttggagcttgactccatctctcgtctcctgcagctgggagcgggcaggtagccaggctgtgtggggcttggagaggacctgggtgtcccacccttttgtagagaaact

SEQ ID NO: 238356 - DNA, 522 bp, Homo sapiens
ccacctccttaagccagaattattgaatgttctctatgtgccagaattattattatctcatttgattctcacaacaatgccatgaagtctatacagacataccttggaaatacagcgggtttggttccagaccaccgcaataaagctaataccgcaataaaatgggtcacacgaattttttggattaggcttcggcttaagggaatgttgtggctggtttgatgttttatccagaccgctaacactttctccctatcagcaatgaggctgttttgctttcttatcattcctgtgttcactggagtagcacttttaatttccttcaagaacttttcctttgcattcataacttggctaactgtttggcacaagaggcctgcctagcttttggcctatctaagcttttgacttgccttcctcactgagcttaatcatctctagccttggatttaacgtggaaaattggcctaattcaatattattgtgtctcagggaacagggaggcccagagagagagagacg

SEQ ID NO: 238357 - DNA, 667 bp, Homo sapiens
  misc_feature (638)..(638): n is a, c, g, or t
acaaatataagctgcagtttgggagaaaaacagtggaaatcaccaatatgacaaagggcatgtgtgatagttacttgtacttgtcactgtgaccgagcaccagggtgccaggacatttggccaaacatgattctggttgtgttccagagagtctttcagatacgattaacattgggatgggcagactaagtgaagcagattgccctccttaataggggtgggcctcatgcaatcaatcaagggccaggagagaattaagaggcctaatgggaaacaaatgctttcctgggtatccagctttccttccatcttgggaatttcagcctccataatctcagaagcaaattcatgttacaagttcagccatgagattggtgaagccagccaatgaataagggtgtgttctattatacgattcagtcttcttttgtaaacgattgaagttctgcatttgaagtaggaggataggagggagcaagtccacctaggatgataacagctgaatttctcaacatacacttcagagccgtaggggtcaacttagagactcaaaaatctcacccataatcctgcccctaaacaccagggctagggaacactgtggccctcaggtgattttctaccaccaacaccccccntccaccccccccccgcacccgccctgcct

SEQ ID NO: 238358 - DNA, 295 bp, Homo sapiens
ttacaagttcagccatgagattggtgaagccagccaatgaataagggtgtgttctattatacgattcagtcttcttttgtaaacgattgaagttctgcatttgaagtaggaggataggagggagcaagtccacctaggatgataacagctgaatttctcaacatacacttcagagccgtaggggtcaacttagagactcaaaaatctcacccataatcctgcccctaaacaccagggctagggaacactgtggccctcaggtgattttctttagccaggtctgggagccacacga

SEQ ID NO: 238359 - DNA, 359 bp, Homo sapiens
aaaatggaagggtaccactatttgcagatgaaatcgtatttctggaaagtcaaggtaacagggtgaaatagctctgggattactgagaagtcttaataaagtgtctggatataagataaatatactttttttggacaaaataaatagtacatccttaatagcagtacaaaatattaaaacaaaaatatgaaatttgtatgatcaatctttacaaaatatgcacagacctgtataaatttaatactgggataaaaggaagacaaataaatgggaaactacatttctgggtgaagagacaaagcactaaaaatatgttctttataaattacttcctagttttaatgaaattccaataaaat

SEQ ID NO: 238360 - DNA, 353 bp, Homo sapiens
tgatattactggcagtaataacagtttcaccaaagtgaagggatgtaactttgataatttaggagtgttctcaatcaggcctcaacaccctcctagatggaattgtctttaaaactggtgctggaagttgataaaatcaaggctttatttttactgtaaaggttctgatgggccttgttctaaactctttgtaaactataaatcactattagaattttgtttagagtctgaaactgcctttatcgttttgaatttttagagccgggggctgaatttcctgttcgtgtacaacatgtagctcttattctaggaaaaactccagtgacattcttgttcagtaaagtgaagtaggc

SEQ ID NO: 238361 - DNA, 366 bp, Homo sapiens
caaatcaacatttcccattccagccaagatgcgcacacaccaaaacacaggcactagtcactctgctcactgccgaagtttgacgtggtgaggctgacacttgttcctgttggtctctagcaccactgatgcactcaaggcggggaggaatgagctccactggaagttcagtaggtggtccccaggaaggatggaagagcagatggtcactctgagttaggctagtggagcttccagtagcaattccttcagggctcaccaaatgttactagccatacaaaaaaagatagttccctgaattaggcctgctgagcttctgctagtaattccttcaggggatttcctccatggccgtaagtatgcata

SEQ ID NO: 238362 - DNA, 507 bp, Homo sapiens
ttcaatcttgtatattgttataatatatgattttaccacactttattgggtattctcctgtggatgggctttgaggttgtttctcttttttgctgttacaaacaatgtggctatgaacatttttgtatctacttgtgcacatgggcaatagtttctttaggattaaactaaggagtagcattgttaggtcaaaggatatgcatgtcttttactttacttttcaccagatgtcaaattatttagaaaattttaaaaccatcaattttatagttggtatatagctctgggcctcatccaccttcaaaattataatcttcaaaatagcaagattgttaatatttgtaattttatattatattgttagtatatatggcaataaataaaacataccttaatttcttgaatattatggtagagaaaaacgtttgaatcagagcccttgatttttcacttctaaattgaattggtccaaataaatttattcagcattcatttttttttcactta

SEQ ID NO: 238363 - DNA, 353 bp, Homo sapiens
catggcacccagccggtttatgattgctaagagaagccagaaatgtgtatatttatttgaaacctctttgttgttaggtttaagtaactattttaatcacaaaaaacatctgccagcatccagtgtgttcgtgcccctcgcagtcacaggccttccccgcactgtcctggcttctgatacgacatgttagctttacctgtttttgttttgctttttcttttttgagacggagtctcgccctgttgccaggctggagttcagtggtgcgatctccactcactgcaacctccgtctcccgggttcaagtgattatcctgcctcagccacctgagtagctgggattacaggcacgc

SEQ ID NO: 238364 - DNA, 671 bp, Homo sapiens
  misc_feature (520)..(520): n is a, c, g, or t
attaaacattttttaatcaaaaaaataaagtttcaaagactcttaaaacatactaaccaatcacaaagtgtagattttacttagatcctaattcaaacaaactaaaagcaaattaggctatttatgaaaccactggaatctggacattgaatgtttgataacaccaaggaaatttttaaagtttagttttgacaatagtattgtggttgtagtaaaaagaaaagtctttatcttttaagaaaaaaacatatgtcagtcctattcaaactgttctgaaaaatagaggaggagggaatacttccaaactcattttacaaagccaggaatatcctgatacaaaaaccaggcaaagacacatcataaaaaagaaaactacaggcctatatccctgatgaacaccgatgcaaaaatcgtcaaggaaatactagcaaaccacattcaacaatacattaaaaaagatcattctttatgagcaagtggaatgtattccaggtatgcaaggatgatttaacatacacanatcaatcaatgtagtacgtcatatcaacagaataaaggacaaaagccagtatcattcaattgatactgaaaaagcatttgataaattcaacatcccttcatgataaaaactctcaaaaactaagtataaaagggacagacctcaatataat

SEQ ID NO: 238365 - DNA, 359 bp, Homo sapiens
tttgagacagaatattgttgtttctcccagtttggtttacaacggcgccatctcagctcactgcaacctccgcctcctgagttcaaggaattatcctgcctcagcctccctagtagctgggattacaggcacatgccaccacgcccagctaatttttgtattgttggtagggacagggtttcaccatgttggccaggctggtctcaaactcctgacgtcaagtgatccgcctgcctcggcctcccaaagtgctgggattacaggcacgagccactgtgcccagccactgcagcaattttaaagtggaattgagcgtcttttttgtcttgtagaaaaaggacaactagctgaagagatta

SEQ ID NO: 238366 - DNA, 676 bp, Homo sapiens
ggcaaactaaggaaatcagcccaaccaatccagtctttgcctgctgacatgagaactgacaaggcaacatggccctggagatgacagcatgcaagaaaagaaagctggtttgagggactgattaagagcatgtgttgtttgggggtgtgcgaaatcggttctctattgtatagcattttaggatgattgtgtgactacagagcaggtttaaatcttaggcaagaggtacagtgttgaggcactatccactagagaggggagcatgaggatgcaaaatagtgcaatagtatgtgcattgtgcagaaaaaaataataattctttaaattttatgctagtttccaaattatagaaatttggaaacacttcagatgctttctgcttttaacaagatggaaacagtttcgtaagtgttttaagtgtaataatatttgctccactgaagggtaaccctccaagggttttcatcgtgagcaccttcccataggctgagaattagagcacagattttcatggtgtctgtttagaataattttgataaagctaagaccttacagaggcaataagatttgcctctttagtagaacaatggaaatggaactttaatacagcatgtagatccgattgctgcttttatacatgtagacaatctgactatggtacatggtgtgctttggg

SEQ ID NO: 238367 - DNA, 404 bp, Homo sapiens
aatatatgctgcacaaccgacttttatcattaggagctcaacagcctcatacatagaaacaaagaagagccttgaaagcaggtgacagggagaagccagagcctgagtggtcctttccaaatggcaagcatcctgttaatgagaaggcccctgatgactatcactatgagaaaagttcaagaagacgaacaggcagtactgagatgtgtagaatggaatgtaaataccagttctttctctctccatccctttcatggaaaaatgcttcctggatagaagcatgctcatttgccattagacagttccaaaaacagactttcttactcctgctgcttacctgctggatttttcaagcactaaatttgtaactttttgaaataaagcagtgcatagatttcctattt

SEQ ID NO: 238368 - DNA, 209 bp, Homo sapiens
gataatatctcattttttaaagtgagaaaacggagacagtttcagtactgtcctgagatcacataatcagaaagtggtagagtcagtacttaactctgggtgtctgattttcagtattgtgttctgtctactatatcatgctgtctgtaggcaaaattcctaatttgtgtaatttttataatgtaataaagttataattttataactat

SEQ ID NO: 238369 - DNA, 456 bp, Homo sapiens
gtagacagagctatcacataataatgaaattaacaggtaccatgtattaaaatagggcgtcatttatgtatgaagacaacctgcctggtcgtctcagtcatccttttttaagaaaattgttttgttttaccttttccctagtgttcccccttgccccacaagaatgtatgaaaaacagtacatatttacagaagagaagattataatggtgttacaatagatgatcactgaagaaatcaaagctaactggctcatccaggatctatgacctatattttgttcaacagaatattttcttttgatacctccattgtcatttttacaaaattaactaggaataacttgggaggctgaggcaggagattcgcttgagcccaggaagtcaagactacagagagccgtgattataccgttgtcctccagcttgggtgacagagcaaggctctgtctcaaaaa

SEQ ID NO: 238370 - DNA, 344 bp, Homo sapiens
ctctttttgcttgcatggtttctgaagagaaagtttgatctaattctttatttctctgtggataagatgttttctgtgtgtgttgatttttttctttacctcttgcttctttcgagatatcttattggtcttaaagttaataaggaaaaaactaaagttttgcttttgatttagttttctctttgtcttattttctgcagcttcactatcatttgcctatgtaaatattttggtatttatcttgcttggtgttctctgaacttccaggtttggtgtttcttactaaagacattctttcctgttacagtgttattgatttgtacactccccttcctcgcctcccc

SEQ ID NO: 238371 - DNA, 483 bp, Homo sapiens
agccacgccatgtccctaaccagtgggctttaggggtaagcctgtggctgcatgtttgaaggagccccacagtgggcctgggggacagaggctgcatgtctctccggagtgggctctttctggccatgactgtggctcacacactcatgatgtaggcagcccctgctctgggcgagtagggtctgtggggcccagcgaccaccaaagctcacaccagagctcacccacagctgggaggaccaactcctgcctcagcagtgccgccagaatctctgcgtgggtgcgagggtgctgggcactgggccaacctggcgaagactggcattctgactgaggttaaaggcgatttgaagaaagaggagctgaggggatgaaagaaccatcagaaaacccctgtgtgtctcattctgctttggagtggggtcccctgcagagccccgggtgctgcatgggccgggcggactccagggaagtccaggcgag

SEQ ID NO: 238372 - DNA, 499 bp, Homo sapiens
agaactcaggaaagtgccctacttacaattacagctttattatagaggctgcaactcagaaacagccaagtggaagagaggcatacagaaggtatgggggtgcatcacggggcatggagctttcatgccctctgtggatacaccagcctcccagcacttcagtgcgtttaccaactgggaaacacctcaaccccatcatttagacgtttctatggaggctccattatataggccatcactggccactggtgactgaactcagcctgcagcccctctcccttccttagaggctggaagatggagctgaaggttccaaccctccaagcatggccagcgctgccttgaaaccatctaatgacccacctgagtcaccacattaggggttcattataaatgacaaaagccactcttgttactccagaaatcccaaggcttttaagaaatctgggccaaaaactagggacaaaaatcaaatatatatatattgcaattttatata

SEQ ID NO: 238373 - DNA, 195 bp, Homo sapiens
gtattcctcttttgagggggcagaggaatggagtggcatgctgtatatttagttatcttacagttgttcttaaaatgtgacagccagatctttgaccaaaaagagaaaacagattcttggctctcctcatttttgaagacacatttttccctcttcattgttatgtatagagacttaaaacaagtttatttaggc

SEQ ID NO: 238374 - DNA, 648 bp, Homo sapiens
gccctctactactaacttgaccaaaaatgaatttaaaattgcctgtgaaataacatcctctcaaatgtttgctgatgaaattcaagttgaaatgtattcattgcaaaagtctataaacctgtggattatatattcaaaataagacaaaggcaaataaaaagcagctgtcttcatgaatagacaaaagttgctttcaggaagtataaattatattctgcactgaccaaagaatagaagttattgcatctgtggaacatatatctggagttactatactaaagagcagggcatgaatttagactaaaatccatccagattacactcattctttaggccactgctggatacttcatttacatttgattcttggctgggcacggtggctcatgcctgtagtcccagcactttgggaggctgaggtgggtggatcacctgaggtcaggagttcgagaccagcctggccaacatggtgaaaccccgtctctactaaaaatacaaaaattagccgggcatggtggtgggctcctgtaatcccagctacttgggacctgaggcagaagaatcacctgaacctgggaggcggagactgcagtgagccaagatcatgccattacactgcagcctgggtgcagagcgagactccgtttc

SEQ ID NO: 238375 - DNA, 865 bp, Homo sapiens
aaaatacaaaacaaaattagccaggcgtggtggcgagtgcctgtagtcccagctactcaggaggctgagggaggagaatggcgtgaacccgggaggcggagcttgcagtgagccgagattgcgccactgcactccagcctgggcaagagcaagactccgtctcaaaataaataaataaataaatacatacatacataaaaatgtctcctcagacaattctcaagggcagacaggtttgggaaccaccataaccactagtaagaagatagaggggattaagataaaaaatgtcagaaaagactgaaagagcagtgagtatttagcttatataataatttcattaatatttgaaagtctgtgtttcgtaaagcctgttctatggggtcctcagaggtaagaactaagattaattggaattagctccaggaagaaagatttcaattcaacaaaagaggaaatttccaatgaaaacaataaaaatcacgtatttatgcagtgtctgtgatgtcgagacactacactaagtaccttacacattttaatcctcacagagaagaaatgcttttcaaaagaagacatacacatggacaacaagcatatgaaaaaatgctcaacatcaggaatcattagagaaatgcaaatcaaaaccacaatgaaatgccatctcacatcagtcagaatggctattattaaaaagtcaaaaaacaacagatgctggggaggttgtggagaaaagaacattcatacactgctggtgggagtgtaaagtagttcaaccattgtggaaagcagtttggcgatttctcaaagaactcaaaacagaaaggaatatatatcacactatattcatactatattcacacta

SEQ ID NO: 238376 - DNA, 486 bp, Homo sapiens
  misc_feature (116)..(116): n is a, c, g, or t
gtcgaccggctgcgagaagtcgacagagggggagtttactttgttttcatgtagacataagttttcaatatctttgggtaaatgccgaggaatgtgattgctggattgtatgatanagagtatgcttagttttgggagaaactgcccagctgtctttcaaagtggctgttccattttacattcccacgagcaatgaatgagagctcctgttgctccacatcttcaatatttggtattgtcagtgttctggatttgggtcattctaatagggtgggccctaatccaatctgtcattataagaagaggaaatttggacacaaaaagagacaccaggggcgtatgtacacagagaaaagatcacgtgaggacacagagaggtctgcaaaccaagaagagaagcctcagaagaaacaaaaccagccaaccccttgatcttggacttgtagcttccagaattgtgaggaaataaatttctgttttaaagcc

SEQ ID NO: 238377 - DNA, 1527 bp, Homo sapiens
  misc_feature (724)..(724): n is a, c, g, or t
aattaaatggccacaagtgcctggtggtccctttgttggtccacacagatctgcctgccttgggagaggtatctggggctgactggtgggtgttccattgcagaaagcttctgagacacacagaagtcgccacagttgggagacgtgatacccgcagtgctgcagtcctgcttgccttgttgttgttctctcaacttctacattagagacttagttatgatgagtgtggccgcccttaggaaggcatgttatatactcacttaaatgcctcagcccccttttttaaaatactttgttcagtggttaatggcatagactagagctagactgcaagagtttgagccttaactctatcccatgttagctgtgaccttgggcaggtcgcctaatctctctgtgccttagtgtcctcaccttcaaattaagataatacaggcttgttatgaggattaaatgagttaatatttataatgcacttaacacttaaaatgttcttgttctttgtaattgtttttcaagatgaagtgtgtaactaataaagtgaggggggattaacagcgaggactggcttgccaccaacagagcaaatctttagattcatattcaactcaagcctcccagtttcaaccctgtatacaactgtccagagtctgtacatggaggcacgcagccacgtggccgagaggagccgctgggcaggacaagcacgtgggcggctgccgtntgtccctgagccctcagagctgcccctagcagtgctgttggacagcaggaatgttgagttaaagactcacatgcactttaaaatttgagcagatagaaatgtcagtggggactgcctctgtctgtgcttaggttctccactgtacgaggagcagagctgtgcgcctaggaggtcctcagtagtcctggcagtctggctgactgcgcacagcgaggggtggggactgaggaagcacaggctgctttcctgagtgcagggtcctccgtctgttaaggctccagttgtcctttgtcttcaggtgcctcaacataatttagtatttcttgactctccagtggtgtttcctgccaaaagcaaatttggtgtttctgcttcacctgtgtgttctttggctctaaataggttttcttttcctggtgaacaatatgggctagaaggagcagctgtggctgatgctctggactgaactttctcatgaaaagcagcttgaaagaaggttggttggttcagggagcactaaatcaaagctgagagcttcttctagcccgcgtgctgtgggcaccgcagccccaggcatcatgctgttggcttatgattggagatcgcagactgccgaggtataaggacagcagaggggccacatggtggtcttcattcagggacattttactcttcatcacactgttttgcctagaaacagattatttaaattggaagagaccaaaaaaattataataccagaatttaaaaactcctctggccttttggaaaaattgccgtaaaaactctgatctatatagtgc

SEQ ID NO: 238378 - DNA, 461 bp, Homo sapiens
tgacagacatgcatgtttagaaaaatttgataaaattaagcctctgaccaggggttctttaactctgtaaggcatagaattctggagttttggcaagcaaaaaagaggtttcgaccctttgaaacctgggaactcacatttcctgctttgaaagggagcatacagctctcactactactttatgcaaaagctttagaaattctaactgtgtgcacacctgttctgttagcagtttagtttcttcacatttatttttattccaaattctaagacatgctctccatttcagattttatttgctgttagttcttccatcggtccatgcagatttagcccacaacatagctgtaggttagtcaggggaatggtctaagttgcctaaccaaagtcagggaagatttattctgcttttacctttaaatggaagagttcatgttaaatgagaatgatgtctagttggg

SEQ ID NO: 238379 - DNA, 161 bp, Homo sapiens
aaaaatctatggagcaaatggaaaacagaaagaagcaggagctgccattgtagtttcagaaggaaaaaaaacaaacaaactttaaaacacaatgatcaagaaggataaagaagggctttacgtaatggtaaaaggttcgactcaacaagaaaatctaacta

SEQ ID NO: 238380 - DNA, 446 bp, Homo sapiens
gagatttgcatctgagaaactaagccctggtcatcatggggaagtggaagggtatgtgctcatgctggggccctcactttggggcttaaggatctgggaagctggctagactctcagggctggtctttgtcacccttaagtcccccaaagaagggttgtccctttcaggccctctactatacagccataactccttagatgccccccagggcagagccagctcttatccctcacactggatcttttacttggcccagctccctctcccctccaccccagggcactcacctcttgtgcagccccctgggtccatagccctgcaaccttggtgacattaccctgcccacacccccctacccagagagcctacagaatgcagaccacttgcctcccataactgctgttacgtctcatccacctcttctgcgccgtcctcgctggaggaa

SEQ ID NO: 238381 - DNA, 590 bp, Homo sapiens
aaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccataactgctgttacgtctcatccacctcttctgcgccgtcctcgctggaggaa

SEQ ID NO: 238382 - DNA, 587 bp, Homo sapiens
tcatcttgtccctggttcggatttgggctctgttcccccaaggccctttttcctaaggcccttttcccgaagccccattttccaaaggcccattttccaaagccatctctacaaaaaattaaaaaaaaaaaaaaaaaaaaaaagccaggtatgatggtgcccacctgtagtcagagctacttgggaagctgaggtgggaggatcgattgagcccaggaggtcgaggctgcaacaagctatgatcatgccattctactccaactggggcgacagagcaagattctgtctcaaaaaataaaactttcatcctcctcactgctggtggtctcttactggtcctttggaaccagccagatgtatatgtcttcctaattagattattagcttctcaagggcaatatattaatctatatattggcttctgatactggcacatggtacttagtatttttgaatgaatgagagtgatgaaatttggattgtcatactttccctgataagtataagcttttaaatcaagattttatcgaagtattttgagatctgttcttatattaagaaatgaatcttctacccaccatcctgta

SEQ ID NO: 238383 - DNA, 878 bp, Homo sapiens
aagtcaagacttttgggctttatcagtagataaacatgagccataggttttctagcaatagaatattttaacctatatgaatatatgctttataggtgagactgctatttaatgagagttttaaagtaactaaaccttgttgacagaattcaggatggaaagttttaccctaaataaaacttcaggatattgaatatgatagcaaagttccagggtatgttttatatttatgaacaattttcatttgaatatttggagcttgggggttttggtgagacatgttcatgtatgttatatacaaactttcaggcctggcatggtggctcacacctgtaatcccaacacttcaggaggctgaggcaggaggatcgcttaagcccaagagttcaagacccatctctacaaaaaattaaaaaaaaaaaaaaaaaaaaaaagccaggtatgatggtgcccacctgtagtcagagctacttgggaagctgaggtgggaggatcgattgagcccaggaggtcgaggctgcaacaagctatgatcatgccattctactccaactggggcgacagagcaagattctgtctcaaaaaataaaactttcatcctcctcactgctggtggtctcttactggtcctttggaaccagccagatgtatatgtcttcctaattagattattagcttctcaagggcaatatattaatctatatattggcttctgatactggcacatggtacttagtatttttgaatgaatgagagtgatgaaatttggattgtcatactttccctgataagtataagcttttaaatcaagattttatcgaagtattttgagatctgttcttatattaagaaatgaatcttctacccaccatcctgta

SEQ ID NO: 238384 - DNA, 743 bp, Homo sapiens
tatgtgttcaaaatcattcgttataaggtagatgcaaattaaaaccacaatcaagaaccagtccacatgcaatataagggctaaaatttagaaaaagaacaagataatactaaatattggcaagattgtgaagcaagtgccatacttttctggagggaatgtaaaatgtttcaatgactttgaagaacattttggtaatttctgtaaagttaaatgtatagttaccatatgactcagcaaatctactgcttaatatttacccaagaggaaaaaaaaaacaaaacacctatgtttacaaaacggttcaccgaaacttcattcatcactgcccaaaactggaaataacccaaacgtatacagataggtgaacgaataaacaaactgcatattcatacagtgaaattctactcagcaataaaaggaataaactattcatatatacaacaacatggatgaatctcaaaaatattatgcttacctaaagaagccagacacaagggagtatgtactgtatgactccttttatatgacatttgtgaactaatctccagtgatagacttcaggtcacttgttaccctaagtgagagacagttagactgactagttaaaggcacaagataacttccttgggagatagaaatactttgtatctttttgggatcatggttatttcaaaagactttggattttacatgtatcatggatactttttatttcatgaaaattatacttacaatgttga

SEQ ID NO: 238385 - DNA, 441 bp, Homo sapiens
tacctcggaaatttctcagttgactggatcctttctcttcctcttctccaacccctgctgactgtatgctccactactatgacaccaattctgtccactttcttccttattgatatgaatatactaactttaagccctctgcctccaatgggttcagtttttgagaaattcagaaaccccaaaagcaaccacgtgtggccaaagccattttctccatcaaattatatgttagaacaaaatattatattaagagtcctccataatattagaggaaagttttcaccctcatttaagcagataaccttaatatgtccaatcttccagagaaagaattctaataaaaatgtaaagtgggaacagatgagaaccaacttttatacaaattagtaagttttatgcttttgtatttgtacctaactcattactaaaatttttaagtga

SEQ ID NO: 238386 - DNA, 807 bp, Homo sapiens
gaggatcacgatgtccgtcctcaggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctaccttttttgttttttttctttgagacagggtctcacccaggctggagtgcagtggtacaatcacggcttacgcattcttgacctcccaggctcaggcgaccctctcagctcagcctcccaagtagtgggaattacaggcacgtgccaccatacctggcttatttttatagagatggggttttgctgtgttgcctagactagactggtctcgaattcctggactcaagcagttaacccgcctcagcctcccaaagtgctgggatta

SEQ ID NO: 238387 - DNA, 963 bp, Homo sapiens
tgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctacaaaaatcagccaggtgtggtggcgggcacctgtactcccagctactcaggaggctcaggcaggagaatcacttgaacctgggaggtggaggttgcagagagccaagatcgagccacttcactccagcctgggcgacagagtgagactccatctc

SEQ ID NO: 238388 - DNA, 1073 bp, Homo sapiens
tgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctaccttttttgttttttttctttgagacagggtctcacccaggctggagtgcagtggtacaatcacggcttacgcattcttgacctcccaggctcaggcgaccctctcagctcagcctcccaagtagtgggaattacaggcacgtgccaccatacctggcttatttttatagagatggggttttgctgtgttgcctagactagactggtctcgaattcctggactcaagcagttaacccgcctcagcctcccaaagtgctgggatta

SEQ ID NO: 238389 - DNA, 378 bp, Homo sapiens
gtagtcccagctacttgggaggctgaggcaggagaatcacttgaacccacgagacagaggtttcagtgagccgagatgatgccatttactccagcccgggtgacggagcaagactctgtctgaaaaacaaacgaacaaacaaaaactaaaccatcagatcttgtgagaattcactcactatcatgagaaagcatgggagtaaccacccccaagattcaatcacctcccactgggtccctcccacgacaaatggggattatgggaactacaattcgagatgagatttgggtggggacacagccaaaccatatcaagcatgatcacaaatatttatctgatttccttccccaaaccccaatggaatgatagtaaagaaca

SEQ ID NO: 238390 - DNA, 440 bp, Homo sapiens
gccctctgcactcagccaacagaatttgacagaagtctgagctttctggtgccaggtcacaaaaaaacctcccacctatgctcctggaacactagcccttcagatgccccctcacagaagccagcctctgtgtcatgggaagcccaggccagactgaggagccacatgtggacccttcagcccaccaacagcaactgctgttcacacgggtggccgtgttgaacatcagcacagttccacctccagacggctctatgcagtctgcaggaaaatgaaggaacacaggaattctcagcagatgcaggtcaagaacaccttcttccatgttcagtcccaccttggcagaaatctgcaacatcctggaaaggacagatgttgcattccattaaaagtgggagcgaaacccactttatttttttttattttttttatttttattt

SEQ ID NO: 238391 - DNA, 2783 bp, Homo sapiens
  misc_feature (780)..(780): n is a, c, g, or t
  misc_feature (1366)..(1367): n is a, c, g, or t
  misc_feature (1384)..(1384): n is a, c, g, or t
  misc_feature (1387)..(1388): n is a, c, g, or t
  misc_feature (1401)..(1401): n is a, c, g, or t
  misc_feature (1407)..(1407): n is a, c, g, or t
  misc_feature (1436)..(1436): n is a, c, g, or t
  misc_feature (1459)..(1459): n is a, c, g, or t
  misc_feature (1461)..(1461): n is a, c, g, or t
  misc_feature (1471)..(1471): n is a, c, g, or t
  misc_feature (1508)..(1509): n is a, c, g, or t
  misc_feature (1512)..(1512): n is a, c, g, or t
  misc_feature (1921)..(1921): n is a, c, g, or t
  misc_feature (1923)..(1923): n is a, c, g, or t
  misc_feature (1932)..(1932): n is a, c, g, or t
  misc_feature (1937)..(1938): n is a, c, g, or t
  misc_feature (1941)..(1941): n is a, c, g, or t
  misc_feature (1952)..(1953): n is a, c, g, or t
  misc_feature (1957)..(1957): n is a, c, g, or t
  misc_feature (1965)..(1965): n is a, c, g, or t
  misc_feature (1968)..(1968): n is a, c, g, or t
  misc_feature (1976)..(1976): n is a, c, g, or t
  misc_feature (1980)..(1980): n is a, c, g, or t
  misc_feature (1986)..(1986): n is a, c, g, or t
  misc_feature (1989)..(1990): n is a, c, g, or t
  misc_feature (1995)..(1995): n is a, c, g, or t
  misc_feature (1997)..(1997): n is a, c, g, or t
  misc_feature (2013)..(2013): n is a, c, g, or t
  misc_feature (2018)..(2018): n is a, c, g, or t
  misc_feature (2020)..(2021): n is a, c, g, or t
  misc_feature (2031)..(2031): n is a, c, g, or t
  misc_feature (2039)..(2039): n is a, c, g, or t
  misc_feature (2057)..(2057): n is a, c, g, or t
  misc_feature (2073)..(2075): n is a, c, g, or t
  misc_feature (2083)..(2083): n is a, c, g, or t
  misc_feature (2085)..(2085): n is a, c, g, or t
  misc_feature (2088)..(2088): n is a, c, g, or t
  misc_feature (2100)..(2100): n is a, c, g, or t
  misc_feature (2102)..(2102): n is a, c, g, or t
  misc_feature (2112)..(2112): n is a, c, g, or t
  misc_feature (2115)..(2115): n is a, c, g, or t
  misc_feature (2123)..(2123): n is a, c, g, or t
  misc_feature (2133)..(2133): n is a, c, g, or t
  misc_feature (2137)..(2137): n is a, c, g, or t
  misc_feature (2140)..(2140): n is a, c, g, or t
  misc_feature (2145)..(2145): n is a, c, g, or t
  misc_feature (2153)..(2153): n is a, c, g, or t
  misc_feature (2171)..(2171): n is a, c, g, or t
  misc_feature (2177)..(2177): n is a, c, g, or t
  misc_feature (2180)..(2180): n is a, c, g, or t
  misc_feature (2201)..(2201): n is a, c, g, or t
  misc_feature (2204)..(2204): n is a, c, g, or t
  misc_feature (2206)..(2206): n is a, c, g, or t
aaatataccttggaattttccaactctgtgctttgctcctttggccccaccctgaccactttctccaaaagcaaaagtagagtgacgtacctttcaaagtccaccaagtttactttgtttataaagccactgtgcccagcctaggaaaaaagttttttaaaattaagactctatatgtacacatttcactgtttcagaaaagtgaaatgcagtttataaggaattttctgttgccattcagaataacaaaatattcttagatcttttcaacctaaaatgagtagtccattttaataattattctacctaccaatatcactttccatgtaatagaaataaattgaaattcataggtagaagctttacgtttagactttattttcatttgaattgacttgaatgtaaggccagagatttttgcaagttggattctttgactaaggattcaaaatattgatagcttttagcagtttgagtggcagtagggattggaaatgtcatctaactcttttgccattccaccagaagagggcagcaaagcaaaccaagaggaaatttatgggtcaaaaaatttagaaaagtcactcgaaattcagagagcttagtacaaaagcttgtttgggtggcttcagtgtttgggagtgtatatgaagtccctactgccagaggccccatagaccattttgcaagaggcttgagcaaatcttaaagcttaaatatatgttcctgcagactgaggcctgtcaaataaaaatcattgaccttgttgaatgctttccntgtgctagacactgctaatctctgtatacatatttattcaaacttcacaaaaacctcatgaggtagactgtcttatgaatgaatctgaaaaatacagactttagataatgtttataaagtcacacaaagtagtacaaagccacaatttaaatctagctcctattctaaaatcctcactcttaactactgaccctattatatgcttctacatttcagagaagataggaatacaggctttaatggataagaaacatatgtgctagttaactcagttgaaaaaggggctagttaagtcaagggtcactgataagctttattttattttatgatttatttatttatttgaaacagtcttgctctggcgcccatgctggagtgcagcggcatgatctgtggtcactgtaacctctgcctcccaggttcaagtgattctcctgtctcagcctcccaagtagctgggagtacagacgcctgacaccatacccggctaatttttgtatttttagtagagacagggtttcaccatgttggccaggctggtctccaactcctcacctcaagtgatatacccgcttcatcctcccannagctgggattacaggcntgnnccaccacgcccgnctaatntttgtatttttagtagagacggggtttcnccatgttggtcaggctggtctcnanctcctgaccncaggtgatccgcccacctcagcctcccaaagtgctgnnatnacaggtgtgagcaactgcgcccagcctgaatcatttcttataccttctgacagcccaactttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactntnatttttttnttttnnttntttgagacagnntctnactctgtngcncaggctgnagtncagtgntgnnatctngnctcactgcaacctccncctcncnngttcaagtgnttctcctncctcagcctcccaagtanctgggattacaggcannnaccaccangnccngctaattttgtntntttagtaganacngggtttcnccatgttggncagnctnttctngaactccngacctcaggtgatctgcncgcctnggnctcccaaagtgctgggattanagncntgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaatag

SEQ ID NO: 238392 - DNA, 750 bp, Homo sapiens
gctcggtacccctccttccctggaggccagacggggaaagggctcagagaggtaaagggctcggagtcgctggggggaggggttcccactggaggtaactgagaggtgcaggggggctcggagaataccggctgcagggaacgaagccgaaggttctgaacggtcaagcgaaaaggccaggtgcagggaggcgaaaggaggccagaggtgaggcccggggcgcggagctgcccagggcgcggcgcaggcggaggacgaactgctgagggagggacctgccaaccgcagccaggaggtggcgggggcaactgcagatccccggaaaagcagctcctgagccaacacaactttcagtgcaaacagcaggagaaatcctgcccgcccccccttctccgggccggagcccgggtgcacgctcgtcccaaacccgccgcgctgcccaccttccggagaggaaccccgcgcgcggcagagccggacgccaggggctggacgcccaaccacctagtcactccccaggacgcagttatcgcgcgcaaagcagctgggggaccccgcaaggaaactcaggcacaatggagcccgcttctttttctgtcaactctgaatgctatgtctggtttggtcctggctgctagttcgaagctggaacatcctccagagctggggcccatttccttttatttgccttgggccccaaatgaaaagcatctatccgcatgcctaataaaaattttcttaaatcggaca

SEQ ID NO: 238393 - DNA, 619 bp, Homo sapiens
tgtagaagtacctctataggattaattcctagaagtggaattgctgggtcaaaggacacccacatattaaatttagacagtgatcaccatactgtcatccaaaaatgttatattaatttatacttaatgctaccaacccactgtgggacttttgatggatgatgtcatctttgtgctacattttctctacttgtaaaatgagaattcttatgccttagtaataattctaaatgaggtcattgttttgataggaccatggctccttcagaagaaatatatctgtaaatctaaggtgtcattttcattttcatttttttctttcatagttcctcaaaacttagttccttctccattttaacctgaaaaataaataatttgattaagagacatctagtgacttcatgccttggcactgccttcaccaattctatttttaggactcaccagtgtctggggatgtttggatgacatcaacttttacacatatcttttcatttaaaatttgcaaaagtctgcacagctatgacatgacagaagcctcccactgcaatgcctgaagatccctactgttctgagattaaaaaataaaagatgatttcctttcttaatgatttgccct

SEQ ID NO: 238394 - DNA, 415 bp, Homo sapiens
caactttgtctggctccaaggggtctctgtcccttacactggaaagagctctgcctaaaatgactgctccagtttcacaaggaagaatccaaggccctgccactgacacaaaagaaaggactggcagagtcaaaggtcaaacccacatctgtgactctgaagcctggacagtccccaccttcctgggtgtaccccacttatcttcccgcccttcgcccactttgtgcccccatcatggttcagcagccccttgcagagaaaaataaatgaagctcacacgctcagcctggcttctgcccagcaagcagctcaggcaggatggaagctgcagcctccagcttctcaaatgccagtgccccgcggcctctagcttccctacccagggaaacggaaacttcacaaatgcctgagttct

SEQ ID NO: 238395 - DNA, 420 bp, Homo sapiens
atatgcttcatataaaagtactgagttcaaagcagtattatacttgctaatcattaccaaaattctgattttgctatacttttcatcaggatttctgggacacctcccaactaaacatattaagattctagaaaaataggccgggcgcggtggctcatgcctataatcctagcactttgggaggctgaggcaggcagatcacctgaggtcgggagttcgagaccagcctgaccgacatggagaaactccatctttactaaaaaatagaaacttagccaggcatggtggcgcatgcctgtaatctcagctactcaggaggctgaggcaggagaatcacttgaacccgggaggtggaggttgcagtgagccgagatcgtgccattgcactccatcctgtgcaacaagagtgaaactccgtct

SEQ ID NO: 238396 - DNA, 347 bp, Homo sapiens
tcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctaccaaaactacaaaaaaaaa

SEQ ID NO: 238397 - DNA, 508 bp, Homo sapiens
gctatgaaatctactttggtattaatacagccacacctgctcagctgcctttgccaactgttagcatgtatctttttccatccttacaaccaatttgtgtctttacatttaaagtgcatttcttataggcagcctgtagttgggtcttgctttcttgctgagcctgacagtctgtattatagttgaggttcttagacaagtgtcatttgtaatgtgattactgatatagttatgtttgtctggtagctgtgtgattgctattagtcccaactgttctctgttccccttcttttcctgctttcctttagattagtcaactgttttttatgattcaattttatatatatttttgggtttattagcgataactgttttgctatcttagtgtttaggatttttagtatataattttaacttatcacagttcaccttcagtaatattatacatcctagatggtataaaaaatgacaatgatacattttcatttttttctgtcccagacacttc

SEQ ID NO: 238398 - DNA, 461 bp, Homo sapiens
ttttttttttttgagttggagtctcaccctatcgcccagactgaaacacagtggcgagatcttggctcactgcaacctccgcctcctgggttcaagtgattctcctgcctcggcctcccaagtagctgggattccaggagtgcaccaccacacccagctaatttttgtatttttagtagagacaggatttcaccacattggccaggctggtctcaaactcctgacctcaggtgatctgcccacgttggcctcctaaagtgctgggattacaggtgtgagccactgcgcccagcttatctcatcctttttaacagccataaaactgtaagcacaaacccttatctgcccaataacttactgatggacacagattgttttcaattttcttatattaccacaacattgttgcaatcaacacccttatacatatttgtgcatttgtgttgttgtcttccacagta

SEQ ID NO: 238399 - DNA, 337 bp, Homo sapiens
ccgaaaaagtttatgattagaggggaaactcagaggtaaagagtaagtggaggccaggcgtgctggcttacacctgaaaacccagcactttaggaggccgaggcaggcagatcatctgaggtcaggagttcaagaccagcctggccaacatggtgaaaccctgttcctactaaaaatgcaaaaattagccgggcatggtggcagtcacctgtaattccagctactcgggaggatgaggcaggagaattgcttgaacctgggaggtggaggttgcagtgagcagagatcacgccactgcactccagcctgggtgacagagtgagactctgtctcaaaa

SEQ ID NO: 238400 - DNA, 258 bp, Homo sapiens
gtactaaaagctgaaagcttcttgtggttaggaatagtatttgagattttggtggcatctaattattttgaacttttaaagccttaaagagtgaaatataaggccacaatacatttttctgatagctttcatagtctgttagtctgtgttgcttattttagggggacgatgtctaaattgaaatgtttatccactatagttgtaatgatctttttcagcctctttagaaagcagttcattgagcgaagaagagaaaat

SEQ ID NO: 238401 - DNA, 435 bp, Homo sapiens
tactaatgatctccctcttataaatctgagcttggcttacgtgtatcaactgaatgtggcatgactatccttgtatcagttttgggctacgcctttaaaagaactcgaagcttcactttgttctcaggaagaagtcagttgctatgtacaaagtcctactactctaagactgccataccatgagaagcccaacctatgccatgtggagaggtcatgtgaaggagaactgagtcttccagccagcaaccccagctgagcttccagccaacaaacagcactaacttgcatgggagaagctgtccaggaagtgaatccttgagctccaattgagctgcctcaagctggtgtcacgtggagcagagatgagctgtccctgacataccttgcacaaatttcagaaacataagtaaataaaagaaatatttgtattttaag

SEQ ID NO: 238402 - DNA, 534 bp, Homo sapiens
gtatgcaattcgaggtgaaatttccaagagccaaatgaaataattgcaacaggccttcatggggctttgaattcagcctcaaacattgtgataatccgatcctgacacttgccctcccctcattcactcttttaacaatcccaagagagtgcaggactgagatccgaaaatgttattatggaggggaaataaaggttattttgaatgcttcaaggtcacgtgacttgaagaagtcagttgctatgtacaaagtcctactactctaagactgccataccatgagaagcccaacctatgccatgtggagaggtcatgtgaaggagaactgagtcttccagccagcaaccccagctgagcttccagccaacaaacagcactaacttgcatgggagaagctgtccaggaagtgaatccttgagctccaattgagctgcctcaagctggtgtcacgtggagcagagatgagctgtccctgacataccttgcacaaatttcagaaacataagtaaataaaagaaatatttgtattttaag

SEQ ID NO: 238403 - DNA, 1848 bp, Homo sapiens
  misc_feature (916)..(916): n is a, c, g, or t
tgtggtttcacccagggtaaagtccagtggtacagttacagcctttttctgctgagttcaagggattttcccaacgcagcatcccaaagcgttgggattacaggcataaaccaccacacccagcttcatgttttgaattttataactcccttttcagtgagcctttccctttttctgatgagcaagccaaaattatcagtataaaaaatttaaaagagaagtttttctcccttcctgctgctttttctctgtctttctctgaaggtgtgtggaggtgggtgtgtatgtgtgtgtgtgtgtgtgagtgtgataggatctcactttgttgcctaggctggagtgcagtggcatgaacttggctcactgccaagcaatcctgcctcagcttcccaagtacctggaaccttaggcacaagtcaccacacctagattattttttaaaaatttttgtagagatggggtctcactgtattgcccaggctggtttcaaattcctgagcacaagcagtcctctcatcttgacctctcaaagtgttgggattacaggagtgagccactacacccagcccctgctgctttcttgatcttgccgttcagtttgcacccaatgctgacttgtggtttcaacgctgtatatgcggagtctgacttccagagcacttttgtaatccaaatgccacgtatttcttagccctcttccaattgtgatataagaggattccgagacccttgtgatgagatgtcttttgctgaagaattctgtttttcagaatctgggaatggagaaggtgtcattcattttgtcctcctgaacaaggctgtgtatgcacacatcaagagtggtggtgatatggtttggctgtgtccccacccaaatctcatcttgaattgtagctcctgtaatccccacatgtcnctggagggacctggtgggaggtaattgaatcatgggggtggatttttcctgtgctgttcccatgatagtgaataagtctcacgagatctgatggttttataaagggcagttcccctgcacacgtttgctcttcctttgccttccaccatgattgtgaggcctccccagccatgtgtaactgtgagtccattaaacctctttcctttataaattacccagtctcgggtatttctttattagtagtatgagaatgaactaatacaactgggctgtccatttttggaatcagagctttgaattgtggagttagctagatgtggattatactcctgactgtgtcactccctgggaaagttgtttaacttcacccttggcattggaataatgaataaataactccttgatttcttatgggaggatttcagccccaagcctacgatcaggcatagatgtcagctgggccagcacattgaggcctctgttctggtcctacttagagtcacaagtacctgtaactaatattggtaatgatgatctgaaattgtcaaaacagtctgttctttgtaataagctctacacacaaggttgtttagatatttattacattagcacttatttttaaaaggtacaaatttaggccgggtgcaatggctcatgcctgtaatcccagcactttgggaggccgaggcggacggatcacgaggtcaggagatcgagaccatcctggctaacacggtgaaaccccgtctctactaaaaatacagaaaattagccgggtgtggtggtgggcgcctgtagtcccagctactcgggaggttgaggcagaagaatggcatgaacctgggaggcggagcttgcagtgagtgagtcgagatcgagatcgcaccactgcactccagcctgggcgacagagcgagactccactcagtctc

SEQ ID NO: 238404 - DNA, 446 bp, Homo sapiens
tgagggcaggaggtaagactagagatgcaaacaggggcctacttacacaagcccctgcaggctgctggcttttactcttgagtgaaaacagggagctaccagaaagatctaacggaaatatataatctgacttgtattcaagagaatcactctggttactacaaggaagatagtgaaccctaggtgacaagggtggaggcagatggaaagatggggcccaatgcatcctccaggagaggcaggatggtggcacaggggtggcagcagggcgggactacaagtgctctggatatattttgtcaatgaagttgacaacatgcctgctgactggctgtggtgagagagaagaggagattccacgcaactgcaataatcctggctaataaaacgttggaagaccacaagagaagcaactgtggtctgtgtgcatgtgcgtgttgtggggg

SEQ ID NO: 238405 - DNA, 522 bp, Homo sapiens
ggcgccctggggccagcagacctgctcgcaggcctgacctcggcgagctgggcgctgccgcctctgtgcggggggagctctggctcaggctccccagtggtcccgagggatttgggggtgctcccctagcgtgagcagaaactctttgtgaccttgttaaagtggtccagcctcctcaggcctcgtcttcctcgttactgatgcttgtcctgcccaccccgcgagatggggaatcctaaagctccctctcgtgtctcgttagcgccctggggttgcgctgtggcccgacagacaatgctgctcgctgctggaggcttgcaagcccaagttatggagtcagactgtccgggttcgaattttcgtctctgccttgtagtagggtgaccttgggcgagtcacttaatgcctctgagccatgacttctttacctgtaaagtgggcagaacaatagcttctatgctgtgggcttaaatgacaagcagaacgcgttgtcagacttagaataaatgctcaaaaaaaggg

SEQ ID NO: 238406 - DNA, 721 bp, Homo sapiens
  misc_feature (705)..(705): n is a, c, g, or t
aggccccagggaccctggcatccctggttcgagcccagggtgcgcctcgggccgctgggggtaccccaaggcggacagaaagcccatgacgggaaggtgaggcacctgtggcaggaaaaaaaaaaaaccgcgccgcagtgaagctgggcctgtgtcccccactgacgaaagtgccttcccatcaggccttgcgctggacctcgcggacactggcgaccctggttcgagcccagggtgcgccttgggcccgctaggggtacccagaagcgggcagaaggcccatgaggggtaggtgaggcacctgaggcagagaaaaaaaaaaactgtgctgcggagaagcggggcctgggtcccccacggaagaaagtgtcttcccatcagcccctgagctgggcccaggggaccctggcatccctggttcaagaccagggtgcgcttcgggcctcttggggtaccccatggcgggcagaaagcctatgaggggaaggtgaggtttgagggaggagaggtatggcacctgtggcataaaagaaaaaaaaaaaaacctcgtgccgaattcggcacgagggccagcttatctacttccaattatgttgttgataaaatctcaagccatctgtcattagatcaaaaagcagcatacagagggtcagtcacaggatgttctgacacaacattgtaacttttggtagagatgatcccatntagaaaaagactggag

SEQ ID NO: 238407 - DNA, 2363 bp, Homo sapiens
  misc_feature (1160)..(1160): n is a, c, g, or t
  misc_feature (1472)..(1472): n is a, c, g, or t
aaaaaaatgaaaaaaaatttcttatgagagtgaatgttctcacctctaatatgtgtgggtttcaggataagagtataaatggagcctgaatactctatctaaatatctcaaaattatgaattcccccaacaagttgctgaataaactgtgcgttgtctgcctgccttgacaaacataccttcaacatttaaaggtctgggtttaaatgtagaattctgaggctcctcagtgtcccatgctggaatgtggtggccttgggaaaatggaccttagctttaggcctggccctcctctcttcccaagctcttcttcacactgcaagggcctcccagatgatgcatgaagatcctggcccatatattcagctacatccacatccctagcaaaagggaggctaaggccattcctcaggcctagggcactgcccctggagggaagaccagtggaagatgcctggaaaggccctggaagtagcttcaaggccatttcgatagagaattctgggggcctgaaaacctagagccaaggggtggacctgggctcaggataggcaagtccccttgatccaaggtatcactgtaggaggaagggcagtcagaggagggccagagctgagccttctaatgcacagggcccagagtggagtgaggaacaatgctgggattagacacccaaatctactgaattagcgaagtccaagcaaagtactgcaaacaaggtctggcatatcacaagcaactaataagtgttacttttattattaagcacctactggatgtcaccttttagcactgaggatgtaacaatgaatagaaagtgatcactgctctgggatctgtccctctaatattaggcttctgcaccaacagtttgggctacctgctgtgacagggatatggaagtttgttaggtggagaataaatggaaacccctacctccctggaaggtcaagggaaggtcttacagaggaagccatggctgagctgagatgtgaagggtgaatatgagtttagccatcagatgactggtaaaggtggacagtccagtcaaagacaacaacttactggatacatggaggtcagaaagagcatggcatttagaataactagaaaaaaaaatgtttgttttgtgcagaggcagggtacttaggaggatggcangtaatgaggttggagaaatgggcaaggaagaacaagatcgtgaatggtgagagtcatttccttagggagctacggatgtcacagtgaccttccacataattcagcatatctgctgcagaggtagccaagaaaccaagattaggacttcagctggacaatgttggcctgctggctcacagggcatggggagcaagttcacataaggcagtagggaagaggaggaaaactgcacacatccagggagattttagtgccagaattccggaaggctttcttccagaaggccctcaacctaactgccacgcctcctcncccacttttttatttagctacctcttatagactcatccttcagaacttagatgaagcattacacttcctccaggaatcccttcctaaattctcattctaattcagaagacattcttttgtatttctgcagtgtctcaaaaagtagattgcacgagacttattaattcattggtcagttttcctagaagagtggtttttaaactttatcatgaattctccaatgacttggagggcttgttgaaacacagatttctgaggcctatccacagactttctgattcagaaggacttagaattttcatatctaacaacttttccgatgaggctgatactgctagtttagggaccacactttgaggaccactgaggaaagagtttcacaagtcagagatttacagtggaggtaccaagcttttctcaagttagtttatcagaagcacaaaccatcaccctctaccaatcattataatgaagaccacttcatttcagtttatgtacaaaaactcatctccacagttatgccaagtgtatgaagacaaagaaacaatatcaggaaaagaggtttatttgattttgaatccttagccccttacacagtgcctgaaacatataagaggcagtgaataaatgcttattgagtgattacataaagagatgaatgggaggctgaggtgagcagattacgaggtcaggatatccagaccatcctggccaacatagtgaaatcccaactctactaaaaatacaaaaattagctgggtgtgatggtgcctgcctgtaaacccagctacccaggaggctgaggcacgagagttgcttgaacccaggaggcggaggttgcagtgagcaccactgcactccagcctggtgacagagcaagactccgtctcc

SEQ ID NO: 238408 - DNA, 2217 bp, Homo sapiens
gaggccaataaacactagatgttttggtgttttattttttcttttctacagacctgttaggttggtgtttcagtccctgctcaccactcccaagctcaagcccagctgcatttcaaaaaactgtaactgctaaactttcgcagcatatataacaggctcagcaaatgtggtccttgggttcaaatttctgtacttcataactttttcttccagcccctagcccagttgttttatactgtgctcttagttgaggcttttttttttttttttttgagacagagttttgctcttgttaccaagctggagtacggtggcacaatctcggctcactgcagcctccacctcccaggttcaagcgattcttctgcctcagcctcccaagtagctgggattacaggcacatgccaccacgcccggctaattttttgtatttctagtagaaatgggggtttcaccatgttagccgggctggtcttgaactcctgaccttaggtgatccacccgccttggcctcccaaagcgctgggattacaggtgttagccaccgcgcccagcctgcaagaactgtttatgtcttctgggcttctgttactgcttgaatcaaagcacttgtattgttgatcttttttcagtattgggttttgcttgagagtacattgcttcagagctcttcacaaattactgctctaatccacatgactaggcaataaggtgctccacctttgaatccttaaacatcagtgtggtattggagttgaatagctcatactggatggtctgcctttcctgacagcttttacttctggcggataaaatttatagccatctgaggaaaggaggcccatgagcagcatttaaaatctttattctccccttttttcttcacaccttgacttaggttggaagttgtggttgtattggctttagaacattcctcaagttctcattggaattgacttgactgttgtgagttaagagaatgcagtatgtagttataggagataagatcgataaaagtgacctagttatttaactatcagcatagcagacctagaatatactgaactttcgtcttaggcaccactatagtagcccagctttttatcaattttatatatgcttcctaataaaactgtctcaatagagagactaaaaatgtgtgactaagaattatattaaaaaattcaaactaatggaagtaagtcaaaaaaaaaaaaaaaaaaaagaaagaataataattagctttatgtattgagttgagactcttggcttgcagtacctgtcatttgatatgtgcctcctgttccaggttttattttagttcccactttcgcatctgaaaaatcactgccagttactcagtgagtgaagtaaagagatggcacttgacctccccaaaaatatatcattatatggattttaaacatagggaagaaaacataaggaagaaaaaatttcacaagctgagaagacctgttaagcatgcatacacaaatcatttttataaaaatgataaaacctgtacattgttaaatctccttgtccctattgtcttctttcccaggtggtttcctaattgttttggtttcttcctctcccaaacccaggctggctacagcaaacatcattcaagatgtccagcaaagggagcagcacagatggcagaacagacttagctaatggtaaggggccaaaatgaaggtgaagctatttttactatcaactgaggttgtcctcctccctgcaagatagagtggaggcctggattttagtggagagagggaaactttcctgtgttgttctgagtttaggaaactacacaggaaacaccttggactatattatgcttttgcttcttctgattttatctgatcattttcaaaatatcaataacagagctgtacttctaagaggtcaagtggtttggagttctataaagctataaggatgggcagaacctaggaaatgctgttagtaaaggagaaaaataaaatctaatggctagtaggaacaagggaattttagggaagatgagcttcccagttatattgagaggtccctttccacagtaagtagtagtttgatagagcgattacatggctgggcatggtggctcatgcctataatctcagcactttgggaggctgagacaggcagatcgcttgagcccaggagcttgagaccagcctgggcaacatagcgagaccccgtcttttt

SEQ ID NO: 238409 - DNA, 1957 bp, Homo sapiens
  misc_feature (1)..(1): n is a, c, g, or t
  misc_feature (18)..(18): n is a, c, g, or t
  misc_feature (1362)..(1362): n is a, c, g, or t
  misc_feature (1794)..(1794): n is a, c, g, or t
  misc_feature (1831)..(1831): n is a, c, g, or t
nttattatctatttttgngctattattatgttatctaaatgctaatgactctaaaattacgtcaccagctctttcttgctttgaacacaacctgtatctttcagcttgtttcttaacatctcttcttagatgtctgaagaggatctcatatttagtgtgtcctctctggaaatttttgttgttatcctgaaaccctctcttccagtgttaccacctctggtatattgccactgtatattgttcaggcttaaaaagatggagtctttcttgatttcacattttcacattttacattttatacattcacattttagacattcacatttcacattttcacattttagacatccagcccactggagggctttacctacccagtatatcctggattcaattactttgacccctccactgctattattccagaacttcacactaccattccactggactgctgcaatagcttcctaactggtctttttccttttcattccattctactcttgtcccacacatagtagccagagtgatccttccaaattcaaagtgagagccttttacttccctctgtcaaccatccaaagactccagtgatatttagaataaaattcaaagttcatgcagtaccattgttttcaggctccattgatctgactttggctacttgtataaccgtatcttatgttcccttgttcactgggctccatccttactggcctcctggcttttccaggagcccaccaaacatactcctttctcaggcatttgcactttttgtcttctttgcttggaaaaattttttctcagatattcatacagcttattcccttacttcagtcaagtctctactcagttacagttttcccagagacctttcctgacaaacttgtctaaaaagtaacacttgtcactttgtcttctcctgctttatttttctcctagtacgtaacagataggacatttaatttcatattggcttattgtatgctttccacactagaatgtaagctttatgaagtcaggggatttgtcttgttaccttatttatccccagtgccaagaatacttctagggatataggaggaattggattcactaagtgaagcagtattgtgttcttgaattttctttatgttttctaagctacctaccattcttggaacattacaacattacaacaaaactaaattcctggcatttttttttccttactggagagtagtaagccccacgaatggactgtcttctcatgctgtctcctatgagaggtcaaggcaaatacagtttagataaatgttttaataggagcagaaaactattttttttaacctggctttactaaagttaataaagccaagtgtntattagtctttgttttgtctttgtccttggaaagtccattgtccacttcttttagggaacatagtgaacatagggcaaggagaacagtgaaagaaagaataactgttataaccactaaacctgcaaatccagacagagtttgttccataaatttctagttcatttaaaagcacattcaagtttgctgcaaggttttaacatatgtatgtctcaagaccccagggtttatttgaaggttctcttgttcctgtaaatcctgtgccttgacatgcttacttaatgttttgtagtaatataagggtattacgctgggcgtggtggctcacacctataaccctagacctttgggaggcctaggtgggtggattgcttgagctcaggagttggagaccagcctgggcaacatggcaaaaacccgtctctacaaaaaantacaaaaattagttgggtgtgatggtgtgcacctgtngtcctagctactcaggaggctgaggtgggaggatcgcttgagcccgggagacaccagttgcagtgacctgtaatcagtcgcaccactgttcaccagtctgggtaacagagtgagatcctgtctcag

SEQ ID NO: 238410 - DNA, 286 bp, Homo sapiens
cagggcacttgcccctttggagtcagccaccatgttatgaggaagtctgggacacatgaagaggccacatgcacttattctgtctaaaagccctagctaattgcaaggctgacagccagcagcaactatcatttttgtgaataaataagtcttcagatgattccaaatcccagcctttgagtcaccccagctgatgtcaagtagagcaaagatgagctatcctcaccgaactccatctaaattgctgattcctgagcaaaataaatgtcattgttctaagtctcta

SEQ ID NO: 238411 - DNA, 495 bp, Homo sapiens
tctgagaatcgacagatcacagcatctggtcaatgagatgagagacacctcacccttcatgattgcccagctggccacctgctcccattgaccagctcttccttaccctccctaattcccattttctcacacacagatgcatttcttccctgctaaaaacccctaattttaggtggttgaggtcatggggtgactctgagtaacagtcagaggaacctccaaatgggtttccgaggtggctgctctttacatccccatgagcagtacagggggcgcggtttccccacagccttgccgtcgcttacctcccattttcagtgattttatttgagaaacatacattcacccgtccaaacccaaggaatagactcggagacttgaggaacaggcggagctcgcagtgagccgagatcgcacctcagccctccaggaggctgaggcaggagaatggcgtgagcccgggaggcggagcttgcagtgagtcaagatcccacc

SEQ ID NO: 238412 - DNA, 499 bp, Homo sapiens
agagaggaggagaatagggctggaggaaaaaggcagtcatggaagcaaggggtagaggaattttcttcagggatatgagaagtctcattggaggaactatgaacagagaagaaactgggaatttaggctgggcacggtggctcatgcatgtaatgccagcactttgggacgatgaggcaggaggattgcttgagcccaggagttcaagaccagcctgggcaacaaagtgagatccctgtctctacaacaaaataattagctgagtgtggtcgtgcacacttgtggtcccaggtacatgggaggctgaggcaggaggattgcttgagccaggaggtcgaggctgcagtgaactataatcatactactgcactctagcctgggtgacagagtgagatcctgttgaaagaaaagaaagaaagaaagagagaaagaaagaaagaaagaaagaaagaaagaaagaaagaaagaaagaaagaaagaaagaaagaaggaaggaagg

SEQ ID NO: 238413 - DNA, 1042 bp, Homo sapiens
cagccagcagtagggggcagtggctggagcactggccctgcatccagactgcctggctttgaatcccagctttgctagctgtggagttgctccacctctctgtgcctccgtgtccttgactaatcatgtctaccagacttctagtgagaataaggggacttgatatccataaagcatttagagcagggtgtggcacatctcaactctaaatgaatgttacctgctcctgctgctactgctgtcaccatcatctaatcctcagggaacttcctcctcctttatcccatgtcactcacgtcttcaaactcttcctttctattgtgatcttgccccagtatttaaaaattgttttggctcatgcctgtaatctcaacactgggaggtcgaggtaggtggatcacttgaggtcaagagtttgagaccagcctggccaacatggtgaaaccccatgtctatcaaaaatacaaaaattagctgggcatggtgatacacacctgtaatcccagctactcgggaggctgaggcaggagaatcacttgaacctgggaggcggaggttgcagtgagcagaaattatgccactgcactccagcctgggcaacagagtgagaccctgctccccaaaccccaccaaaaaaaaaaacaaaaaacaattgttttaaaactgtaaaatacatgcccgtaaagagttcacaattctgagccattggagaacaaaaagtgaaaagggagtctacttatgatgctttgatacagtgctccagatcctgatcaaaatgcattagcaaacacacacatgtaaatgcacggtttttggttagctttacataactgatagacactagtaatactgttctgtgacttcatttcactcaccgtatgttggcaattttactgctcactacaagcttcaaatggctacaaaattccttggtttgaatgtgccatgatttgtttaaccattaatctatttatcagaatgcaattctttcccatttctcattcctacaaagaagactgaaaataaaaatttttgagtaaat

SEQ ID NO: 238414 - DNA, 492 bp, Homo sapiens
ctgcacagtgtcatttatgcaaattaaaacatacacaagtgatatattaagagcacacctatgtaaaaataaacatagaggtgaatggtaagtttcagtgggccctcactggtcagctctgtttgggcatttccaggctttgtgcctggccatgaacaggctaatgcagtggagctgtgggcagcatggcaaggggtgctgttggcagagtgagaaattgtgcctggaacctgaaccttagatccaggatctgctgaaggcagtttggtaattatcgtgtaaggtaatcatgcaagagtttcaggatgataatcttgggaatatgaaaaactttttgcaacctggcaggactttaccctggacaggcagaattccatgctacatagaatggactgagatgagaaccttaccccaccaccaaattgtctgttatccattatcgctaatgtgtcctttcagtttatcatagtaaaatattgcttttctaagacg

SEQ ID NO: 238415 - DNA, 742 bp, Homo sapiens
agtgaggctattgcgtgaattagccttcgacccagactgcaggagcttgggggttctgaggacagcacggctctactttccactttggagtggaacctacctggcgggggtcacacagcagatagtttgtgcagctgggaagatgagccctggacccgaacggtatgaggatatgtatcctaaggccagctttggtcccagttcactgggtgccggctgccccagccagctatggtctgcagagcccgaaggcaggcaggaggatcgcagatcgaagatctgcaaggactgaggatcgttcctagtgtctgtttggaagcccgtgggtcttgcaatgcgagggcagacaaactacgaagcgggttccggattccgatgagccacacgacctctccggcccctgatctgagcacccctcaccttggtccatctgctgaccatctaaaatgtgtaagcccagcgtcagggctcagtgtgtgaccaagaacagttttcctgtttgaggagttacctgataatgctcaaacacaggcgagttaatttgtccccaactctggagatctttttcctgtctggctccttctttccttccttaaatatttagtgagcacctactgtgtgctgggcattgtcctggaggtacaagcagtgaacttctgcctggcatcattacaagcaatctaacttggtagttgagaaaacaaagaaagatataacgatcgactatcaccatatttgaagt

SEQ ID NO: 238416 - DNA, 2653 bp, Homo sapiens
  misc_feature (806)..(806): n is a, c, g, or t
  misc_feature (818)..(818): n is a, c, g, or t
  misc_feature (836)..(836): n is a, c, g, or t
  misc_feature (843)..(843): n is a, c, g, or t
  misc_feature (846)..(846): n is a, c, g, or t
  misc_feature (976)..(976): n is a, c, g, or t
  misc_feature (1054)..(1054): n is a, c, g, or t
  misc_feature (1306)..(1306): n is a, c, g, or t
  misc_feature (1376)..(1376): n is a, c, g, or t
  misc_feature (1434)..(1434): n is a, c, g, or t
  misc_feature (1620)..(1620): n is a, c, g, or t
  misc_feature (1730)..(1730): n is a, c, g, or t
tctaatatgctggtgctatggtttggatatttgtcccctctaaacctcatgttgaaatttgatccccatgttggaggtgggcctcatggaaggtatttgggtcatgggggtagatacctcatgaatagattaatgccttcccttagtggtgagggagtttttcttctattaattcccacaagagctggttgttaagcagagcctggcactttcccctttttcactgtttcttcttctctcaccatgagagaagccttttgccttccaccatggatggaagcaacctgaagctttcaccagaagtcaagcagatgccagtgccatgcttcttgtacagcctgcagaaccatgagttaaataaacctcttttctttataaactacccagtctcagttattcttttatagcaatacaaaacagactaagacagctgggtttctatagaagtagtcaactgtagatttgtagcaacagcctttacaagcaaagcaaggtgcagaaattagtagttaactaggtcatttccagaaatatatctggcactattacataaggattaatagtactgcctctggaactagttctgggtttgcattccagctttgcctctcactagcagtgtgaacttctgggtaagtttcctctttgtgcctcaattttctcacctgtaaaaagggaatgacagtaatagtcccaacctcatagaattattacacaaattaatatttggaatatgcctggcatggccaggcaaggtggctcacgcctgtaatcccagcactttgggaggctgaggtgggaggaanacttgaggccangaggtcaagaccagtctnggcaacntantgagaccctgtctccacaaaaataatttttaaaaatcagctcagtgggggtagcgcacacttgtagtcccagctgctcaggaggccaaggtgagcatattgcttgagcccaggagttcaaggctgcagtnagcttgattgcactactgcactccagcctaggtaacagagtgagaccctgtctctgaataatatgcctggcatatagnaggtgctaaataaattaaacactatgtaccaggcattgatttagcctctgggaatatagtggaaggaaaaaggaaaggtcctacacttggagcttagaagttatattgacaacttccatttcaccttttcccaaaagttttcccccatggttaagtgcaagtgagcaaataattgattttattttattttatttgtattacttatttatttttgagatggagttttgctcctgttgcccaggctagagtgcnatggtgtgatctcggctcgctgcaacctccgcctcctgggttcaagcgattctcctgccgcagcctcccnggtagctgggattacaggagcccgccaccacatccagctaattttttgtatttttagnagagatggggtttcaccatgttggtcaggctgatcttggaactcctgacctcaggtgatccacccacctcagcctcccaaagtgctgggattacaggcgtgagccactgtgcccggccattttttttttattatttttcagagatggagtctcacagtgtcacccccaagctggagtgcagtggcntgatcatacctcactgcagcctcaaacttctggcctcaagcaatcctcctgtctcagccttctgagtacctgggactacagggatgtgccaccgtgtttggctaatactnttaatttttgtagagaaagggtcttgctttgttgcataatctagcaaataaattttaaaaataatttctgtcacaccagaaggctacgctataatatccattcattggcaaacatttttgagctcctactatgtgccaggtactacataaaagaaatagaggccaggcacagtggctcacaactgtaatcccagcactatgggaggccaaggcagacggatcacttcaggtcaggaatttgagatcagcctagccaacatggcgaaaccatctactaaaaatagaaaaattagccaaacatggtggtgcatgcctgtattcccagctactctggaggctgcggcagaagaattgcttgaacctgggaggtggaggttgcagtgagttaagatcacaccactgtactccagcctgggagacaggctcaaaaaaaaaagaaaaagaaaaaaaagaaatagagtctttgtcctcaaggaattcctaagagggatattcagctgtaaaactcttattgaataatgcaatactatgcgtgcatttccatgtatttatacatataattttattgataatatatataaggtaacgccttgtttatcaggaaataacttttacccaacaacctagccaagaattagggattattaaggaaaagaggcgcctgtaatcacagcactttgggaggctgagacaggcagatcacctaaggttgggagttcgagaccagcctggccagcatggtgaacacctttctctactaaaaatataaaaaattagccaggcatggtggcatgtgcctttaatccctgctactcgggaggctgaggcaggaaaatcgcttgaacccaggaggcagagatttcagtgagccaagatcgcgccattgcaatctagcctgggcaacaagagcaagactccatctc

SEQ ID NO: 238417 - DNA, 923 bp, Homo sapiens
cagctactcaggaggctgaagcaggagaattgcttgaccccggaggcggaggttgcagtgagccaagatcatgccattcattgcactccagcctgggcaacaagagcgaaactccgtctcaaacaaaaaaacaaacaaaagaaaaaaacaaaggatactagccagtaagggtagaaggaatgacaatattttaaaaattcaccattttgtaatccctagtatgatatgggaaattaaatttagttaaggatcatcatggaggctaatatcctggtgagaagaagctgttgggctgttcacatggtgccatagattacttactcatcaaacataaagggaaaaacatgtctttacactagagaaatcctgcggttaccaccttaaccagatcgtcaaagtcagcatcactagtgcaggaaatcatgatgttaatgtgttattttgttggatgcagtaagaagtacccaattcacttatgaagcattctttccaaaaatgtttaaattaaatctaagcaaccttcatgtttatctgcaggattatcttctttagctagaactgtaaatgattttactatatgaccttaggtaggttacgttagtgacttgtctgagtctcagagcccttgtttgtaaaaacagtgacattgaatcagaaaaaatgcatgaaagtaacctagcatgtagtttgttatatcataagaatgtaaaatactagttcatctctgctatcagaatccattcatagccaccaagtatatagctgaatgaaaactacatttctctttttcacatcttatttccttatctaattctatgtaatctgatggcatgttttatgaattccctatacttgcttagatccataagctgtgcagccccaagtatggcataaaccctctaatccaaaatgttcaagggaca

SEQ ID NO: 238418 - DNA, 869 bp, Homo sapiens
cagctactcaggaggctgaagcaggagaattgcttgaccccggaggcggaggttgcagtgagccaagatcatgccattcattgcactccagcctgggcaacaagagcgaaactccgtctcaaacaaaaaaacaaacaaaagaaaaaaacaaaggatactagccagtaagggtagaaggaatgacaatattttaaaaattcaccattttgtaatccctagtatgatatgggaaattaaatttagttaaggatcatcatggaggctaatatcctggtgagaagaagctgttgggctgttcacatggtgccatagattacttactcatcaaacataaagggacaaagtcagcatcactagtgcaggaaatcatgatgttaatgtgttattttgttggatgcagtaagaagtacccaattcacttatgaagcattctttccaaaaatgtttaaattaaatctaagcaaccttcatgtttatctgcaggattatcttctttagctagaactgtaaatgattttactatatgaccttaggtaggttacgttagtgacttgtctgagtctcagagcccttgtttgtaaaaacagtgacattgaatcagaaaaaatgcatgaaagtaacctagcatgtagtttgttatatcataagaatgtaaaatactagttcatctctgctatcagaatccattcatagccaccaagtatatagctgaatgaaaactacatttctctttttcacatcttatttccttatctaattctatgtaatctgatggcatgttttatgaattccctatacttgcttagatccataagctgtgcagccccaagtatggcataaaccctctaatccaaaatgttcaagggaca

SEQ ID NO: 238419 - DNA, 705 bp, Homo sapiens
tgggggaggaggcccctcgtttccctcatctgggctcaggccggtgggagcaagaggaccgggccctctcccctgtcatccccctcattcctcgggccagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagccaagaacctgaatggcgtgatggtggcagtggcggagctgctgagcatgaagatccccaactcctatgaggtgctgttcccagagagccccgcccgggcaggcactgagccaaagaagggggaagctgagggtcctggtgagtgtggcagggaagccctttgggacttgaggggagtgattctggtgggaggctctgatccactcctttctgcaggtgggaaggaaaagggtctggaaggcaagagcccagacactggccctgattggctgaagcagtttgatgcagtgttgcctggctataccctgaagagccaactagacatcttgagcctcctgaaacaggagagccccgccccagagccacccactcagcacagctatacctacaatgtctccaatctggatgtgcgacagctctcggccccacctcctgaagaaccctccccgcccccttcccccttggcacctt

SEQ ID NO: 238420 - DNA, 627 bp, Homo sapiens
tgggggaggaggcccctcgtttccctcatctgggctcaggccggtgggagcaagaggaccgggccctctcccctgtcatccccctcattcctcgggccagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagccaagaacctgaatggcgtgatggtggcagtggcggagctgctgagcatgaagatccccaactcctatgaggtgctgttcccagagagccccgcccgggcaggcactgagccaaagaagggggaagctgagggtcctggtgggaaggaaaagggtctggaaggcaagagcccagacactggccctgattggctgaagcagtttgatgcagtgttgcctggctataccctgaagagccaactagacatcttgagcctcctgaaacaggagagccccgccccagagccacccactcagcacagctatacctacaatgtctccaatctggatgtgcgacagctctcggccccacctcctgaagaaccctccccgcccccttcccccttggcacctt

SEQ ID NO: 238421 - DNA, 1107 bp, Homo sapiens
tgggggaggaggcccctcgtttccctcatctgggctcaggccggtgggagcaagaggaccgggccctctcccctgtcatccccctcattcctcgggccagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagccaagaacctgaatggcgtgatggtggcagtggcggagctgctgagcatgaagatccccaactcctatgaggtgctgttcccagagagccccgcccgggcaggcactgagccaaagaagggggaagctgagggtcctggtgggaaggaaaagggtctggaaggcaagagcccagacactggccctgattggctgaagcagtttgatgcagtgttgcctggctataccctgaagagccaactagacatcttgagcctcctgaaacaggtaggtctgggggagaaaaaggggtgggtgttagaaaaaaggggctgccggccaggcgcggtggctcacatctgtaatcccagtgctttgggaggcaaggcgagtgaatcactttaggccaggagtttgagaccagcctggccaacatggcgaaaccccgtctctactaaaaacaaaaacaaaacagtagccaggcgtgatggtgcgtgcctgtaatcccagctactcgaaaggctgaggcatgagaatcccttgaacccaggaggcagaggttgcagtgagccaagattgtgccactggatccagcctgggcaacagagcaagactgtgtctcaaaaaaaaaagaaaagaaaagaaaaaagaggctgtctagggcaaagaatgtggaggccttttgggagggtgggatatgggtgaggggaaggagggagctagttagatgaggagctggcactaatgatacagggcaccctcctacaggagagccccgccccagagccacccactcagcacagctatacctacaatgtctccaatctggatgtgcgacagctctcggccccacctcctgaagaaccctccccgcccccttcccccttggcacctt

SEQ ID NO: 238422 - DNA, 615 bp, Homo sapiens
cctttttttctctttttttccttttcttttttaggattctaaatcacatacaaaacatttgttctgctccagctctttgtgaactaattggctctcctggagggataggtaattgtacctgactacacaagctgtcccgaagctcccttggaaagctccagtaagcttctagtgttagcagccatcaaggatttcacaggtcaggcatcggatcgatacagctaaaagcagcagggactgtaatgtcgacagcaggtttcagaaagcgctgcaagtgccagtttgttcctcttcatgcagaagctcaagacagcttaattaacccttggaaaatacaatttatccagaggctcggcaggtccctaccaggccttattggtgaactgataggagagatactgtagctggcagcgctgaattcggtggatgtgttcctcatgtcctgaagagcaggcaataggaggtagccttagaggggggtttgttagaactcacttgtgacttcagcaggagcaaggctgagactgagcattgatcatccgagccctggggtgagaaattgggatgtgtgtgcatgggtgtgtgtgtgtgtgaattagatgtgtgagagagagg

SEQ ID NO: 238423 - DNA, 669 bp, Homo sapiens
cctttttttctctttttttccttttcttttttaggattctaaatcacatacaaaacatttgttctgctccagctctttgtgaactaattggctctcctggagggataggtaattgtacctgactacacaagctgtcccgaagctcccttggaaagctccagtaagcttctagtgttagcagccatcaaggatttcacaggtcaggcatcggatcgatacagctaaaagcagcagggactgtaatgtcgacagcaggtttcagaaagcgctgcaagtgccagtttgttcctcttcatgcagaagctcaagacagcttaattaacccttggaaaatacaatttatccagaggctcggcaggtccctaccaggccttattggtgaactgataggagagatactgtagctggcagcgctgaattcccatttccccctttaatgctgtttcagttaggatgcaaagaaaacatagttttcggtggatgtgttcctcatgtcctgaagagcaggcaataggaggtagccttagaggggggtttgttagaactcacttgtgacttcagcaggagcaaggctgagactgagcattgatcatccgagccctggggtgagaaattgggatgtgtgtgcatgggtgtgtgtgtgtgtgaattagatgtgtgagagagagg

SEQ ID NO: 238424 - DNA, 2060 bp, Homo sapiens
  misc_feature (948)..(948): n is a, c, g, or t
  misc_feature (1032)..(1032): n is a, c, g, or t
gttaccatgctaaatgtaatgcgtttatttattattcagcaaaatctatggcagaggcattccaaatagtagctcgtggagaattaaaagtatcagggacttgtagaaatcttggtttctttatttttttaaagcatcagaaggtacttgaaagatgtgaacagataaattaaggctaaaaagaaaacagaaatggctacattttaaactgcctttctaccctcagtatttaattagatcaattgtatagaggaatgaacagaggtgacattcctcattgggattccttccaggactcttatagactttgcattcagaatgttcccattttcattgtgttgtactgatgataatttaagtattaggggaaaatccatttataaattaaacaaaatgacttgatatccatcagtcccctagttcatcaagctgttcaaacacggggaagattggctggtcggcctgggtcttccgagagcgctggtaattagatctgcgaaggatttattctttgctgattggggctttaaattaattgaagttccacatttgtggttttgtcctttttgtacttttttagaggagatatttcatattcttgtgtggtggagtgcttggccaagcagcagtggtttaaatgttaatttttctcatgagaagtttaagattttttgatgaatcaaggcctgatttgaagtgcaaagttgtatttgcttacttggaaaattattttttcactcttcaaagatgcttgtactttacttgatctgttgttttaaaatagattcgtaatacaaaagcattttattaacaagaaaaatagaaaaacctatgttaagattaacattaaaataactcaacatacttcgaagacaataatttggcctgcctagaagtaatcacgatatgttttctcacacagaaggaaaaaaaaaacaacacacattngactcttggaagtattttaagaaccaatccattttcctcactgaagttaactgtagtttctagggcattcattattcttagcantggtgatcatccttcttcagtgagccccacacatgagaaaagagaatatttaagattattctttaccttttaaaaatgaaaatacttttgttcaggtgggcaagtgatatattcttataccatagctcactgactttactgagcagctatgtcagcgagataactggaactgttttttagtcaatagaatgttcatatctgggcatatttgagaaacagcacatgcaaacggttttctactctttcatcctgatgttggagaacctcttcctcatgactcaaacacgcagcatgaaagaatttaagtttctaagcctttgtatgagggaaggtcttagaaaagtttgtttccttgaatcacaaatgctcaagtttgaaaggatcttcatgatccttttatccaacctccaacatacgcagccaaatctctacagcaaaaccagcaggcagcctttccagtctctgctagattctgccctgataggaagctcatgaacttgcgaggctgcccactcccttgttgagtagttctcgtagatagttatgcctgatatggagcccaaatctgcttcgctgcaacttcccactgatccaaggtctgccctctgggacatttctgatttactccttcttccctatcctagcttctcacacatgtgaagtcaattacatcagatcctcctttcctcctgtcatccttctcctttccaggtcaaacagtgctaattcacaacccttattcaatggcgtgttcctaaaagcctcaccatcctagtcatcctgccctggctgtgcttcagtttgcagagaaccctctaaaaatacagtgaagagaatagcacagccctctagatatattctgattagtgcaaagcagaggaactgtcacctttctcagggtaggctactatacttctcttaatgcagcctgaggttaaatttggtcttcttggaagctagatcatcctgtcaattcatactgagtttgatgtctccccaaatacatgttgacagtgagactttgggag

SEQ ID NO: 238425 - DNA, 1620 bp, Homo sapiens
  misc_feature (701)..(701): n is a, c, g, or t
  misc_feature (789)..(789): n is a, c, g, or t
  misc_feature (971)..(971): n is a, c, g, or t
tcttcttagtcactacttcccacagagttaaccattgccaagattagctttaatctttaaaaataacctgagattagctttgcctgttctgaaaatttacatgcatttaattagacgatatgcattatttggagtttgggagtcttcagttattgtgtatagcaggggcgggtttgttctcattgctgtatattttactgtacaaccgtgccactcagttattcattttactgatgacagagacttaattggttccagtttgggactcttaggaatagtgctgctgtgaacatttggcgatgtgtcccttgatgtacatatttgtgtatttctggtgggtatatactgaggaatggtatgtgtatggtcatagggcatatgtaccatcagctttagtaccagtagatactgccaaacgattgtccatattgagcatcttcttaatgctttttttgtgggggtgaagggggcagagtttcactcttattgcacaggctggagtgcaatggcacgatttctgctcactgcaacctccgcctcctgggttcaagcaattctcctgcctcagcctcctgagtagctgggattacaggcatgtgccaccacacctggctaattttatatttttagtagagacagggtttctccatgttgatcaggctggtcttgaactcccgacttcaggtgatccgcctgccttngcctcccaaagtgctgggattatagatgtgagccaccatacctggcccctaatgctttttaagtcatcttacctatttcacatttccntgagaatagtgagtcacttaatatatttttgacaggttgaacaaggaagtttgttcctgggagataaaaaagcttgaggtcggccttgcgtggtggctcacacctataatcccaccactttgggaggtggaggtgggaggatcatttgaggacaagagttcaagactggcctggacaccatngtgagatcctgtctgtattaaaaaaaaaaaaagtacggggccatttactttttctttcttcaaatgatgagtatcttgggagacctgtttgcttctcttgagccaggtcatcttggaaccatgtccacagagacaggtggacgtagcagccttagctcttactctgaaatgccccttctcatgggcgtcttgctagtccctgccaccacctccttgtcagccccagggacagcccttccattgcctgcagtgcagcccagctaagccaaactgatcacaaaagcaagattttactgaagaatcaggagagccaaagggcagcccacccagacagcgccagtcacagtttaccatgtaacacctggttcaggtcgagtgcagtggctcatgcctgtaatcacagccctttgggaggccgaggcaggaggatcacttggggccagaagttcaagaccagcctggacaacatactgagaccccatctctacaaaaaatttaaaaattagctgggcttggtgtcatacgcttgtagtcctagctactgggaggctgaggtggaggattgcttgagcccaggaggtaaaggctgctgcaagccatgattgcaccactgcactccagccagggtgacagagtgagaccatgtctt

SEQ ID NO: 238426 - DNA, 610 bp, Homo sapiens
cacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaaatcttgttttctttaatcagcataaaatctggaatgaggagaaatagcttctgaaatgcgctttctcaaagaaggatgagcagaatgagccacaccatctataccaggagtgtccagttttttggcttccctgggccacattggaagaagaagaattgtcttgggccacacataaaataaactaacactaacaatagctgatgagct

SEQ ID NO: 238427 - DNA, 410 bp, Homo sapiens
caaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaa

SEQ ID NO: 238428 - DNA, 428 bp, Homo sapiens
gagacagagtttcactcttgttgcccaggctggagtgcaatggcgggatctcagctcactgcaacctccacctcccgggttcaagtgattctcctacctcagcctcctgagtagctgggattacaggcatgcgtcaccgtgcctggctaattttttgtatttttagtagagatggggtttcaccatgttggccatggttggccaggcaggtctggaactcctgacctcctgaactcctggccaggcaggtctggaactcctgatccacccgccacagcctcccaaagtgctaggattacagacgtgagccactgtacccggcctaattgggtttttaaacaactattgttgttttttatatgttctgaatataaggtccttattagatatatgatttgaaagtatgttctccccttctgtcttttcac

SEQ ID NO: 238429 - DNA, 450 bp, Homo sapiens
ccctctactttctcctacccaccacctctctctccaggattaggaatgctcaagcaaagaaaaggacgccagaagaggaggctcaggatcctaaagtttgcatttattttaaaattttgcatggcacagttgaaatgttaatgtttgctgaccatttaaaaagtaagatgtttgccgggcgtggtggctcacgcctgtaatcccagcactttgggaggccaaggcgggtggatcacctgaggtcaggagttcaagactagcctgaccaatatggcgaaaccctgtctctactaaaattacagaaattagctgggcgtggtggcatgcgcctgtagtcccagatactcaggaggctgaggcaggagaatggcttgaaactgggaggcggaggttgcagtgaagccgcgattgcaccactgcactctagcctgctgacagtgagactgtctc

SEQ ID NO: 238430 - DNA, 423 bp, Homo sapiens
gcattctcttctggggtttgccttacaagtcatgggcagataaacaataaacagcaaatatataaataattttgaaaagtaatgagggtgacatgctaatatgctagtgagtaaagtggtggagatacccgtctccttcttgaggacgtaacatttgagttgagattcgaatgacaagaggcctgttacacctatgatatggtggaggtataacaggcatgttgcaggtagaagaatagcaagtgcaaagtcctagagacaggaacagcttagcttgcttgaagaacataaagaaggccactgggggcaagacacagtggcttatgcctgtaatcccagcactttgggaggccgaagtgggaggatcccttaagggtaagagttccagacctgactggacaataaagtgagactgtctctaca

SEQ ID NO: 238431 - DNA, 291 bp, Homo sapiens
cagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaa

SEQ ID NO: 238432 - DNA, 662 bp, Homo sapiens
taaagtacaaaggttttagttttgatgaagtgaaatcacattctttcatttcttctgcttttcgtgtcatctctaagaaatcattgccaaatctaaggtaagatctactcatgtatcttcttttaatagttctatagttttcttatatttaggtctttaattttgagttaagtttttgtatatagtgtaaggtaggggtccagctttattcttttgcattcagttacctagcattatttgttgaaaagactactcatttcccagttgaattgttttggccctctacatgaaaatcaaatgaccataaacatgagggtttatttatggactctcaatttgattccactgatctatatatctgttgttatgccagcaccacattgtagcgttgtagtaagttttgaaataagaaaatgaaagtcctctagctttgctcttctttttttaggactgttttggctattctaggtcccatgaagcttgcaaggcttttgaaggaccagctatctttggtgcctggttccagagtctatctgcaggctgagcatctgagggtggcttgcacgtgtgccgaggctgccccacgggctagtccccctgtgccactgaattattcagtctgcctgaatggactttttctaggtcctagagctggatcttgt

SEQ ID NO: 238433 - DNA, 257 bp, Homo sapiens
aattttgaattagaattataactattcaatgtcaatgaatagttaacatatattaactgagttaatatatgttaaaataaagtacgttactattatattttggtaattcttaaaatatacgttatgtataatagttatttgtatattaataacttttatccaggagtatttctcaaattttatgcctttaaagaactacatctcaattccagtcattaaagacagagatctgtgtgttccctgcaaaaaaggaagtc

SEQ ID NO: 238434 - DNA, 344 bp, Homo sapiens
caggggtggaaatttaggagcttttaggctatgaatgaataacacaggtggaaataaaatgacactacaggtgggattgtatctcagagttaaggcagaggactttaagtctctactgttagtggttggtcctgttaaaaataaaatgccttcagagcagttgagaccatggcaacctgacctcattattgtagggaagttgtaacaatacaacttccttattgcagttgaggaagggaagtaaaatggagacagaattatcagctcaggtagaaaggataaaaagaagagctcctgtctgttcagcaaagacaagacagccatgaaagtatcataggacaagc

SEQ ID NO: 238435 - DNA, 487 bp, Homo sapiens
tgagtttccaccagtttctcacatgagagaaagctgaaggaaaaggtatgaaggcggatttcactgttgacaggttgtctttcaagtgtgggtcctggcgtttatgaggcaatgatgagacacctagaaagaagcacatctctgagacatgacagttcagtcccaaaggccattaatagagggccagctcatcaacacagctgcagaaacagagcacagccagcctcgcagccccacacgctgaagcccccgctgcagcattccatctactctagcgcccatgcaaattgaaaacctaaaatagttcactccccatagccactggctttgaagaatctcttttgtctccatgaaatagctccaggagacagaacccagagaaaaactttttgaagtgaactttttccttataattttatttaaatttgaatatttttgtagaaataataaagttatccactaattatctgtgtgacacaaaacaatc

SEQ ID NO: 238436 - DNA, 284 bp, Homo sapiens
tctccaccccgcccccagccctagtggagctgtgccctggctccccctggctttttttgtgtgtctgcctcagcctgtcttacttagcaactttcgtgcaccagcattttcatggcaacacacctggacaacaggtgcaccctcctgagcccctagcacctttgagtccaatttacttggcctgtaagtgtgtattcctcaatctccgggccacctctgggtcccctgaacgctgtaccctgtacctctgattcctaaatacacaccgactctcaaatacacca

SEQ ID NO: 238437 - DNA, 179 bp, Homo sapiens
ataaattgaaatcgtagaatgaacttttccttatttgtattgtatttatttttaaaatataggtacttttgttttcattcagcttctcaaatacactggcacagtatttaaacaccgttagcctactttttgaaatctgactcatatgtttccattaaaatatttaaaaacaaggaaac

SEQ ID NO: 238438 - DNA, 225 bp, Homo sapiens
cagtgaaagatcatcgctttcatcaaaggtattttgagcatcaaattggaaatcctgggaaactcctgggcgtggaggacctcagatgtcaccctgcagctttctctgtctctgagaacagatctagagccttagtgccatcgccactacagatgggctaaattcaaggactgatgactactcaaggctgctatggagttaaaataaatagcataagaacatgaa

SEQ ID NO: 238439 - DNA, 511 bp, Homo sapiens
caattatatgcttagcatttattccatgctccaaggttagatattcatctttgaagcccccaatgccagttatatggtaggtactctaaatgtctgatgaatgaacatcttcccaagggaatgacaacatcccacatttactgaatgcttaccgtgtgccaggcagggtcctgaaagctttgcatgtgttaactcactgaagcctcacaaaaactataaagtaggacctcttgttattttcattttatagatgaggccaactggggcaaaaaagttaagtggcttgcccaagggcacaaagctgctaagtcgaggagccaggattcaaacccaggcaggctggccccacagctcctgctctagaatggccttctgcctaactgccctaagagtagaaactatccagacagtatcaactgctgagtgcacagggttctcaataaatgctaactggcttgtgtcactagcagaatatagtgggcatgaccagtatcctagtagagctgaccca

SEQ ID NO: 238440 - DNA, 487 bp, Homo sapiens
gtgatgaaggaagaaggaggggatggatgccaggcaatctgtcctggttgtagaggtagtgctggaggtagctgatgttcattgcgttcattgtttgttgccaggaagtgcattctgtacctgacatgtattagaggtggtgtgtagtgaccagctggagcccacgtctctagcaccagtgaggatttggctgatgagcagagtttttcagtggtcagaaccctctttgctgggtcgtatgtagcctactggaccgtgaactccttgaggacaggagtatttacttttgtctcccaaagcacctggctcagtaccaaggaaatgtcaccaaatgttggcttatttaaaccaaagctatttctattgaaaactacaattaaaaaatattttttggcagggcatggtggctcactcctgtaatcccagcgctttgggagtccaaagctggagaatcacttgaggcaaggagtgagaccctgtttctaca

SEQ ID NO: 238441 - DNA, 532 bp, Homo sapiens
ttttatatatacatacacatgcatcttatctatatttttatatatgtaaattgagaccatccttcaaattagagtaactggatttttattttttaaagagacaagattttgccatgttgcacaggcttgtctcgaactcctgagctcaagcaatccacctgcctcagccttccaaagtgccgggactataggcgtgagccaccgtgcctggcctggagttttttttgaatgacaattttgtgtcttgacttttcatacatagctcttatgaacagctgctttcacatagtaaagctgactagaagcttcacttttaatttcaaaacctttaaaagtagacagtataacatagtaattaagaagacagacagacacggtggctcacgtctgtaaccccagcaagtttggatgctgaagcaggaagatcacttgagtccaggaatgagaggctgcagtgagctatgatcatgccattgtcctctagcctgagcaacagagagcaaggtcctgtcttgttgagaaggaggaggga

SEQ ID NO: 238442 - DNA, 552 bp, Homo sapiens
gatgcagtagtttgtcttcgtctctttaatggctctgggatgagcagccagatgaggtactaataggtgctgcctcagttccagttttgtgaaacttgtagttctcaatactgcctttataggctagtgatttgaagagaataggttatgtggttctctataaaccttattaatttctggtgttagcagttttggccctcccttggcctgcctcccagatggctgctggctgaagggtggggccgcctggcaccttcctggatccctcctggcgcgttggctgtggcaagcgttcagtaaagaacttcatatgagggagagggtacacctcagctgggagatccgcagcctctattgtttgtattcagacatgccctccgggagtgcttatttctttaatttcacaaaatggcccaatcacagctaagttccacagctctcctctgtggctgcacacttgtggacctgggtactgggtgttgtttcctgttagaatatcccaaggtcaagtcacctgtggatggaatcttaaaattctgctttatcaatgcc

SEQ ID NO: 238443 - DNA, 85 bp, Homo sapiens
gcggccgcagaagcctcgagccgggctggggcgcggttccctcccgcacgccccgcggcgcgcccccgccccctccgccgcgcgc

SEQ ID NO: 238444 - DNA, 426 bp, Homo sapiens
ttcaaaaagccagtttctactgacttataaagagagcaaaatctgctgaaatttttggttaaacttttattgccaaccttgaaaaggaacatattaaccagttaccttgtgataagaggatgacttgccatttttcttagaatctagtaggcagtcctgtggccctgaaacatgtgggagtggctgtttttaacttgaatctattcctttcaatgggagggagctactgaaatgaacgtgtagtttatcaaccacattaggacctcaaattaagttgttgagccacgagggcgataacctttaacaaagtaagtactgatcttataaatctttctacactgcctcacaccatctcatctaggtcaccagaaaaatatttttaaatgtgtccttagtacaataaaaaaaaactgcttaatactcaca

SEQ ID NO: 238445 - DNA, 491 bp, Homo sapiens
ttctgtctcagagaggtaaggcgagtctgtgagagaaaggactggggtgcttgcagtcctggaggttgaggcaccagagctagggggtgggcagggcagcagcgggcagggccatgggggtctcacagtggtgcatgaacaacatacgggaactaagggcaggaagcttggatgcggggccctcccatgtgcagaacagagacctaacctggtggccttacgcccctgtgtgtgcacatgtgttggcctgtgcactctgtacaagatgccacgtccttgctgagccacatgcttatgggcctgtccatgcagagggctgccctttctgattagatggagggcccctcagcctcgtctgcggatctggttggagtgtgggaggaaaagcgcaggcaaggctgggcacggtggctcatgcctgtcatcctagcccaggactttgagaccagcctgagcaacatggcaaaaccccgtctctacaaaaaatacaa

SEQ ID NO: 238446 - DNA, 367 bp, Homo sapiens
ttggtctgtctgtgtctaatgtaatgagtattaattaccaagtgtgacggtgacacctctgggagtggctgtgtagctgggatgctgtctgagttttgtgtgcttgtgttataacatacacacagtgctgtgactgtctgtgatgccgtctgtgacttccatgtgattgtgtggttgtgcatgaatctggcacttcgcgtgtatgatgggatgccataggtgtgactgtagagtcattcttccttcctttcaatcagcaagcatttccctagagcatgctttgtgccaggccctgggccggatgccggggacagatccgtggtgtcctattagggatgtctatgcttggcagtgatgaaatcagcca

SEQ ID NO: 238447 - DNA, 438 bp, Homo sapiens
aaactagattcttccaaatgcctaaggctgtgcctatagaaaactggcatcacattcccataaaacaacaactacttcaaatgcagtgaaactggccatttgcagtacagaaagcataatgtttattggactgactgctccaattttataaacagtttgtaaatctagattaggcaggcagcttcagtcaaccttttccctcaccccttagtaaattacaggtctgttaaggtacacaaaagctttcaggccatcagggttctatttctatctttttatgttttaaaatttctttctatatttttagtagaatcatatcttagagatctgctaaagagtacaccagctgcctgaatgccttactgtattcagcatgttggcaaagataatttattaagagtgtaacttgtacataataaataacatcctttattgcag

SEQ ID NO: 238448 - DNA, 431 bp, Homo sapiens
ctgaacttcttgaagtcaaagtttggttcccaatcctaccacctgctagctgtaggaccttggttctcaaatgtcaattgggagcaataatcccaccccagcttacttcatagaactgataagaagcaaatgagatattggctatgagcatgaggcccatgggacaaaaacattcatcaaactctatcaagagactttttattttatttttttgagaaagagtcttgctctgtcacccaggctggagtgcagtggtgccatcttggctcactgcaacctctgcctctcaggttcaagcaattcttgttcctcagctacttgggaggctgaagcaggagaattgcttgaacccgggagacggaggttgtgacgagctgagatcacgccactgcactccagcctaggcaacagagtgagactctgtcttaaag

SEQ ID NO: 238449 - DNA, 449 bp, Homo sapiens
ctgtccagtctagaactcaaagagtgatggtacaggctttagagccagacaacctgagtgtgaatccagcttcaccacttcattcattcactcacccattcattcaacaacatatttgaagcacatactttgtaccagggacttttccaggcaccggactacagctatgaacaagacaaacagtccctagcctcccaagagccgtcacttcagaagggcagacatgacacgcaaacaaaatgatgccaggtggtaccaagtgccttggggaaacagtgccacctttctgagaccgtttctccatccgtccatggagctgataacaccagtccctcagggtggaggtgaagactaagaggttgctttgagagggggaacttggtggctttttttcaccacctagaacctggcacatactaagctctcaataaaagtatattgaaccaaca

SEQ ID NO: 238450 - DNA, 205 bp, Homo sapiens
actttctttcccaatacaaattttgttttcatggttttatattctttattactatgcccagtgccattttgatgtgtttaaagagtaaaactttaatttcttcgtgatagaaagcaaacatatgtcacctcacatctgaactaaagtaacatttgattgtctacacatttgatatctataccattaaagagaaatgtatgcaaca

SEQ ID NO: 238451 - DNA, 418 bp, Homo sapiens
atcatttggccttcacttgactcaaacttaatataaaacccattgtaagctctggccaggcacagtggctcatgcctgtaatcccaacactttgggagatccaggcaggaggatcgcttgaggccagtagttcgagactagcctgggcaatatagtaagaccctctctctataaaaaatttgaaaattagctttgcatgctggtacatgcctgtagtcccagctactcaggaggctgaggcaggaggatcccttgagcccagaattttgagcagtaattgtgctactgtaccccaacctggttaacaaagtgagacccccatctctaaaataaaataaaaataaacccaatgtaaattctgaaatcatgagactgcatgttggttgcaaggtggatacacagctgactaccactgaaa

SEQ ID NO: 238452 - DNA, 2224 bp, Homo sapiens
  misc_feature (880)..(880): n is a, c, g, or t
  misc_feature (1376)..(1376): n is a, c, g, or t
  misc_feature (1527)..(1527): n is a, c, g, or t
  misc_feature (1595)..(1595): n is a, c, g, or t
  misc_feature (1676)..(1676): n is a, c, g, or t
tggaagcccagcgagactcagcccattgggaaacccagcttcctggcattcacgccttgtctccagagaggctgggaggagagggaagaatagctttgctgtaagagcttgtttaaactcttgggcagctttcagaggatgtccagccacttggcacctctctgccgctgagccaacactgtctcaagagcacccacttgaaaacccttttaaaaataagtgcagatgaaagagaaactgctcaggagccaggagcagggaggtggttaccctcaggagtttgttccccagatgggaaggggattaagaaacccagaggtgctggtctctggaagaacatgccagaaacaggctctatggtgggagcatggcacctggtgcctgaggcctaggatgcagggagtactcactctgcactgtctgcttatctgcacttttaaaattgtgtattgggaacaggcattaccaatttaaaaatatatattctgcatgtatacttatatgtatattcatgtgtatttttaaaagtggtaacagagagagagaagcagagtggctaatggacttgctggtacttctcttgctctttgttacctccatgtcccttttgtgtctccttttcttaccttgccctcctggtccccagggaaattctggaaccaggccagcatgtctgagatatacccattcccaacatgcctgtgttagtaaggccctttgaagttgtggaaaagagcaagggtgcagaccagtatgaatccacacatcgtctgagccaggcacaatatctgtctcatgtattctttataataaacttattttgtacagaagggaaactagaggctccgagttagccagtttgaccaaggtagctcagcgnactcaggtctgcattgccaccaaagttcatgcgaggctttgaaaagcacacatcttctccttgggctacaagtgagcaccgtggtggaggactgtttccgggtagtctttgcttccaggttctggaatccaggggacagcacacctccagcccagcagagctgctcctatgctttccctgtccttccagctggtcagcaagagcttagccagcactgtggtgtgagtgtgatccagcaaggccccaacgcccagcccttcctccagcatccacctgccattgcccactctgcactttttcaagaacccaaggtaaaattagttatagaagctagtggagaggaaagctggtgtgaactaaggaactttttttatttttatttatttttatttttagttgtcaaatgattctttattgaaatatcgtcctttgtgcttctaagtagctgggcactccaccgcaccactgttgatgtcatctgtgatgtcatgagggnggcggccaccaacttggcagcccacagactgggcagtccccagaatccctttaatggttccagagagttgtctggttaaaggtcggtgctgtatctgtagagcaatgttgacaatctcatcaaaggtggtatttccggctgggcacagtcncacgcctgtgagcccacccagcactttgggaggccgaggcggggggatcacttgaggtgaggagttanagactagtctggccaacatggtgaaaccccgtctccactaaaaatacaaaaattagcctggcttggtgacacatgcctgtngtcccatctacttgggaggctgaggcaggagaattgcttgaacccaggagttggagactgcagtgagccgagatcacaccattgcactccagcctgggcaacagagcgagactctgtctccaaaaaaaaaagtggtatttccgctgtgtttaacatttttctgtttctttctgtctcacggcagttccttgagggctttgatgatcagggcagaggcagaaggtaccatgtcaatctgggcctatcttttctgaatagtcactttcactgtaagcctcagacccttccagtcaccaattgctttggcaatgtcatcaccaaccttttttggggacagacccatgcggcgggtgcaatcttgggggcccacacaggatggcactgacttcactcctggtgttcctcagctatacaactttgatctcattgaggtcgaacttcagcagcatggtagaggcagctggtgttggatgaacccagatttgggacaaccgaagaaggttgcaccttagctgcctccgagctgaaagccaagagctttttttttt

SEQ ID NO: 238453 - DNA, 477 bp, Homo sapiens
aatagactttaaccccaagattgtcagggatggaataaggggtggggcttaggggtggaaattcagaattacgtaattatcctctttattcataagcccaggggtgacctttgcttcccagatttgtgcaaacctactctctaagatgtagaaggcttgcaggtttagaaaatattactagaatttatcaaagctagtttacacaccatgtctttatggttgataataaactgtatatgtatacatatgtgtgtatgtgtatgtgtattcatttgtggcctaagataaaaaactgaagaatagattgtcatgatttttttttaaatgtcaatttcttctttgattagcatacactatggtatgtatctttaccaaatggacttcagtatttgataaactgttgaacattccatgtgaaattcaggtctgtctgccacaacatggaggcatttaataaaatattaacgctgtgtaaat

SEQ ID NO: 238454 - DNA, 423 bp, Homo sapiens
atttgggtaatggatactgtagaaacactgacgtcaccactatgcaatttatgcatgtaccaaaactacacttgtaccttatgcatttacacaaatgaaaaaagacaaaaagaaatgaaaacaaacaaaatgatgatacataccacaaaacttgtgaacttcaataatgttaactaagtgaaggaaattggatacaaaagattacatgttgtatgatttcatttacttgaaatatctagaaaaggtaaatttatgtacacaaaaggcagatcattgggtgcctagggtttggggtctcagtgggacttaaatataaatagagaaatttgggacatgacagaaatgttctaaaactggattgttgtgataattgctcaaatctattaatttactcaaatcattaaattttacatatacagtgag

SEQ ID NO: 238455 - DNA, 598 bp, Homo sapiens
ggaaccaggcgtcgacttcagagctgacctttgtgcatttgtgcattgtttgtgttgtgataaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggccacggaggtgtcagcgtttcactcccagcacgtcacgccacgtccctttcctctgctttgttcctcctcagctgtgaactgtctgggactgggccaggagacagtcctgggatagggaaagaaatggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaag

SEQ ID NO: 238456 - DNA, 193 bp, Homo sapiens
tacttaacttttttaaaaaattgtcattcttatatactttgtaaagccttttttaatcctgttctttgtttccatatctattctctttcttttaaccaatcatcttaattttcttcctttaatttctcatgtttactttcataatcagttgtgcctcttgcttctctgccagccccttctatcagcacgtatg

SEQ ID NO: 238457 - DNA, 506 bp, Homo sapiens
agaggccctgacctctggggtagggtggcagcgtccccttgaagatgcggtcccgcctcccatccccaggcgcccggcctctcacaccctcagcaccctgctcacctccagctgaagatgccagggcacctctgcttcctccctgctctctgcagtaccgcagagtgagcataaaagggcttaatacaggcttcgccgggcgcagggctcccgcctgtaattccagtactttgggagaccaaggcgggagggtcacttgagaacaggagttcaaaaccagcctgggcaacaaagtgaggcccgtctctaacaaagacaatgagaaataaatctaaaaattggatagactgaaacaggcaatgaggaaaggattccctatttaataaatggcattgggaaaactggctagccatatgcagaaaactgaaactggaccccttccttacaccttatacaaaaattaactcaaggtggattaaaaacttaaacataagatctaaaaccat

SEQ ID NO: 238458 - DNA, 385 bp, Homo sapiens
gccactgctgtcaagcataatgtcatcttcactaaaattaaaggctggcatgaaattggaggttatctccaatgatctgcctggtcaaactatttgcaaagaaagttggtctaaatcaacaaagtgaaaacaagctctggctgctttttggtcttccagtttcctccagttgggttgggtggaggaagagatgaagactctccaatcaagatgcttctccctctcctgctgtcaggcttaactcctccctccaagccaagactatggcctgaggccaggacagatccactcctgcagacccagaaaaggcagggctggcaaaaccacagcctgcagccctgcagtgggacctcatctagatcagaggcttttatctgtattgcca

SEQ ID NO: 238459 - DNA, 411 bp, Homo sapiens
cctaaagatactatatagatggaaggatgaggaggaggaatctaagcagaaaatggcattcacactgagttaagaagatagagatcggtttggggagcctgaggaaactaaggtttctaagagttcctccaaggaggaaagtaggcagagatattaatagaactccataaagctgcatggagtctcaaagagtctttagacaaataagctgtacatgtttagtgtgagattccattgaggccaggcaaagaacaactactaggaagctgtaagtgatgcaattcccagagcttgcatagggctgggagacatgggagttctaagcagcttcactgaacatccagagctttcagtagagagctcagaaaaaaaaatgccttagtaggagggttaaattagccccaaagtaag

SEQ ID NO: 238460 - DNA, 2284 bp, Homo sapiens
  misc_feature (268)..(268): n is a, c, g, or t
  misc_feature (444)..(444): n is a, c, g, or t
  misc_feature (618)..(618): n is a, c, g, or t
tttgtctcaatgatctattaatgcactcaaaccacactaaattagctttgtcatctggtccaggttaggctgggcaattctgctggtttcatttaggctcacccaggcagctgaagacaccttggtgcagcatggtctaagttggccttgcctggcctggggtagctgccgttggctgagccgtacatctccagcaggctagcctgggctcctccattggatgcagccttcccagagcaagccacatgtgcaaccgcttcccaagccnctgcttacattgcatttgctgctgtcccattggctaaagcgggtcatgtgaccaagccggcggccaatgtaggagaggattacacaagaggggtgtggctcctgggcactcatggctgtaccaacctacgaccaattcccctgagcgccaggctgtttcctgcctctgcaccatcncccaagctttccccttcgcttgttatgccctgctgggcgatctcctactcgggcaagtcacaagcttctctgtgtctcagcctcctcctctgtaaaatggggatcacatgagtttaagttattctgaggattaaacaagttaacacacaaacatttaaaacagtgtctagcacncagtaggtcctccagagatgccagccatcaccatcacagtggtgattcttggtatgacgacccctgccctcttcaaagccccgtttaaggaatctcctctctgaagctgtctctggttctctccaggcaagcatcctcccccaggcctggccctataattatcttttcctcatccacctactccatctacagtaggatccagagggaagggaatcccagggcccagcccagggagtgcgaactatctgatttcctctgcaattagggaggcaagacagtcctcggtggccccatttgacagaggtgaaaactgccgctgtaggagatgtgctgatttgcccggggttgcgcagctggtaggtgggtgagctgggagtggagccaggttgggctgtagcagctgtgtttgccctgcctcactgtccagctcccacctgggccgggtgtcggggtctcaaagagaaggcagataccggctctgccgcacagagctcacagtttggtggaggaggaaggctcaagcagagagcaggaggtgtgagtagctctgtgggctgtgggggccagatgggtcctcgaccctgcggggtcagagctggctgcccagaagacatgaaatggaataagcagagtgacatgctctgggccacaaacagggtgtgtggccgccctgaacacatcactgcagccacctccacagccacagccctagccctgtgggtcatggggatgtgaccctccccactacctcccatcactgaggacacacctcctgggcctccagtaactacccaggcctccacacctgctacaccatgatggtgcagcccgcctccccaacgccttcagccctgtggaaattttctctggagattctaataccccggcctccttgaggtcagtgtctgcccagagcctcccggcaggagagaagaaaccccacagctcttaagggaatgcctgcctgtccaaatggacaaagacaagctgtgcagaaacctcccctgggaggactgagccatcacctgaggaatgggagtctgtggaaacgtgagtcacgtctgtgggaataaagcctttcatctggacatcgaaatggccaccagctccctgagtgactttgggcaagtcatgccccactccaagcctcagaaagccgacctgtgagatgaggatgaaagtaaccccctcatgggcctgccatcccaccaccatggcgcactccacctgaatgaccttgaggactgtgaccgttgctgtgtgcatctgtgctgcttcccgtttcattgctgagtggtgttcctgtaaatggatatgccactgtctgcttcttcactcaccagccccaggcaccccgccattctaccgactgtctctatgaatgtgactaccaggatcaaggaacttcataccagttgaaccatacagtatttgtccttttgtgactggcttatttcactgaacataatagcctgaaggtttatccatgttgtatgatgtgtcagaatttccttcctttttaaggctaaataatattctattgtgtgcagagatcaattgtctttatccattcatctgttaatgaacacttgggttggttccaccttttggttattatgaatagtactgtgatgaacatgagtgcaaatatatctgtttgaattcc

SEQ ID NO: 238461 - DNA, 529 bp, Homo sapiens
cagcatttacagacgctcttgaagccgagcgcccacacagtgtgaatttgaatgaagctgcgttggcacaaacccctgttaagagtaaactaacgaaaggcttaaacaattgttgtcttaaatatatctttttagctaataatcaccttcttgccactgttttggataaatcacgctgttggctttcttcataaaagaatttggcttgtcaattctgacttctttttaaaaggatggagaagtgacaaagtcggagggtgggggttggggggagaacaaagttggtttatgtgaaagaaagcttggaccggaaaggtgtgtgggtggtagaggtggggaggcgaatgcagagggcctttggaggggaaaagaatgggggtggtggggggcgggcaggattatgaactcctttcctggcaggttattttatttgagtcttagatattattaattgactttcatgaatatttgtacagctcatttgtatcttaagcacattttgaaaataaacaacaacataattccatga

SEQ ID NO: 238462 - DNA, 330 bp, Homo sapiens
ggccacacattataaaatatactaacgctagctgatgagcaaaaaaaaaaaaaagaaagaaaaagaaatccaaagaaaatctcataatgttttaaggaagtttatgaatttgtgttgggctgcattcaaagctgtcctgggctgcatgtggcccacgggctgcgggttggacaaacttgcagtctaatcagtgtattttgaaaacaatactgctgctaaaatgtgattctctcctcagaactccccagtggcctctggtgttctcttggagtaaaagccaatgtctttggaactgcttatcaagccccacatgaccccacccaccaccca

SEQ ID NO: 238463 - DNA, 439 bp, Homo sapiens
tctatattagttaaaacgtattcttcattatgtttaaatctttccagagctatggcaggagttggattggagtatacagaatggattaacttattctaattgttatctaaagtagaggcattgagcactgatatggtttggctgtgtcctcaaccaaatctcatcttgaatcagttcccataatccccacgtgtcaagggcgggaccaggtggaggtaactgaatcatgggaacggtttccctcatgctgttctcatgatagtgagtgagttctcacaacatatgatggttttataagcgtctgtcatttccgctgctgttactcattgtctctcctgatggcctctggagaggtgactttgccatgattgtaagtttcctgaggcttcctagccatgtggaactgtgagtcaattaaacgtcttttctgtataaatta

SEQ ID NO: 238464 - DNA, 341 bp, Homo sapiens
ccactgtgcccagtcacattttttatctgttaaaaaaaaacaaaaaccaagtttggatgttatgatgttagtagtgtgtctggttctgaagttacaggataggagatagagaaaaattgtgacctgcccaaagtctcaaagctaattctaaataactaaagttgtagaatcttttgtttggaggaccatcttaaaggtgtgatctatactcagccatttgtctgatgtgtaaatcctcagtctgtagcttcccggccacgtggtcaccaaggctgtgcttgaacatccctgagacgcctttcaaggagcaccgttctgtctttgggcagctctaattgtta

SEQ ID NO: 238465 - DNA, 1585 bp, Homo sapiens
aattctgaaagagatctaagaaatttgatagggattttagttagccaaagttactaaaacttagaaatgataaacagtttacctgaagtcattccagaagtagttttgccatcatctgagcttattggcttattgttactataatgttgtcatctgccccagttattcttacacatttattcagcaagcatttactatccacagcatggtgcttgaggcttagaaaagttgaagggtatagcatagtttagaaggttcttacaacctggagagaaaatgtgaatgtgagaaacatatagttaaaaatgtatgaagaagtattagagaatcaaatgatgtatgtaatcatcttaattactttaagaatgatgcatgtaaaacattcttaaagtaattatcaaacaaattcaaggcatctaccagagttgtaaatgtattctacgcacttcttgagaaccatataatgtagaagatgttgcaggaacgatatagatgagtaggattccattctgtcctcaatacaaaaaatagtaaaataataataagttagaggaataaagaactataagaatttagcagggagtttccagagaaggtttcatgtaagaggtggcatttgtgctatgactgcaagtacgtttataactgggcccacaaagactgagtctcagaaaagcccaaggagcatgtagggaacacagcagttgaatttgaatgaaatgctataggttaagaggacccatagggaatgattagaaaaataggttgagctagctgatagaggactgaagaatattcgaaagtatatgggggaactactgaagcttttgaagcaaaggtagtaatagtcaaacttaagatggggacaattaccttgcaggattgctgtgaagttagatgagataatttacctaaagtacttagcccggtgcctaccacatagtaaatacttaaatagtagctgccatcattcacctgactaaagacagggagaccagtcaggatattaggtgggccagaaaagtggtgtgaagacctgatatttggcataatcaggtatctagtaatgctagagatgagacagaaactgttgagattgagaaggataaagaaaggtattttttaagggaaaacttttatttttgactgtataaaatttagaaacatttaaatagcaaataatatcatgaacaaagtgttacctcccctaaatctattaatttagtgctaaactaataaaaatactaataaatttagttgggggttattgttgttttgttcttttgtttgttgggcttggcggggttctctttattaaacctaaatttattgaggtacatattgttattcacattttttgtaacagttcatagcatatataaatggcctttattgatttgtgtctctccatgatcgtacaaaattcaattatggtttacataatagtgaaccatttaattcagcctaaatacagtacttaaatggatctaattctgggagtctcatggaatgatctaaaaaatagtcaagaattttattaaaaccatctagatttggccaggcacagtggctcacacctgtaatc

SEQ ID NO: 238466 - DNA, 1030 bp, Homo sapiens
cagggtattcactgctaggccacactcaagaccagcaatttaaagcagtgacgttgaatttcaaatcttagcactccatcttctccctccctccattctgaaaatttagaaacacccagttcacatgagttggaaacaccaggactgtctaggacaatggtttgcaaccttggttgcttattagccttaaactaaaaactattagaagtcctgatgtctaggtcactaaaattaggatttcacccagacatcaggtataaatgattaaagctctccatttgagtgcagtatgcagctgagggtgagaaccactcatctaggagaagcatgaggaatggttaagccattaagcaagagggtatatccctgaattttttacttagcagtattatagtgtttttatcctctctggcttttgaatatcgttcattcagacaccattctttaatagcaggaaagaaaaaaaaaatggtctcaaaaatcgaaagtggaagtgaagactaacagaatccaaggttttctctccactttagactgtggagaggtagcctaggatcacctgaaattatatggaaaattttgtgcgtgtgtccattttcctagggtgtttgtagctttcatcgatttccagatgattgtgacctcccaaaataaagaatcacaatttaatttacttgcagactaaggctaagcagccttattttaaaattttcaagaagttagtcgctctttttctgtctcttcctggtggttgagagtatttgaacaaattttgaaaatgcagttgcttttttacaagatatctgagccaagagtcttttcagtaatgttcccacttgcataactagtttaataaagcattttcaatttgacatggtgtaagtcaaaattattactaattctgaataattagatatagttaatgagattgttgtatacgtttatcacgaagattaaaagtccaattttctgaactgaaactgaggcgatttagggaaaaaaaaatgcataggaattttacatctggatt

SEQ ID NO: 238467 - DNA, 512 bp, Homo sapiens
tgatcctggtccaccaccatcagcatcccttgggaacgtgttagcactgcaaattctcattcctccctaattttctgaatcagaaattacggaggtggagcccagcaatctgttttaaccaaacttccacataattctaattaatttatgctttgagaaccgctgatctagtttgtccctctcattttgcaggcaaagaattgaattctagagaggttaattgacttgtccagtcatacagctaggttctgttttctattatttatttatttatttatttttattttattcactttaccccccagtattcatagttttctttctaatactccatatttgacttgactttttacaagttgtaattacaaataagtctaagatgggaaagttgtggaaaactttatagagaacatgagatttgactgaacagtaaacattaagtagagagaaaagaaaggggtgttctaagcagtagggaccacagtgaataaaggtagagataggtaggttta

SEQ ID NO: 238468 - DNA, 561 bp, Homo sapiens
agtttccggtcccccactttagataatcagatacccccgttataagactcaggggtgcatttctagcaggaatacatggaagcgatattgtgacctcagggcctgacatcaggaggcagcaagtgctgtctcctgacatcatgggatgttaactttgacacacagggttatgtgctttgtgctgggttttcccactcaattgcctttgtaattaataagcacttatggggagataaatctatttctcatgcaatttaatctattagttttagtatccatgaatgattcttgcttgaatccattattattatttatttatttatttatttttattttattcactttaccccccagtattcatagttttctttctaatactccatatttgacttgactttttacaagttgtaattacaaataagtctaagatgggaaagttgtggaaaactttatagagaacatgagatttgactgaacagtaaacattaagtagagagaaaagaaaggggtgttctaagcagtagggaccacagtgaataaaggtagagataggtaggttta

SEQ ID NO: 238469 - DNA, 478 bp, Homo sapiens
gacttctcttggctgtcttccttgtgtaacccctcccctttgaatgtgagtggaatttgtcaatataatgacgtattactcctgtgactgttatgtgcccaaaggtgattatctagatgggctcaatctaaccacggaatcagaaagaggaaaatacaagaaggataccacagatctttgctggctttgaagatacagggggctatatcttcagcctctaggatctgagcacagtctggggctggtaagctagccagaaaatggggacctcaatctcacattcacaagatacagaattctgccaacaaccagaatgagcttggaagtgaattcttcccgaaagccttcaaataagtgttcatcccagccgacattttctttttgatcttgtgagattccgatcagagaatccaatggagtgcaacataaataatgacttacagatttgtgagccaataaatgggtattgtcttatatt

SEQ ID NO: 238470 - DNA, 563 bp, Homo sapiens
tgctacacatcacagattggggtcttagtcttatgtcttctaactttataatggtatactatttttttcatgtttttattaaaatgttttcttaaatccttagccaaagatttttgtttgataagtcaaaaataaggtcttgtttactttgtttacttttttgtattcaagatttaactcagagtaagaccaaattatcattgtagttttattgatataaaatgtcaacataatttaatttttttttttacttttttgtatttttaaaattttttattaaaaataaaagtagacagccaggtgcggtggctcacgcactttgggaagccgaggcaggcggatcaccaggtcaggagatcaagaccatcctggctaacacggtgaaaccccatctctattaaaaatacaaaaaaaatagccaggcgtggtggcgggcgcctgtagtcccagctactcgggaggctgaggcaggagaatggcatgaacctgggaggcggagcttccagtgagctgagatcgcaccactgcactccagcctgggtgacagagggagactctgtctc

SEQ ID NO: 238471 - DNA, 373 bp, Homo sapiens
gggtatacaaaaaaggcagaccatggagaacttttgaataagagttcagactgtaagcacccagctcagattacataactctggccttgcgtgagctgcccagctatctgtccagtgttcctgcctttatgtcctagcacagccattggccctactagatggacagtgagtgagccttgacaaacacgtctgcacctgtgctccctgccatgtgctccctgccctgtgctccctgccctgtttccaatattccctctgtcctcagagcacttgccgttgcttctcttatcctttgagattcagtcacatacagacttttaacatccctttttttttttgaaatgggctcctactctgtcacccaggctggaat

SEQ ID NO: 238472 - DNA, 611 bp, Homo sapiens
cacaagtgttaaataggggtcagattcaggccacccattcctcagtgctcagtggtcccagctgccactcaggaagctcagttcccagggagcagatctgagaagcagtggtggagtcccctgagatattgtcattgtgtagccagcaacagctgcacatgactagaacacagccagcaaatggtgagcagcagggctatcaggggaggtgtctagggattttcttttttttctttttttttttttttgagacagagtgagactccatctcaaaaaaaaaaaaaaaaagaaaagaaaagaaaagaaagtaagtattggggcggggcatgatggctcatgcctgtaatctcagcactttgagaggctgaggcgggcagatcaactgaggtcgggagttcaagaccagcctgaccaacatggagaaaccccatctctacgaatacaaaattagccaggcatggtggcacatgcctgtaatcccaactactcaggaagctgaggcagcagaatcacttgaacccaggaggcggaggttgtgatgagctgagatcgcgccattgcactccagcctgggcaacaagagtgaaagtccatctcaaaaaaaaaaaaaa

SEQ ID NO: 238473 - DNA, 501 bp, Homo sapiens
gcagaaagggggagggaagggactgagcgagtactgcacgctcactggagcatctgcagggcttccactagcaggtctcccttcacctcacacaagccctagagccagacactggtctccacactaaagataagagactgagacacagaaactctgtagttgtcaaagttacagacaaggcggggctttcatccacatttataagaccacaaaacaaccctgtctgcatgacagctcacaccctcccatgcctccctgagggctccttcttcccccaaacacttcttaatcctatattgctgccatttctcctctttctttttttaataaaaatgttaagaagggaacatatttataatgttttataaatggaagaatccattcataaaatattaacaaatggttaaactttgggaagtgagactctgtcttgggtttttgataataaatgtgggcccctttaatgaggtggataagactacttaacccaataagaaaaaa

SEQ ID NO: 238474 - DNA, 689 bp, Homo sapiens
tctgtcacccaggctggagtgcaatggcgcgatctcagctcactgcaacctctgcctcccgggttcaagcaattgtcctgcctcagcctcctgagtagctgggactacaggggtccgccaccatacccagctaatttttgtatttttagtagagacggggtttcaccatgttggccagggtggtctcgaactcctgacctcaggtgatccacctgcctcggcctcccaaagtgctgggattacagacgtgagccaccactcccagccaattttttttttttaaacatacagattttttgactccatgttagaaatctgttgacctaaagctagaggcaaatatggccaagggtccagaatccttggaggaaaaatgggctaaatttggaccctggagacctgtggtgacagagagatggggagagagtgggtgaggcagacagagtcagccagggaagacccgccccaaccccagcagcagcatctgagggtgatggaaaaaaaacccacccattccttcaatgcctgaccacgtggcaccatggaataggtccagagtggcagaggagtgcacaggcaggcaggtggaagaggctggaagaggcagttgccatcttctggggcccaggaggtttttttgttttttttgagatggagtttttcgctcttgtcgcccaggctggagtgcg

SEQ ID NO: 238475 - DNA, 635 bp, Homo sapiens
tctgtcacccaggctggagtgcaatggcgcgatctcagctcactgcaacctctgcctcccgggttcaagcaattgtcctgcttttgtatttttagtagagacggggtttcaccatgttggccagggtggtctcgaactcctgacctcaggtgatccacctgcctcggcctcccaaagtgctgggattacagacgtgagccaccactcccagccaattttttttttttaaacatacagattttttgactccatgttagaaatctgttgacctaaagctagaggcaaatatggccaagggtccagaatccttggaggaaaaatgggctaaatttggaccctggagacctgtggtgacagagagatggggagagagtgggtgaggcagacagagtcagccagggaagacccgccccaaccccagcagcagcatctgagggtgatggaaaaaaaacccacccattccttcaatgcctgaccacgtggcaccatggaataggtccagagtggcagaggagtgcacaggcaggcaggtggaagaggctggaagaggcagttgccatcttctggggcccaggaggtttttttgttttttttgagatggagtttttcgctcttgtcgcccaggctggagtgcg

SEQ ID NO: 238476 - DNA, 621 bp, Homo sapiens
atcacgtctcgttgccgtgcttattttccagcctgaagtgtgtttcatctttgttcgtgttggctgggaaaattgtctgtatatttgtgatcccctcctcccactttctctctaccttacttgctctaccactacccaaaaataaataaatgaattaattgaaacacctcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgtttttatgaactaaaaatattgagatcaggattatgaatcagttatagttttatattcatttcagcatctggttttggtttaggtagtccaatatcaagaaaattctgattagcatagataagttattgtaatcttgagctttaaattgatttagatgga

SEQ ID NO: 238477 - DNA, 441 bp, Homo sapiens
cgcctgcttcgctttcttctctcgctctccccagagacaatctcgtggcctgtgtttccccgcaggcaggccccagcgccctcaagcccagatgtctgctgtccacgctcttctgacttccggaaagctaacatctcagattccctctccctgaaggacctttgggaagtcccaacccccaccccaggctcttcactccccccgggtctgcttctcattctctcagatagatttataacttatgtaaataaatgtacatgattagccaagtgattatgtaaatggcgccttccttttctcgtcccaattctggtgacaataatgattaaaagatggaaaatagagtcaacatgtaaaaggtaaagaagctggaatttaatctgaaaaagcaagtgtaatgcctatttcacggcaaggttccatttgcacaaaggataaaat

SEQ ID NO: 238478 - DNA, 475 bp, Homo sapiens
gttgagaagcagtctcatgactttattccttatatttcacattggcagcaggcctgcaatgaaatatggctcattttttttggtcttgggctttgaggctaaagagagggtttagcagaggatatcataattcctttttgtggatacagaagaaccctaagcagttgccaaaatcaggtagaataagacaagtattggtccactctcagtaactccaaggcctcagagtttttccttagcttctggggaactggtatctacaaggaaatcaagaggcctagtcccctaactgctttcggagcacgttgtgggaggtgcagaccaaaggtgagtttacacatcagtgactaaagtttcctgccactaagcataagaagtcactcatgagcagcgtccctaaaccacagctacaggatgtgggcacaagcccttgtataattgttggccaagagccaatgagcattcatccctgtgc

SEQ ID NO: 238479 - DNA, 398 bp, Homo sapiens
ctgagattatttggtatcttcaaaattcctctaacataagagattgagatcacatccaacgaagacaaattagaactgcttcgtcaagaagagcaagacttcaaataagtaattttcaataaatgcccttagaggaatatgaaaagacttcgcaattatgaagaaaaagaacttagaaggaaaataaatattcataggacaagagaacattttaaaattatgcgtgtaaagaactttataattggatgcctactgaatgcagaaattgccagaaaataaaactctaaaaatgacatgggtaacaataaagatacaaaaactagagaaacagtccagaaattataatatgtgcctaagacatgtttcataataatcgagaagagaattggcaaaaaaaa

SEQ ID NO: 238480 - DNA, 325 bp, Homo sapiens
agctctctgaccagaccagaaacccgcaggaagagctggcgtgagcccagggccccatgcagcccgccctgccccgatcctgtgcctgtaaagaccccagacttagttggtagagactgagacggcctgacttcagggaagagacgacttgacttcagagagagacaccctgacttcggggaagagacagcctgactctggaacagagacaagctgacttcggggaagacaacctgcctttcccatcccctctccagctcccctctccgctgagagctgattctgtcactcagtaaaattctttgctctcatcacccttcaactg

SEQ ID NO: 238481 - DNA, 426 bp, Homo sapiens
cctaagaaaatttaaattaattcaggtcacttcatctaagttcaaattcaaatacaattgcccctctgtaaacgtgggggattggttccaggacccccacctcgtgtataccaaaatttgggcacactcaagtccttaaggggaaaccgcgtataagaaaagtcagccctccctatgggtgggtttcacatcctgcaaataactgtgttttccatctgcatttggctgaaaaaaaatctgcatataagtggacccatgcagttcaaatctgttgttcaagagtcaactgtattcccagttgtctcaaaaatgattttttatagcttttttgttttggaacgagggtaaaatcaaggttaatgctttgtatttgattgtctcctttggtcttgaagtccccttcctgcaccaccacctgcccctcaa

SEQ ID NO: 238482 - DNA, 459 bp, Homo sapiens
ctcttgcactctatagtcccacgttactcagagcttccccgtgccccataaatatgaaggactagattgaatgggcaccaggggggcaggctggcagtgccacccaggaaagcggggaagaggctatgtgggctacctggcccactcagggaggagggcaggactgggtattgtcttgacagcagccctgtcccacaacactgaactgggcagggaaggggtcaggcgtccccctgacatggggctggattccagagcattggacctggccaccagaattggccgtctccatccaaggcactggggccatgggtgccagagccacatgtggctgagctggcagagcctgccccccagggagcgctgagtcccggaggtggtcatttctggggaggggtctgtggggctcatcccacctgcccccttctttccagcacttgcatggcgcttccctctatt

SEQ ID NO: 238483 - DNA, 1809 bp, Homo sapiens
  misc_feature (5)..(8): n is a, c, g, or t
  misc_feature (899)..(899): n is a, c, g, or t
ggcannnngcttaacagcaaacgtaggtgccatccacccagcctttatccccagtccaagcacttcagcgtggaggtctagcaagccctggacaggaccagccagctagagacaggtgagcggaggaggcaccctctctggcccatggagtcagggttcattcggcgcatagacttggaggcctggaggtgggccaccttggccacttgctggggatgaggccttgagtgcaccatttgccctctagcccatttccacaactataaactggcaagaatagtgcttgcctcttggcatcattgtgaggactccacaaagtaatgaatgcagcgcatatttatgaaacacctgctatgtatcagacattgaaattgcaaagataagcaaacctctgcccacatggaggtcacctgccagtgggtaataccagctagcgctgccagctactgtgctgagaatcttacatatatctacctatattacctcattccatctcctcagcagttccatgaggcaggtattattactgtgcccatttaacagatgataaaactgaggcacaggggtgtataccttccccaaggccacattgctgatgagtagaatgcatgtggacggcttagcccagtgcctggctcagtcgatgactgtgctgctgatgtacttgcccggccctgcttccccttccttcttgcctctgccaaaggatctcagtccaggggcgatggggcgcggtgtcctctccccaggtctctcacttagggcaggcacagggcactctccccaggtgccctgagaagggggcggggacctatggctgccagggttcccaaatccttggtgcctgtgtgacctctcctccagggcctcaaaaggacaacaaaataccccaggcaagnatcacttgggtccagcctaagggcacaggtgttggcctgcagatggggtgactgataggcaggttacgcagtccttgtcccttcctctctctctctccacctgactgacccgctcatccctggagagccaccaaattccagagtcagcgtcccctcaggcaaggcagtatttgtcccagcatcacctggccatctctctgtcttctcagagacagagggagggaggaagaaaggttctggaggcagaggaagagcccaagggttctgggggagcaggcagaagtgccaaccccctggcacctgcccagcctcacccctgagcttctccatgtgactccccgccccctgccgtccccctggctatttttggagccacccactcagctgtcttaaggtagcagtgcctggccccagtgtcaccaggcccacagaggccagccttccttaatgaaaagctgcagctacttccccatcagatcctccctgcccaattcaagggagccagggactgtcccacaagccagaaagtccccagaaacccttctcaggcccctcagccatcagaggaccttcccactcagagctgtctggattgcaacctgctgcttgtaacacacagcaccttctgtctattgggcctaggggtgggaagggaggtcacagggtctttaaacttcttagtttgaaaaatttgcagcatactataataagcccccgtgtatctgtcacctggcttcaacaattatcaactcatggccagtctagtttcatctgtacccctcctgattaatttcatccatcaatatttcagtgtgtatctttaaatgataatgactctttttaacataatcacataacacgttcagctattaacatcatcaataaaattccttaatatcaaacttctagt

SEQ ID NO: 238484 - DNA, 1082 bp, Homo sapiens
cacccgccaccacgcctggctaatttttgtatttttagtagagacgggctttcaccatgttggccaggctggtcttgaactcctgaccttaagtgatccaccggtctcagcctcccaaagtgctgagattacacgcatgaggcactgtgcccggccgttatcccggttttatacataggtaggcgatatgaggcatccagaggttcgaggagctcaggagcttgcccgaggtcacagagtgggtaatggtgacagctaacatgtgctgagcacttagtgtacaccaggttctcagtgctcttcagaaccctgaaataatcctgtggagcagatgtgttatagacccgtatttcaaatgaggggattttggctcagggtggttacgggacttgcctgaggttaactgaggtaacaagcagcagagccaggatttgaacctaggccatcggggtcacaggcacacactaagccccttcctctgctgcctctgagaagttaaactgggtgcagcatggctgtgctcttttcaccaagggaccctggggtggggcagtatggcctctagaccgtcctcagtttctcaatggcaaggtgggggtgggcgacatcaccccccagcctccagcgttcacccccgaccctgctcacctcctccccgcagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 238485 - DNA, 1130 bp, Homo sapiens
gtgtgtacgtgtgtctggggctgctagcctgcagcagctttgggcctctgatagagttcctgcgtgtaacttaaccactaattctgaccgcggctctgtgtgtcactgtaagttacctgtgtgtgtctggggctccaaatctgtggctgtgagcagctggttgtgtgcgtgttgtgtctcattccatctgtagctccctgtgcaaatataaattacccctgtgtgtctgagtgtgacgttggagtgtttgtacatgtgtctggagttaccgtgtgtagcagctctgatccttcttgggctgtgtgtgttttaccattaattctatctgtagctccaagcgttgctgtaagttaccagtgtgcgtcccattgtgacttagtggtgtgtgtacaagtgtgcctggggctctgggttctaccatgaccctctgtgcctgcatatgcctgtaatttagctctgaaacgctcttctttttttttttttcttttgaaatagagtctggctctgtcgcccaggctagagtgcagtggcacgatctcggcccactgcaacctcctcctgctgggttcaagcaattctcctgcctcagcctcctgagtagctgggattacaggcgtgtgccaccacgcctggctaagttttgtatttttagtagagatggggtttcaccatgttggccaggctgatctcgaactcctgacctcaggtgatccacccacctcggcctcccaaagtgctgggattacaggcttaagccatcgcgcctggcttgaaactctcatttagctctgtgtgccaatgtaagttacatttgtgacattgttgtgtgtctggggctctgtgagtgtggctgtaacttaatttgattccatctttgtgtgaacattcccttgtgtattcctttgtgacagtattgagtggtgcctaggcctctctgtgtacagctgagaccctctgtggttttgtgtgttgctattttaagtaagatgatctcagaagaccctcttaagtcctaccaccctcacctctgcctgccttttccttcaattactaccctagttcttttttttccttcacagtcagacactactcctgaccctctttccaacacaccaggaagtccggaccga

SEQ ID NO: 238486 - DNA, 663 bp, Homo sapiens
gtgtgtacgtgtgtctggggctgctagcctgcagcagctttgggcctctgatagagttcctgcgtgtaacttaaccactaattctgaccgcggctctgtgtgtcactgtaagttacctgtgtgtgtctggggctccaaatctgtggctgtgagcagctggttgtgtgcgtgttgtgtctcattccatctgtagctccctgtgcaaatataaattacccctgtgtgtctgagtgtgacgttggagtgtttgtacatgtgtctggagttaccgtgtgtagcagctctgatccttcttgggctgtgtgtgttttaccattaattctatctgtagctccaagcgttgctgtaagttaccagtgtgcgtcccattgtgacttagtggtgtgtgtacaagtgtgcctggggctctgggttctaccatgaccctctgtgcctgcatatgcctgtaatttagctctgaaacgctcttctttttttttttttcttttgaaatagagtctggctctgtcgcccaggctagagtgcagtggcacgatctcggcccactgcaacctcctcctgctgagacaggaggatggcttgagcccaggaggttgaggctgcagtgagccgtgatcatgccactgcactccagcctgggtgacaaagccagaccctgtctca

SEQ ID NO: 238487 - DNA, 3367 bp, Homo sapiens
  misc_feature (3233)..(3233): n is a, c, g, or t
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgatgttacatgagtgcctaccctgcatcctgtcccgcattgtgctggggacagagcagtgacccacagacccgtgaaggacttggacctgtcatcagacagtgacggcccagagtagtccaggatgggagctgcccaggggactgtggggtcacgcatgagccaaagtcctgaaggacaaataaggatttgctaggcaaagaagaactacgatctggacagacagaatggcatatgttaaggcttggagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238488 - DNA, 2867 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 238489 - DNA, 3007 bp, Homo sapiens
  misc_feature (2873)..(2873): n is a, c, g, or t
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238490 - DNA, 2738 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 238491 - DNA, 2577 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 238492 - DNA, 2280 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcatctccgctttggtttccaaagcggagatgctgacccctatagttaagttttgtaagcggaccctcagagccagcatctccgctttggaaa

SEQ ID NO: 238493 - DNA, 914 bp, Homo sapiens
  misc_feature (780)..(780): n is a, c, g, or t
catctgactccaagctgctctcctgcaggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238494 - DNA, 863 bp, Homo sapiens
  misc_feature (729)..(729): n is a, c, g, or t
agttgtttgggggtgttcagagcatctagaccccaggaatcctgacctctgacccctgtccccagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238495 - DNA, 1230 bp, Homo sapiens
  misc_feature (1096)..(1096): n is a, c, g, or t
cacccgccaccacgcctggctaatttttgtatttttagtagagacgggctttcaccatgttggccaggctggtcttgaactcctgaccttaagtgatccaccggtctcagcctcccaaagtgctgagattacacgcatgaggcactgtgcccggccgttatcccggttttatacataggtaggcgatatgaggcatccagaggttcgaggagctcaggagcttgcccgaggtcacagagtgggtaatggtgacagctaacatgtgctgagcacttagtgtacaccaggttctcagtgctcttcagaaccctgaaataatcctgtggagcagatgtgttatagacccgtatttcaaatgaggggattttggctcagggtggttacgggacttgcctgaggttaactgaggtaacaagcagcagagccaggatttgaacctaggccatcggggtcacaggcacacactaagccccttcctctgctgcctctgagaagttaaactgggtgcagcatggctgtgctcttttcaccaagggaccctggggtggggcagtatggcctctagaccgtcctcagtttctcaatggcaaggtgggggtgggcgacatcaccccccagcctccagcgttcacccccgaccctgctcacctcctccccgcagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238496 - DNA, 1094 bp, Homo sapiens
  misc_feature (960)..(960): n is a, c, g, or t
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238497 - DNA, 267 bp, Homo sapiens
gtgtgaacagtgtgagaccccttgtggctctctgtaggcttggaaccctcccttctaagaccctgggagtacccaggggcactttggaggcaataatgataactgacgttgtccacctgttacagttagtatagcatgtgccacgcattattccactacctggccactgtgtcctcgagatccacgccctgctcggctgcattattcccaagtcctgcttgactgtgagcatcagggctctccaccagctacagccactgacacctc

SEQ ID NO: 238498 - DNA, 2972 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 238499 - DNA, 3120 bp, Homo sapiens
  misc_feature (2986)..(2986): n is a, c, g, or t
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238500 - DNA, 2377 bp, Homo sapiens
  misc_feature (2243)..(2243): n is a, c, g, or t
gtacctcatggcgagctgcagctcgggggcgagctgcctccccagaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238501 - DNA, 2294 bp, Homo sapiens
  misc_feature (2160)..(2160): n is a, c, g, or t
tccccacttgggtcgcgttgcgtcctgttctcccccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggtgagttggaggtcaaaggaggttgaagggttcgggggagaacaggacggtcggcgtgcagagttcctggagtgctggggggcctgagatggttgtatgacgtctggaggattcaggagggtgtatggggtctcaaggacacagcagtcccgcttcctcccctttcccacaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238502 - DNA, 2898 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgaggtaggaggcgccgctcgggcagggctcggggctgcggggctgcagggtcctgtgttgaaaccccaccgtgcggcaggcacttcccctctccggatctcagtgtcctcctctgtaaaatgaggaagccgctcagagtccccaccccacagcattgcaggggaaagcatggaagcatggatggaagacagaactgattggctcacgtcctggagaaaagtccagaggcgtctcacattaggcacggccgggtttggtcactcaatggcagtaagagtcagtctctcgtgcccactctgccctgtgcccatctccagggttggcttcattggaggccacccttttccccc

SEQ ID NO: 238503 - DNA, 1482 bp, Homo sapiens
  misc_feature (1348)..(1348): n is a, c, g, or t
tggagaagggatcagatagctcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaanaaaattcagggattttatgtacggtgcgggaaaaacagttctgaattggcctggactatgactttccggccccgtttctgtgacacgtgggaatctcccgtcccctaatggagccttatgccaaaccgtacctt

SEQ ID NO: 238504 - DNA, 2377 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccggtgagtggtggctgggcccctccacccgatgccctggtggccccagggcctcctgtccactcctcaagtcagcagcagagccttggttcccaccctggtggaggaacagaagcgtggggttcctgaggcccttgtcctccgaatagtggagggtagaggaagagtggccctgggatggctcctcccatctacagagggtgtttgagcctcaagactctgaggatacagcaaagccaggcaatatcacctctctcagggagctcatattctagtggggaattggacaatagagaaatgatcaggaaaatctgcagaacattcactggcagttaggcctatggagaaaaatgaggaaaacacggcaggctaaagaagcagggtgtggaggctttacacccgacacgctggtcagggaagggcc

SEQ ID NO: 238505 - DNA, 1732 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaaggtgacggaggacccggtgacgggaccacgcggtcccccgctcagcaggccgcctcccccaaacatgcaaagccccatttgttctgcaccctgagttctctccgagctgtccccttctctctgttctcccggcccaggcgcccatcacccctgacctgatccccgcaccagcctctcctctctttccctgcaacctgttacctcacacagctgctcaggaacagcagaaatagtaaaactcttccatgtatgtggcacctcagccgcccctcccttcgtaagtctccccgatgttgtgtcctgtccctgtcattgtggcctcatgtccgttggttgcaagatggctttctcaccagcggtccaacaagaagggggacaggtgtgggggacacttcccagcagacttctctttgtgttttgttggttaaaagtggatctggccaggtgtagtggctcatgcctgtaaccctagcattttggggaggctgaggcaggaagattgcttgagcccaggaggttgaggctagcctgggcaacatagtgagaccctgtctcttaaaaagcaaaaaattaaccaggtgtggtggcacgcacctgtagtcccagctactcactcaggaggctgagacaggaggatggcttgagcccaggaggttgaggctgcagtgagccgtgatcatgccactgcactccagcctgggtgacaaagccagaccctgtctca

SEQ ID NO: 238506 - DNA, 1500 bp, Homo sapiens
gtccaggagcttctggccagggcatagtagttgctagggacccttttctaggtactaggggagggggctccccaacctgcgggcaggcagctgcctccacgatgtttggttttaataaagtctctttgtttccttctctgtctctctgcccctctgctttcccttctctgtccagtccctctctccccggcttctccctccttctaggcctctgcggcccctccccgccttccctcccgggctgggggcggcgccgtgacgcggcggggcgggggaaggaagggggtgtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgccctgcgcccggggcgcgcccaccgcgccgcatccatgttcgaatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaaggtgacggaggacccggtgacgggaccacgcggtcccccgctcagcaggccgcctcccccaaacatgcaaagccccatttgttctgcaccctgagttctctccgagctgtccccttctctctgttctcccggcccaggcgcccatcacccctgacctgatccccgcaccagcctctcctctctttccctgcaacctgttacctcacacagctgctcaggaacagcagaaatagtaaaactcttccatgtatgtggcacctcagccgcccctcccttcgtaagtctccccgatgttgtgtcctgtccctgtcattgtggcctcatgtccgttggttgcaagatggctttctcaccagcggtccaacaagaagggggacaggtgtgggggacacttcccagcagacttctctttgtgttttgttggttaaaagtggatctggccaggtgtagtggctcatgcctgtaaccctagcattttggggaggctgaggcaggaagattgcttgagcccaggaggttgaggctagcctgggcaacatagtgagaccctgtctcttaaaaagcaaaaaattaaccaggtgtggtggcacgcacctgtagtcccagctactcactcaggaggctgagacaggaggatggcttgagcccaggaggttgaggctgcagtgagccgtgatcatgccactgcactccagcctgggtgacaaagccagaccctgtctca

SEQ ID NO: 238507 - DNA, 412 bp, Homo sapiens
caacattcaagaacagatgagtaatgtaagaagataaagggaaattctgaaaaaataaccaaaagtaatgctagagataaagtggatagtaacagaaataaagaatgcttttgattagctcctacattacttggattggctgaaagatacttaggaaataccaaactatgtggagagtagacagcatatttctacataacacataggtcaaagagagcatctcgggagaaattttaaaatagttttgaactgatgaaaacacagcttatcaatatttgtgggatgcagggcttagagggagatttatagtattgaatgcataattagaatagaaaaaagatctaaaatcaataatctaagtttttaccttaagaaactagaaaatgaaggacaaattcaatccaaataaggc

SEQ ID NO: 238508 - DNA, 757 bp, Homo sapiens
aatctatccaagattcccaatttacctctgtttctcttcccattcattcttacatgcctttattcaaaaactactgaatgtcttttattccctgaactggcttaagtacattaaagccccttaattactagtgcattgctgagttggcaggctatcacaaggaatgaaatcttaatggagtccacctatctgaaattcatagcctctgcccatatacttagcctgacaccagttttgggagagatataaactagatagtaggtgtgcatttaagcaggtaaaacattgagatggctaaggacgatagtggcgtcacatgtggtacattagatccaaaagaaagcaataaaagcattttgtcatttttggagaagatctagaatatgttagagtagctatcagccccaagggagacagtaatttaggctcctggtgcttgactcttaaaaagtagcttaatcatgaacagaagaaaatgatctgaagatcagatcctcagagccaatgtttcaactgtgttcctcagacatgcctcagaggccagttctacattgcaggtgggaggaggggctggaggagggagtcaatgaatgaaaacattttttccacttttagtttttcttaagtcttcctctgccacaataggaaatgaatagatactgtttaaaattgattaatcaagaagtagcatggtaaacatagtattttaaaagtggatataagaagaaaatgtgtagaaacctagaagaaaatgcta

SEQ ID NO: 238509 - DNA, 346 bp, Homo sapiens
tgtcctggtttaacagtggtttagagtgtaggctctggaacaacaatgctaaccccgggagcctggagccgctatcgatagaagacctagtgcaagtcattcaacgtcttcattgcctgccattcctcatatgtgtcaagtgtctggaagagtacctgtcccataacaagtcttcaattacctggagcaaatgcaagaaaatttaaaagctagactctctgctagctttcacggctacagaagggctctaccatgaactaagctgataggagccaaaggaattctatttcaaatcctaaaatacagttgaaaccgcccatgccaacaaaactttacgaaacatccc

SEQ ID NO: 238510 - DNA, 1930 bp, Homo sapiens
  misc_feature (643)..(643): n is a, c, g, or t
  misc_feature (1136)..(1136): n is a, c, g, or t
  misc_feature (1583)..(1583): n is a, c, g, or t
ttgacattgccaagcacccagtgtatcttatttctaatctctttgcccatgagccagagccgcttgcccaagggctcccagccaggggctgtggagttgtcaggtttgtgcctccgaagctgtgtcctgaccactgtggctgccgctcctggaggcctcagacctgctcccctacacacgtgggcagcaggactcccgagggcctctccccagacttcgggagaaggctcacctcgtgggagggagggctcgctcatgcccatctcctttcgttctttgcgggccactcggccaactgacgtcggcctctcctgtctggatgtccagtttctgtggctcactcctcaagccagatcatctgggactgagggtggcctctgggctcctgtagacttccacagccaggatttcacatccctccccagagcctcggaccgaacagccacaagcagccatgagtgtcgtgcctggactaagctggagagacaaaggcgtttgtggcaagggcccagctggaagccctggcaggccagagcatgcatgtgctggcttgcacgagcatactttggtgtttgtgttggggacaccgggcttctgagggactggcgtggctccagggtggggagcagcctggttgaagcgnggccaggcactcactctgttgttcagatcccagctccactgcctgctgtgtccacagtctcctcacctgtcaaatgggaatatctatgtggcgggagggtgctgaggtttccacgagctaatctgcctgctgtgtagtaactagtagcttttcttactgttagtgaacttgttttagtctgaaggaaggcacccatgccccaggtgaagtccagctgagttcagtgaggacgatggagacccttggtcttggcacccttctgccttacactgggaatgcctcaggcttgctcctgctgtgtgtctgtggttgcccactttctgctggtctccgagagactgattcaggtgttcaggagtctgttcgctattacatcacctccttgtgagaaataaagtggagcagcctcatccagacagcaaagcaaggagggagcgtgaggagcagccaggtgagctggtggcatggggccgcctgtgcagaggccggcctngctgcttcatgtggctcagggaggctcagcacgtccgtcatcacacctcagggcagcgagagtggacctggtgccttcagaagcccacccgaggcctgctgctctggcctgcaaaggtggagtcaccaaagctcattacaaagtgtttgcttatttttgtctgccctgcatttttttatttcttgcaaaggcctcagaggatgtgggccccagcccaaacacatcttgttttcactggtagagcttttcctagtgtctgcacaggggtgcttccagtggctctgccatagccccagacaagctgctgacacggcagccatgaggtctgggacaggttccagggggtgcttttggcctgctccagcaggagtggaggctggactggtctccagcaggagtggaggctggactggtctccagcaggagtggaggctggtctgggctccngcaggagtggaggctggtctgggctccaggagtggaggctggtctgggctccagcaggagtggaggctggtctggggagagagctacacctccccaggcccaggtctcacgaaaggagcatcgaagggcaccgaggaaaaagccacttagccctctcctgtcctgcaccattatctgggcccattggttcttgggtccctgtctttctcaacaggcagccccagttggggaattaagttgattctggactggctatgcctaatgatagctgcaatttgaaacccataaagttcgagttcagcaataaagttggggaggcagtgtcaacaccttccttgtagaacggc

SEQ ID NO: 238511 - DNA, 848 bp, Homo sapiens
gaagagacaggaaaactaggattacttcccagatctctagtatggccccgaaatgcaatcaactgaccaggttaggaatactgaaggaaaagcatgacatctactcagatctcacagtaaagtctgctggatacatagggcaagtatcactagcatagaattatacaacagctttaaggggaagttgcaccaaagtaagagggctaagattgaatattggagaacatctacttttggagggatggtgatgaagatatgtagcaaagaggtaaggaagaagaggtcagcatggtagcattgaaaaaataggacaggaagatttttttcaaatatcaaaattatatggctaaataagaaaaaagtctgaaaaaaggctaattcgggtttcaggagtttactggtgacctttttgggcttaacttcaattgaatgatgaaaggaagacaggtttaaaagagagtgtagattctgagaaactaaaagcaagaggtcaatttactaattctagatatttaataatagaagagaaacagaacttactgatagtgtgacaggacagtggggtaagccccatagagctttgaaaacagaagaaccgattgaagatctaaaaacagtggataagtgaagaagcaaagatgtggatgaggaaaccagcaagaaaattagaaacccactggaagaatgggaaaaaaatagagataaaatgcaaaccttttggggtgacagagacggaaaaagatgctcattcctgggaactctcttctaacagtaagtagaacataaggtcaaacgtccagatactgacactgaaaaaggatgaggaaagatacagtggagaatggact

SEQ ID NO: 238512 - DNA, 351 bp, Homo sapiens
gaagagacaggaaaactaggattacttcccagatctctagtatggccccgaaatgcaatcaactgaccaggttaggaatactgaaggaaaagcatgacatctactcagatctcacagtaaagtctgctggatacatagggcaagtatcactagcatagaattatacaacagctttaaggggaagttgcaccaaagtaagagggctaagattgaatattggagaacatctacttttggagggatggtgatgaagatatgtagcaaagaggtaaggaagaagaggtcagcacggatgcaaataaacattagtccaggcaccttttttgccttggtctactcaatttggttata

SEQ ID NO: 238513 - DNA, 480 bp, Homo sapiens
aatatgatccaagggaatatataagaatttataataattgtgcatatatagccttctgagattattggtggatctaggtacaaataacagaatctgtgggatgaacagaatactgggacagagtgagacattaaaaaagacttacactagtcaaaggcagcaagaagtggttctttgtccatttttaaaggttaagtggcatatcagagggaagaatgtgcccctgcgttgggggctatttaagaagaggtggtcttccagggtagctgtattactaaagaggtaagagagattgtatagggagaggtgcatcattttaatgtgatggtaagtagacctttgctgatcttaagtaaattttcaataaagtaccaagagtaggaactgaattagccacaagctatttgcccggaaatcatatatcatgtacaataaactcacagagtttgcaaataaacagaaaaaaataaagtagttgta

SEQ ID NO: 238514 - DNA, 339 bp, Homo sapiens
cgcactcggtgggctgtcctggggcacccatgttgtgtgttttggttttgtttattttgtatctgcctggtttttccaagtctaatcaggatgtcccctggggtgacattctttgctgagagaagggcacatgcctcggttccctgggctgtagaaagccagtgctcagccttgctttctgccgcagacttggtgcccggagactcgctatcaaagtgcagtggagataatgtccaatgggaggctgaggcaggagaatggcatgaggcagagcttgcagtgagccaagatcgcaccaccgtactccagcctgggcaacagagcgaggctctgtctcaa

SEQ ID NO: 238515 - DNA, 472 bp, Homo sapiens
gtgtttagagtgaaaacgatataaattcagggaagaagagagagacagtaatgggagtactttaaacattaacagcaatggtagactttaaaaacatttttcagtccttgctgcatcaaagtgataaagaaatatgatataaagaatctgagtcatataatttgcctgtctgatatataaggctgatgtaataaatatatcattctgttgttgtaaagagaaaaaaatacttttaaattcccctcagaacattttttaaaataggttatatttttaaacattgttaagtaggttacattgtattataaagaaagctgaaaaaaaaactaaaaagtagaaatattattaaccacatactctacaatgaaattttaggttaataacaaaagggagagccagaaaccaaacctttccaaatcccaaaacaaaaacctcaattacttgaatttaaaaatgtaaaattattgtccct

SEQ ID NO: 238516 - DNA, 445 bp, Homo sapiens
aatgagaagataaaaatccaggttatcattagccacattcactggtcaagaaaaaggcctctgcagaacacagctgagcagaaccacacagaagtggaagaagcaaagaggtttccagaagactaggatggtcggcagagagtatccgaattattgctccatgctgcgagatccctgttcctaggaaagccgaggtctgccttccaatgtgcaattctagcttaatagggaagttatatcactgttgacagtcttgtcctttcttaataaatcttaggagttatcccataaggaatattcattttccttcagacatgaagtgaccattaagatgcgccagtaaagaatccatggctttcagtgtctggccctatttcttctagttcaagaattttaagaaaaaatattgcaataaaaggtatatttttattagctacaaagtgga

SEQ ID NO: 238517 - DNA, 374 bp, Homo sapiens
atacttctgaaataattccagatctcatacattaagttgaaatcaaaagctgtggatcatgttataatataatatatttgaggtcaaaagccttcttgctgagaaaaagagaaaagggttgataagcgcaagagtgcatgtgtgcctgcaacagcaatttggtgtggggagttctcgaggacagcaaggatgtgagccatggcagcaaatcaggaggaagctaggtgttcaccacattaaccttatcattaagaaaacaatctgcctctcttggcctgggaatccctcctgagtgcttctaggctgcgagtgtcaaattgttctttacagatgctgagcagaagaggattttccatttcatcttttggccttcc

SEQ ID NO: 238518 - DNA, 346 bp, Homo sapiens
aaaacacccctgaatggtcacaacttcagaaaagagaatatggggataggaaagtaaaatgagattgtttggtacatgagtatcactctggaaaattccatggatgggaggatgttccaggtgcacattttaagcaataactcagcacagagtcagattgtgcagtgtaacaaaactgtccttagctgcatatttgtcagtctttctggaaggttcccagctcccccaagatggcagctggctctcgtccctgaggtcagaaagaacccctcccccgctgccctaggactcacagatttcttcacaaaagacacaaactctgcatggtcaaagcacatcacacatg

SEQ ID NO: 238519 - DNA, 420 bp, Homo sapiens
atagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaa

SEQ ID NO: 238520 - DNA, 137 bp, Homo sapiens
gtttctatgtcttttggttttctttttcatctttcttccctttacatctctgtctgtctattttctttttcttgatcttccttactctctctctcttttcttcatttctttctttccatccttctgtcgtcttctcg

SEQ ID NO: 238521 - DNA, 395 bp, Homo sapiens
ttttaaagtgaattaacgaacaaaagcacgtacagcgttttatttttaatgtacacatttaagatacaatgtcatacacttatggaaaggtgcataatgagataagcagtttccataatatagcaacttctgggttaaaaattatttctataaaatctgttattcgtcaggcgcggtggctcgcgcctgtaatcacagcacttcgggaggctgaggcgggaggattgcttgaggccaggagttcaaggccagcctgggcattatagcgagacccccccccccaactctaatagtctcagctacttggaaggctgaggcaggagcatcacttgagcccaggagttctaggctgcagtgaggtatgtcagtgacaacagagcaagaccctatctttc

SEQ ID NO: 238522 - DNA, 532 bp, Homo sapiens
gtttttaaaaaattgctttattacctcacataccatttacatgcactttatgatatttacatgtaatttatgtacaataaacttcagcaattctaagtgcacactttgaagacttttgacaaatatatagtcttataaccaccaccacaaccgtggtacggaccctttccatgatccccaaaagtttccttgtgtctcagtgaagtcagtcccctccccccactctgggctctggaaacccagatctgctttctgtcatgacagttttgctttttctagaatttcatagaaacagaatcaacagtgtctcacttggcgtcccgttttgtcataccttttatgctgtctaaatgggggatgctggttttgatttgaagcaaagggagaaaagggtgatgttccgggtaacactatctgttcggaggcttgttgcctagtatcgacactctctattcatgggaaaaggtatcgctcaaggttaaactgcagaggttagtttccttgtatttatttaatgagctgaattgctatt

SEQ ID NO: 238523 - DNA, 595 bp, Homo sapiens
tttgctgcatccctcaccatgtggccccttcaactctaaaaccagtaatgatgcgtggaatctttcacaggcttggactctctgacctcctctttggttaacagccagggacaaatcgagttccagagggttctcatgatttggttaggaacacccaggtggtctccctttccttgtactggtaacacaatctagtcacaggagtaaagtgcatcctattaacagtctgaagattagtgggagaaatcatgatgccattttagcctgggtaatttataaagaaaagacacctgcctggctcaaggttctgcagacagtacgagaagtgtggtgctggaatatctttccggtgaggcctcaagaagtttacagtcacggtggaaggcaatgaggagccagcatatcacatggtgacagcaacagccagagcaaaagagggagggagaggtgccactcacacttaaacaaccagatctggtgtgaactgactcatcaccaaggggatggcactaacccattcatgagggatctgcccccatcatccagacacctcccaccaggcctcatctccaacactggggattacatttcatca

SEQ ID NO: 238524 - DNA, 540 bp, Homo sapiens
tttgctgcatccctcaccatgtggccccttcaactctaaaaccagtaatgatgcgtggaatctttcacaggcttggactctctgacctcctctttggttaacagccagggacaaatcgagttccagagggttctcatgatttggttaggaacacccaggtggtctccctttccttgtactggtaacacaatctagtcacaggagtaaacctgggtaatttataaagaaaagacacctgcctggctcaaggttctgcagacagtacgagaagtgtggtgctggaatatctttccggtgaggcctcaagaagtttacagtcacggtggaaggcaatgaggagccagcatatcacatggtgacagcaacagccagagcaaaagagggagggagaggtgccactcacacttaaacaaccagatctggtgtgaactgactcatcaccaaggggatggcactaacccattcatgagggatctgcccccatcatccagacacctcccaccaggcctcatctccaacactggggattacatttcatca

SEQ ID NO: 238525 - DNA, 424 bp, Homo sapiens
atattctaaggatccttagttcagtcttcttataatgtgtaatactggcatctcattctgccttcatacctaaataaaggtgcaatttcttgcagaaattgccctagacaactgtcctaggtctataactaagtcaggcaagaactaggttcatttaccttctaactataacaatcacattgaaacagttttcacgcctgtaatcccagcgctttgggaggccgaggcgggcggatcatgaggtcaggagataaaaatacaaaaaattagctgggcatggtggccgcgcgcctgtggtcccagctactcaggaggctgaggcaggagaatcgctggaacccaggagacagaggttgcagtgagccaagattgtgccactgcactgcagcctgggctacagagcaagactccgtctcaaaaaaaa

SEQ ID NO: 238526 - DNA, 364 bp, Homo sapiens
tcatcttgcataactgtaactccgtacccattaaacaagtgcccattcttgcctcccacagcccctgacacctctcattctattttctgtctctataaatgtgaccactctagggaccacatattagtggaatcacacagtatttgtcatactgcgactggctaatttcacaaagcatcatgtctcaaactgcatccatattttagtaggtgtcaaaatttctctcctttttaaggctgaaaaatattccattgtatggatatacatactgcatttcgtgtatccattcatctgttaatggatattgggttggggctgcctctatcttctttctttttttttttttttttttttttttttggag

SEQ ID NO: 238527 - DNA, 450 bp, Homo sapiens
ccgcgtccactacggctgcgagaatatgacagaaggggggccctgaaggcggaggttgcagtgggctgggattgcgccgcggcactccagcctgggtgacagacggggactctgtctcaaaaagcaaaacagagcaaaacaaaacaaaaggagcttttctgaatcagggtatcggcttctgttcgatgcctgcctcccacctttctgagttgagttaactcatccagaacacactttgggaagacactgaaacactgtagaatgtgggcatgttggcctctgctatttgatgtgagttttattatctagaggaaaattgcaacattatatcctttgggtaatctccagtatttatgggctcaaatcagtgttgatggtgtattcttttgttcacttattcaaaaaaaaaaaatctacataaaaaaaaaagcggccgctcgaattgtcgac

SEQ ID NO: 238528 - DNA, 354 bp, Homo sapiens
ttagacaccacaccagaggaataaatggaaaataacttgatggagatgagtgcttccaaaccagtaccagatgataagcaagaagatgtggaagaaacagtaccagaaaataaattaactatagacagtctggcagaagggttccacttattcaagactgcctttaacttcttttacaacatggacccttctaaaatacgggcactgaaactaaagcaaatggtagaagaacgattggtaccataatataaagatttatttatttattaatttttttgagacagagtctcagtccgttgcaccactgcgcttcagtctaggcgacagagcgagactccgtctcagaaaaaaaaa

SEQ ID NO: 238529 - DNA, 347 bp, Homo sapiens
ccatgagaaataggtattttgagtgtgcctctttactaccgaagcacaaagaagataagtaagacattgaagtgattggaggaactctctccagagcctgacgacttctctctacagcagggaactgcctccattgctgatgttggattaaacagaacagcctgtgcagttagttcatggattccataaagggactggaccttaatgaagacgttcctgacatgggtttggggtaagaaggagagtctgtttgcaaaattattattgataataactagaatttaaatgtatatcttttcttggttaattaaataaattaatcagctccccatctgggccagaatatc

SEQ ID NO: 238530 - DNA, 4130 bp, Homo sapiens
agttgctgatggccaggtcctgctggtcagccgccttggacggagtctcgggcctgcttttccgttttctgtccccttactctggcttctggatagcctttggaatattccgggcgatagctgggcctccagagagagtgggctgcagggtgtgggcccggcctccccttgcctggcgggttttcctggtcagcgttcctgctgctccccggtcatccctcctgtgctgcagcctttttctctggttcagacccacactctgccgtcccactgcctgggcttgctgagctctccgttctggcttgaaggcctcgcccgagccctgtcaccggctctgcctgtcaggagggcccaagtgtgcggcttcggtggggctgcctgacactgacctctggggttgtaaaggtcccagagggtcctaagtcgggcctgatgtggctgagatggcaagagccggaacgtttctgtaaaatctgaaagcccttgatggggccgagggggtgaggaggattcccaccctgtgtggacaggagcacgcagcagcggagtgactccaccacgtgagtggggtccagcgggtgtggcactcgatgacaagacagtttgagagcggcttgtctccggggacctggcgtaggtctcctctgccttaacccttggcttttgcacttcctctgtctgtcctccatacaggcttcttgccctagtgaggactggcttcttaacagggtgagccggttcctgtcctaaccccactggcatcttacactctgggagatagcttccccctgagaggcgagtgagccacgtaaggggaggtgggcgatggcttcccttctgtcttgggttgggggagtcaggtacagtattttttcttttaaagcatcattgatcacataataaggtttgtcatagtccttaatcacagacctgtgaaatttggagaattcacggcacctaggatgggagtgagcttctgattgtgagctgatttgggagctaacctcaaggaaactcctcttgcaagccccctgctgggtgtcgtggccctcgcccagtgacctcccggggactctggacgctctttgtctgcccttccttttccctcacctcgctcccccgtgagaaagtgggactcatgcagctcagctcagtgacagagggtttattaggggtagctctgggacccatcttttggtgatttcttctctctctttctctaatggaataattgtttctgtctacacttctttattttctcctctctacagctgccttctaaaaatgtgcttttctgttcctgcagaactgaagcttgcatggcctttgttgtgactttcccgtcacgagcgttgtctcttggtattttcccataggccagcctgcaggtcatacgttgttcattttttttgttgtggttggtccagtcagccaggaccagagcaggtgggaccatgtggtgccacacgcagccagctgggcctcttcggcaggcgtgtgggcagtgggcaggtgggctgactgccactctcagatatagagctgacaccgagactggatgctgtgctgtgctaggcacaggaggggaggggaacagatgtgagtcagatgtgcggtttgccctcacaacttcactttctagttggggaattggacatttacataaatgtacaaacacctgtcatacaaaaaagaaaggaataggtgtcatccaaataccacctctgttggggtatgtggtgggcagcctctaacacggcccccggtcatccctgcctcctaggagtcgtgccctggtgggtccctgtcccttgatgtaggctggacttattgacatgcttctagtgaatagaatctggcaaaagtgatggcctgtcactctgggactgtgttataaaagcctgctgcttctgtcttgggcactttctgtctctctctctgagccttgcctggaggaattcagctgccatgatatgagctgccctgtggagaggcctgcatggtgaggaactgatgtctctggccagcagccagggaggatctgaggcccaccagcagccacacgagtgagaggggaattgagtctttacatagttgagccctagccaaccttgattgcagcccgtgggccagaggctaagcttgcctgaattgtctcagataaataacatatttatcttacagcttatttatttatctgtaagataaataaatatttgttgtttgcagctgctaagttttgggttaacttgttatgcagcagtaggtaactgatacaaggggatctcagcacagagagagctgtgaagtgccaaggaggcggcacctttggctaaggaatttggggaaggctttgaggaggatgtggtatttgagcaaggctatcttttttccatagagtgtacacctcttgtacaaggtagaacatcttgcacataacagaaggcctgtctgtcggtcccactttccaaggtgagtagaataaagtcactgttttcctgttgcctgagaacctccaaaccctctgttgaagaagggcagggctggctgtttcctggagccctcctgcccagccagacgtgtggcatctctgatgtagctgagtctcccgggcctggtggcctccatctgcagtgccaccaactgtgtgtggggctgctttgcacaccatatgctgattagggagcaacaacatgggacctgcaggcccgatgccccaggcgctcctcagacccgcgagccatcccacagtctgcccggggcagctcctcacctgccctcgtggctcttccaggctggctcagcctgtggtagaagggtctgaagacccaggttaaagccttgtttctctctcttactgatggcgaggcactgaacatcctccgtgggcctttttttttccccctccaccttttattatggaaaatttcaaatatccacagaaggagagaggagagcataatgaatgcctgtgtactcatcaccggcttcagtagttaccaactcatggcctcctgttgcatttctaacgttcatgttcattccggcaaatgtctgttctttagatggattagtccacgttgaaaaaatgtcttcaccattatcctagcattcactcaggcttccagaagctatgttggggaacatcactaatcatttaagaaatgcaaatcaaaatcacagtgagataccagctcacacttactaggatggctactattaaaaaaaaaaaaaacagaaaaaaacgagtactgatgaggatatggagaaattggtactctgtgcactgttggtgagaatgtaagatggtgcagctgctgtagaaaatattatggcagttctaaagaaatgtaaaatagagttgctgtatgatccagcaatcctcctttgggggcatgcccagattgaaagcaggatctcgtcgagataattgaacacccatgttcatagcagtactgttcacgctagccaggaggtagaaggatcccaaacatccatccttggataaatggagaagcaaagtgtgttatatacgtgcaaaatggtgtactattcagtcttaaaaaggaaggaaatcctgccatatgccacaacatagatgaaccttgagaacattatgctaagtgaaataagccagttacaaaaagaaaaatactatatgattctactaatatggggtacataaatagaaacagtagaatggtggttgctgtgggaaggcagaaatgggagctgtctaatgggtacagagtttgttttgccagatgaaaacattgggagatctttttcacaacaatgcgaatatacctagcactactgaatgtgcacttaaaaatggctaaaatgggccgggcgtggtggctcatgcctgtaatcccagcactttgggaggccagggcgggtggatcacctgaagtcaggagtttgagactagtctgaccaacatggtgaaaccctgtctctactaaaaatacaaagaattagctgggcatggtggcgggcgcctgtaatcccagctactggggaggctgagtcaggagaattgcttgaacccaggaggcggaggctgccgtgagccaagatcgtgccattgcacttcagcctgggcaacaagagtgaaaatcagtctc

SEQ ID NO: 238531 - DNA, 596 bp, Homo sapiens
ctatacctaataatgtttgctgagggcttccagtgtttggtatctgctacaggctacgattatttgtaaatacttttgacagaataaatgcaagagatgatcacagtgtggctatggaacactttgatgtgaaatcagaaacatctgtaatctggattagcaaagcaatattcactttaatggcaaaaccgaaatcagtgcaagcatacaaaatatttttattgttaaagaagaaaatgagcttaaatgaagcaaaatgtgtttgaatgtccagcttggtgatcacaccaacatctatgcaacatgaaagaaagttttctatgtctggaatgtttgtcatgaaataaaagtcaagtctcaaggcaattaatgttttatgtgttttaaatttttattaaaaattggtggcttttaaatatcaaatatttgtgatatcatctgtaaatttttaaataatttctatttgacatgtgttaatgtttacttcacttgatgttttctattattagatgtctatatcaggtatagatcatttttatgttacgaaaatatcgatcttatcacaataccacaatatattggttgataattataaa

SEQ ID NO: 238532 - DNA, 533 bp, Homo sapiens
tgggccttcattttcattgccattgaatatagaagggagaagagaaggaagaactaatattggtttatttttaatgttagaacgaactggtgtctgaagtcagttttgatttacatatgttaaagcaggtagggacaatcccctctccaagtactagatccagtcctagacaaagaggaaaaagccgatttctacatttgtaaaagatttcattttttgtctccctaaaataatttatcaataagattggcagggtggggtgaggggaaacaatatgaactgtacttgtttacattgattgaaatagatcaaaaaacctctctcaatgtcctggatattactttatctctctttgtcttccttttggaagtctctttctccaactttcagagatatgccagaggaaaagagatgaatataatcccaaattatggactagggttccctttatgaggaaagtaagggagaaaagggagattccagaaatacaaatgaaccaaaaaatttggaattaaagttaagtggtattggct

SEQ ID NO: 238533 - DNA, 249 bp, Homo sapiens
tggccctaacctgaaacgccatgtgctgttgagcatgttgtgtctcaatcaagagataacgaaggggaagaaccaaaggtaaaatcagcaaggagatggaacaatggtcttaaaatgacagattaataacacttgttctctaatggggagatgagggctgacaagtctagggactggaaaatcaataaacatactcctcttcaccagcactcagacatttgtatccagagaaagcttccttaatgctca

SEQ ID NO: 238534 - DNA, 2021 bp, Homo sapiens
  misc_feature (1697)..(1697): n is a, c, g, or t
ccaaaaaataaattggaaaaattttggagatttcctacagtttggaaaacagatgaactacatagcctaggaatattgaaaacattgctcacctgggccctgcggccagcagaattggccccgctctatggctgctggggcctgcgcactggaatcgccgtggcctgcgcaccccaccatgccagtttgaacctccatggcctcaaccagattcggaatgtcaaaaagcagagtgtctatttgatgaatttgaggaaatcgggaactttgggccacccaggctctgtagatgagaccacctatgaaagactagcggaggaatcactggactctttagcagagttttttgaagaccttgcagacaagccatacactttgaggactatgatgtttcctttgggagtggtgtcttaactggtaaactgggtagagatctagcaacctacgtgatcaacaagcagacaccaaacagcaaatctggttatcttctccatccaatggactcaagcgttatgactggactgagaaaaactgggtgtactcccacgattgcgtgaccctccatgatgtgctcgctgcagagctcactaaagccttaaaaaccaaactggacttgtcttccttggcctattctggagaagacgcttgatgcccagcccggttttaaggatattaaaagctgtcaggccaagaccccagcttcattatgcagctgaggtctgattttttgataacgtaaataggttctcattcctgctatatgaggaacagctctgtggaaagaacgtgtagcctcctaccttgccacaagttttgatttttaatttctacagaagattttcaggattaattgctgattcctcctcatatgatatcctttatctttataatgcttaatccctatacctgaatataaccacctttaaaaagccaaagaataagaaaggaaaaatttcagcaggagaaatgaattgtcctcactcttcattctttgaaggacttactgcagaagtaccatgaagagctactggttaacctgctcactggtactgtctcaaaattgagacacattaccgggtaggctacaatgttcctggactctttcaaagtgaagcacttcttgagctctttagcatgtgagtgtcaaaagcaattcacatgggaaagaccaattcttatatgtgcctttgtgacttgcccaggagtatggcctacacctgggttgtcctgggagacctagtgctgtttcttccacatattcacgtgtgtgtgtgtgtgtgtgtgtgtatttttttattattttttcattttaagggttagtatggaatcagctgcctactagaatgcaaagaacttccaatgacaagaaaggaggaaaaaaatgccattttcataagctgagtgatgtagcataataaacaaaatcatggagctaaggaggtgctttgtaaacgtgaaggggcataaaaaggaaagagatacttgtgtcaataaagagagcctggtcctagacgtagttcagccacaaagtagttgtgcctttgtggacaagtttcccaaactccctgagcctctgctttcccatactgttaaataaggggatagaatatggttgatttccagcattcagtggtcctgtcaagcagccttaacaggctagctcctaattcccattgggtagatgaggggatgacaangaacaatttgtgagctatataggaaacattgttattggtgttgcccctatcaggatttcagttgaattcatgttaaaattacagccgtcctttattgtacacttattgggttaagcctattataccatattacctcattttaatttttactgacctgcactttatacatgaagcaacaaggctccaggacattaaaactcacacaaagttatgctcatgttatattattttcttacttaaagaaggatttattagtgacaagtttgtattaatatgtagcaaaggcttttccaatgggtgaataaaaacacattccattatagt

SEQ ID NO: 238535 - DNA, 462 bp, Homo sapiens
gcatgcccactttagtgtcttgtggaagacattttccccacagcatgcaggtaagggggcatggagatggctgtgacagccgtccctgaagtcagtccccagaatctgacctcctgcgagtgttctgctggactttgggaagatgagcgccacttttcggaccctctctgctaagaagaggactcgaaaactctgctcactgcagaagcactggcgggacaggcgtcccaggctggcgagagtgggcactgccatgctgcccctcactccatctcgccccgggttcacacaggggacactgagcagcagctggacgtagacagagctaatggagtcttcccaggtggtccctcctttcagaaaggcccctctgtctgagctccttaactctgaaaccagataagaaggtgggagacaggggccccttttctcatgggattaaatgaactcaattgacagagc

SEQ ID NO: 238536 - DNA, 351 bp, Homo sapiens
gggaggcagaggttacagtgagccgagattgcaccactgcagtctgcctgggtgacagagctagactctgtctcaaaaaacaactttccagtggcttctcactgctctgagaataaactccaggctcttccattgcaaccaacaggatctgttgattcgaccccagcccctctttccaggccctcatcactttgatcctctcttaacctatcctgctccagctgcactggctgccttcctattcctccagcataccaagattgtttctgcctcagggcctttgcatctgctgttctcttcgcctggactcctctttgttctttttttttttttttctttgagatggagtct

SEQ ID NO: 238537 - DNA, 304 bp, Homo sapiens
gggaggcagaggttacagtgagccgagattgcaccactgcagtctgcctgggtgacagagctagactctgtctcaaaaacagaaaaacaaaaaacaactttccagtggcttctcactgctctgagaataaactccaggctcttccattgcaaccaacaggatctgttgattcgaccccagcccctctttccaggccctcatcactttgatcctctcttaacctatcctgctccagctgcactggctgccttcctattcctccagcctgggtgacagagtgagtctctgtctcaaaaaacaaaaa

SEQ ID NO: 238538 - DNA, 418 bp, Homo sapiens
cattcacacatgcataccttgaaaaggcaaataaccttggtttaaatcctctatcttatttaaatccatgactgaagttaagtaaaaccacttagaaaagtgtgtaatcagctgggcatggtggctcatgcctgtagtcccagcacacctgtagtcccagcactttgagaggcagaggtgggcggattgcttgagcccagcagtttaagaccagtctgggcaacatggtgagacctcatctctactaaaaatacaaaaattagctgggtgtggtggtgtgcatctgtggtcccagctacttgggaggttgaggtggaaggattgtttgagcctgggaggtggaggctgcagtgatccaagatcacaccactgcacttcagccccagtgacagtaagaccctgtctcaaaaaacaaaac

SEQ ID NO: 238539 - DNA, 469 bp, Homo sapiens
cagagcaggtgtgcagtgttaggacctgtggctgagctgacctaacagcctgcctggaggcatcagtcaggctcaagtagaacagcaaggcccccatcttggggctgtcgtccaggcacagagcggtcagcatctactgtccttcctggagaaaaaagggaaaatgcatttgtcatttaaatgttggaatgggccaggcacggtggctcctacctggaatcccagcacattgggagggcaaggttggatcacatgaggccaggagtttaagaccatcctggccaacatggtgaaaccccatctgaaaaatacaaaaaattagccacctgtggtggcgggtacctgtggtcccagttacttgggaggctgaagcatgagaattgcttgaacccaggaggtggaggttgcagtgacagattgctccactgcactccagcctaggtgacagagcgtaagactctgtttaagg

SEQ ID NO: 238540 - DNA, 389 bp, Homo sapiens
atttaactagccaggtgtggtgacatgtgcctgtagtcccagctactccagacaccgaggacagatgatcacttgagcctaggagtttgaggttacagcaagctttggtcgtgccacagcactgtagcctgggcaatagagcgagaccctgtctcaaaaaaaaatttaatgtagaacgttggtggttaaagatgcatgatataaattttaggataaccattaaaacactacaaagacttcctgtttatggtaaggtaatgttgggatgaaatgaaacaacaaaaatccgaaaagcaagaaaaaagaggaaaaggaacataggcaagacaagatgagatgagagtgatgagactaaatgtttgggggctaaatctgccccaattacttga

SEQ ID NO: 238541 - DNA, 937 bp, Homo sapiens
aaagaatcagagtcctataactggtaaagtaaaatttaaaataaataaataatgttaaatgttcctgataagggagataaggatttagaagtgactatgggtttagtgacaaatagtttgaaggtatagtgggggcagaacaaagtaagttgcagctgaacaagtcatgaatggaaggtagagaataataaggccaagtggacttcctttcaagctttgatttaagaggaagagagaagataagtcactcagcaaagagaagcatggaatctattctcaaagcgagaacaatctatgttttaaaaatgtccaccactcttctccatactagctgtatggtaatcctgtgttctcatctataaaatggatttctaatagtacctacctcatagggttatggtgaaggtcaagtcttcatagctcttaacaattgtttcttatctgtttcctccaccaaactacaagttcatgagcaacactgacagctctcagtgcataatgtggtgtattgttaataaatacatgttaaacaaatgatgcttctaaggctctgaccacagtgcactgcccaaggtaagcaccagagaagtcagctggggagtgtgatcctgttggggaagaagagagccacacaccctcagtttgctgttttccaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccataccaaaccc

SEQ ID NO: 238542 - DNA, 521 bp, Homo sapiens
cggccgctgtcttctgctgcggcttccgcgaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccataccaaaccc

SEQ ID NO: 238543 - DNA, 531 bp, Homo sapiens
cggccgctgtcttctgctgcggcttccgcgaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggtggttcctaacttcctggcaacaaccacaattgtaattcgttcaaagagattgactgctgtggagacagatcatcaccatcaccatcaccatcaccatcaccaccaccaccatcatcatcattgtcatcgtcatcattatgttgcttttagctcactggagcctcacagaaccctgtgaggtaggtattacctcagtttaccaaatgagaaaactggggctcggagggggtttcatggctgtcccagacttacaaagcaagtcagaaccagaatcatatctaaatcttct

SEQ ID NO: 238544 - DNA, 720 bp, Homo sapiens
catccccaggtaaaaggcccaggcactgggctttggggcatttctctaggagctgatatttgtctctcaatggcctcattcttgaagaatgactcagacacagtttccatcaatggatccgggatcagtgggaacagaggcataaactgtaagcagaatagcattccaccattgggctatgacctgaggagaatcaaggtagctttctcaggcctcgtggacgtcgtggatataaagaatgatcttgtaggagggtataagaaccccagcatgatttcaatggagaaggcccagggccccatcattttcattgttggtcaggatgaccataactggaggagtgagttgtatgcccagtctctgaacggttacgggcccatggaaaggaaaaaccccagatcatctgttaccctgggactgggctttacactgagcctccttacttccccctgtgcccagcttcccttcacaaattactgaacaaacacgtgatatgggttggggagccagggctcattctaaggcccaggtagatgcctggaagcaaattctagccgccttctgcaaacacctgggaggtacccagaaaacagctttccctaaattgtaatgcgtttgtctgttgttgacatgagagagtcaagatcagattctagtgttcaataaccctatgtgaatcagctgtctcctggataacattaaagccatgtctttgtcatt

SEQ ID NO: 238545 - DNA, 743 bp, Homo sapiens
tgaattagaaggaaggagattattgggtttggaattttgaaatatcaaacctggaacaaataatctcactctcagtttatttgtatgtgaaataaggtggggcagggggagtggttatggaggggacgcataatggatgtggagcactctatacagtcctgggtagggggtagttaatgatactacttagcatgacagttgccagtcacactgtcacagtctcccatttgtctatggggaaccagctccttgcagggactgcctgagtttttgtttggtccaactgagtgacgaacatataaggatgtggggctgggcgtgaaaatgagtcaccaaggtggaactcccttctgtgactcatcaggtgagttccagaatggcagaggcctctaacaaaaaagatgcagtccgttcgtctctggtattctccgcacacctgcagtttagggcctgatagctagacctcccctttgggaaagaattttaagtgaataaaaaggaaaagatgaatttgatggaaaagaaagccaatattttcactattcagaagtataaaaggaatctcacaaaggttatacttaaggtactcaacctagagtttattctaaaataccaccccaaatcccctatctaacatgaataaggtggcaaaagttctggttgcatggcaagatcagacccttggcgaaacactcacacacacacctcatttgtgtagtgtttaccttagcccttaccaggca

SEQ ID NO: 238546 - DNA, 565 bp, Homo sapiens
actcacaagacccgttcttcttgcaatccccaaatccccattctggattcctccttctctccattgctgcttattcctctacaaccccagctccgcttgctttttctactccctcccttctgtctctaagcagggactccacctggctcggtacatggagatccaatatggagcaccacttttgggcagagtcctcatgctgcgtcaactcataggtcactggcctcatgtccagcctttatatggaagtctttggatgaatttctaatttctgcaccatccgtcagccaggatagtcaggccacaaggcacaaagctcacagtgtatctcagaattccttactcagaatgttgcgaggggcctggcagacacttggaatctgctggaccctccccaagtcaatcgtttcaaacccatgcttaggacatgtgatctaagtaagagtgttttatatgatctgtaaattatgtatttgaaaaatctcacaaaagaataaaaacaaaaatcacaggtagtcccacactttaaatcccaatcataaaatggaataaagttatacaaaat

SEQ ID NO: 238547 - DNA, 350 bp, Homo sapiens
ttgccttgtttacgagaaataataattcatcaaacaaccaaaaaatggaaaagattcaaaattaggcagaccagatttcacccataatagagacctcacaattatagcggtcacactattcaccataatactcaataggatatactgctatctgacctgctatgtattttatttatgtgtcatcattttcttctcactggaatgtaagccccataaaagaagcttttcatctgctgtagcaccaatgcttagaacagtgtgtacacacagcaagtgctcaataagtattgataaagagaggatctctgtggactgatggcatcaccattactgaactccttctctttttc

SEQ ID NO: 238548 - DNA, 405 bp, Homo sapiens
ctcaaggcaggcagcgtcttcccccagccccaggctttctgaggccacacctggacacgtggtgcacttagccaacactgacttattttacctggcctatctctttgccttgttgggtgaaattaatgcctttgagggcctaaggtggtctggttaagtgacaagggcataggaagacacaaccttacctagctggaagtcagagatttggactctagcccactttcccactgagtggtcttgggcaagccacctcctttactggatccagaaaagtagcattgagccaggtgtagtggctcacacctgtaatcccagtaactggggaggctgaagtaggaggctctcttgaggccaagagtttgagaacagcctgagtttgagaacagtgagaccctattctta

SEQ ID NO: 238549 - DNA, 647 bp, Homo sapiens
ggcaacatgacctagattgcattgactacatgtgcttgtttcctgtgcttttgataaactgacatctggggctgggctaaccagggaaagactgtccttcccagggctagccaattcttagagattgcaaatgactcacttagaggtgtgcctttgatatgcaaaggaacaaatccagagcccctgctgtgaaccacttcctctctctggctcctacactctaggagacagaattcctctgccctaatcatcccaggaccagtcaagacagccagtcctacttctgcttaccttgcctggcccatctcgtcccagaaccaccacagtcaagactttactgcctccttctgccttgttgcctacccagatgcttccatgtggggccctgtgtaacatggcatgccccctcctcttgggaactagagtaagctatgttttcaatggcagtcatcccctgatctgttggcctcaccacacctaaataattttataacataggtataaaataaagtcacttcatggcttggcacagtggctcacgcctctaattccagcactttgggaggccaaggtgggtggatcacctgagatcaggagttcgagaccagcctggccaacatggtgaaaccccgtctctactaaaaaaa

SEQ ID NO: 238550 - DNA, 460 bp, Homo sapiens
aattctctcatgctattattttcaattgtagtctgtctcattactgcttatttcctcaaggctttaagttatttacataaaggtgcacttgatatatgaccagcagcatcagctcaagtgtgctagctccaattcctttaagctgtagtgttttcctatatgatagattacaaggtattttttttttaaactgtagcattgtcgctttgggttggacatgcaatttcaaataatcttttgggaaggaagtattttattattttaaattactggattcttagtctcctatcacagagaagactggtagctacagtcagtgtgtttagtatcatctacaacattctgtattaacatacaaagtgcaatcctggaccttgattccccccacccccgccgagtctaattgaaaatacagctcagcacgtgattttaggaacatcaaattgtcctttaccctcca

SEQ ID NO: 238551 - DNA, 438 bp, Homo sapiens
tacccacactctctccttccacggacctcagaagtatctgtgatagcttaactgttatgggctgaatcacatccccccacaattcgtatgttgaagtcttaactcccaggaccccggaatgtaacattatttggatacaggatctttacagatgtaatcaaattaaaaggaggtcaccagggtgggtcctcattcaatatgactggcatcctcataagattaggatacggacccacatagaggaacaaccctgtgaaaatgtgaggagaagatgctgtctacgagccaaggaaagagactgcagaagaaccagccctgccacaccttgatctcagacgtctagcctccaggacggtgaaagaagaaacatctgtttgtaagcagtccagtctgcagaactttctggtatgacaaactatataaatcaatcaatgtaac

SEQ ID NO: 238552 - DNA, 225 bp, Homo sapiens
agtgcctgcagactaaataagccagatatgtagtgtccattttaaaatcaaaataaatcttttaatccagatatttagcttaacttgcttagggaattttggaacagaacattcagtggccaattttcataccctaagaagaatgaaagttactgggtaacaattcaaccttcttgttgaattgatttactactcatcagggtcatgcacaagcatagaatcaga

SEQ ID NO: 238553 - DNA, 472 bp, Homo sapiens
gcaaagttaaagagaaaatgttgcctgaatgtgactgctccctttaggaaaacacagctggtgagtgtatgggtgaggtcccccaggggccacagcccgtgtgtagggaggtggcaccgtgtggaggccacgcctgtcacaccgataccacatcttcctgtcagtgccactcaggctgatcttcaccccatgacccagaaaggttttgtgaaaattaaatcccgtgtgctgtgccgtggcgtctgtgcacatggaggctgggacggtggcatgggctgcgtgggcctcacagaagcatcagctgctgggacatgattcctgtttctgtaactgtcctaagctggctgtagtttgttctataatagtcataagagaaaagaaccattgaataaggattcaatcaataatgtactgtaataagtataatttaaaaatgtatttataagtaaaatgttttagtttgttagaaaaa

SEQ ID NO: 238554 - DNA, 373 bp, Homo sapiens
gattttgacccttgggggttttggtggctgtatccttttctgccttgtactcttcttggtagttactgttctggtgttcatggaatagatcctgtgtcagcaagccaggcagccaggcagatattactgtgcttggcaagtgcatccttttctctgctagcactgaagccaaggtccatgtgttctgaccacaaagactgagaactcctgtgttcagcaatgtttgctcaagtgattattttcaggaggttgttaaaatagctgcattcacagaagattaacagaataagctgctagctgtttatactttaaaaattaaaaaatttaaattaaagttcacattaaaaatgtggttatagttaatagttgactg

SEQ ID NO: 238555 - DNA, 2716 bp, Homo sapiens
gttatgaagatagtctgtcttgataaaatcccaggcttaatttagataatgtcagtctgccacacggagttggtagccataaaatgctacttctgagttctacacttagctgtagaatgcaaattgagtgacacctttaaggctacagtacttgattttttaacatcttttctgttggggctttgactagttctgcagaaagggattgggacaaaaccaggagtttgttatttttagtttttctttgccatttagcagcagaaattcgatccccactgataaacagaacctgctggaccacctttgctcagataatttctataacacagaggttaactcactattggttgaaataaatgcttaaactttgaagcactttttaaaaaatcataagtacaccagtgctgcacctccaatgataatcatttaggaaacacagaaaacaaaaattaaatgaatggtccacatgtgaataaataaccttaatccactcggatatgcagcagctcttcccactgcaaatgggttttgtggtggtaacttgaattggaggagagagacagctggcctggtgctgctgctgctgccaaaagccatcttgttaacatggtttatttccattctgtcttcctgctacccacaagagccctgtcctcctgtctccctcctctttcatcagttttcagtggcatactgtcctcagtcacatttctcctgctttgccagtaaacagcatgtagctgattcttctagtcctcgcctgcattcctacaattcctgctcattccgaattggttctgttatctcctaagttgttgcaactcctagaactcagccttcttttacatctccaattctcattatgtgtttgaatggcttcagcttttccctccgctagctctttgagctccaaatcatcaactcagacaaaaaacacagagaagggagtgcatactgtatgtacatgaacatgtttgtgtgtgtgttttatatatatgtacatgtttgttttcatctctacctgggtattttttgggaaatttatggccatatgtctttaaaaaaaatcccatttaacaacaaatacaataccttctgttgggccaaccaatatgacatagatccaatatgtgagaaagttgccagggaaccccaggagtccaaaatgattttatttcagaagagaataaaaataggaagagtccctgtacatctgcattgttcatttccgctatttctgtagagtaggaaaggctttgtcagaactcagcttgaccagcagggagcagcagaggcccatgggaaacggaatcctttgtaggtctgtccccatcaccactggtaacaggacatggaagaaggcaccacacgcactgcacatggaactccagcaagaacctgtctttactctttaattttgataggaagtagaatagcaaatccccatgcccaaatcccgtgatggccaagtagtcttagctatttgaaaaacacccttaaaagacaggtttgttgtttaggccatcactcaggtgtatggaaaataaactttagaacacttaggccttgacatatttagtgtaatttgtgctcattgtgtatcagtggaagagatttgtgtcaaataaaaaattgagagtgatagcacaaaaccacaaagagagggtacactgtaggtacatgaacatgcatatgtgtatatatgtgcatgtctataaaccacattatgaggtgaaaacttagtgaaatgtgtttgaaaataagtggtgcatttgcaaaatatatataaaataacactatgtttactttgatgtcgtgttgttctaggaatacatcaagttcatttgcataattcatattttccactggtataatgcagggaacaccagccaagaggtagcagcatgaaaagaaaatctggatttcatataatttgatctaaaaggcagttaaagattactgggtcaagttgcagataatatttcagatcagaatcagaaagtattttctaactgaactggccttgagtggcatgtgctgagctgcctgtgaagttcatgtggacacctgcagctggagctgtgcaaacagactggaggaggcccagctggggtattgtccaggtcacttaagcatgccatgaggagttggatggcgtggcttgtcaggccccgtttaactccgaaatgtctttgttacctaaagcacaagcaggaaaatgaatataggtgatcattaaattcctttactgtacatcatattgaattaatatgaaaaatacagagaatgtagacatctctgagttaaaatattttccaaaagttttaaagcatggataatatatctttaaaattggataaaatgtgcttggatgctttaaacatatactcaaaatagtaaataaatgtttgtggccaggcatggtggctcatgcctgtaatctcagcactttgggaggctgagacaggcagatcacttgaagtcaggagttcgaaaccagcctggacaacatggtgaaaccccgtctctactaaaaacaaataataataataataataatgcagaaaaatctgggcatggtggtgcatgcctgtaatcccagctactcaggaggttgaggcaggagaattgcttgaacccaggaggtggaggttacagtgagccgagatcatgccgctgcactccagcctgggtgacaaagcgagacttcgtctcc

SEQ ID NO: 238556 - DNA, 2662 bp, Homo sapiens
gttatgaagatagtctgtcttgataaaatcccaggcttaatttagataatgtcagtctgccacacggagttggtagccataaaatgctacttctgagttctacacttagctgtagaatgcaaattgagtgacacctttaaggctacagtacttgattttttaacatcttttctgttggggctttgactagttctgcagaaagggattgggacaaaaccaggagtttgttatttttagtttttctttgccatttagcagcagaaattcgatccccactgataaacagaacctgctggaccacctttgctcagataatttctataacacagaggttaactcactattggttgaaataaatgcttaaactttgaagcactttttaaaaaatcataagtacaccagtgctgcacctccaatgataatcatttaggaaacacagaaaacaaaaattaaatgaatggtccacatgtgaataaataaccttaatccactcggatatgcagcagctcttcccactgcaaatgggttttgtggtggtaacttgaattggaggagagagacagctggcctggtgctgctgctgctgccaaaagccatcttgttaacatggtttatttccattctgtcttcctgctacccacaagagccctgtcctcctgtctccctcctctttcatcagttttcagtggcatactgtcctcagtcacatttctcctgctttgccagtaaacagcatgtagctgattcttctagtcctcgcctgcattcctacaattcctgctcattccgaattggttctgttatctcctaagttgttgcaactcctagaactcagccttcttttacatctccaattctcattatgtgtttgaatggcttcagcttttccctccgctagctctttgagctccaaatcatcaactcagacaaaaaacacagagaagggagtgcatactgtatgtacatgaacatgtttgtgtgtgtgttttatatatatgtacatgtttgttttcatctctacctgggtattttttgggaaatttatggccatatgtctttaaaaatagatccaatatgtgagaaagttgccagggaaccccaggagtccaaaatgattttatttcagaagagaataaaaataggaagagtccctgtacatctgcattgttcatttccgctatttctgtagagtaggaaaggctttgtcagaactcagcttgaccagcagggagcagcagaggcccatgggaaacggaatcctttgtaggtctgtccccatcaccactggtaacaggacatggaagaaggcaccacacgcactgcacatggaactccagcaagaacctgtctttactctttaattttgataggaagtagaatagcaaatccccatgcccaaatcccgtgatggccaagtagtcttagctatttgaaaaacacccttaaaagacaggtttgttgtttaggccatcactcaggtgtatggaaaataaactttagaacacttaggccttgacatatttagtgtaatttgtgctcattgtgtatcagtggaagagatttgtgtcaaataaaaaattgagagtgatagcacaaaaccacaaagagagggtacactgtaggtacatgaacatgcatatgtgtatatatgtgcatgtctataaaccacattatgaggtgaaaacttagtgaaatgtgtttgaaaataagtggtgcatttgcaaaatatatataaaataacactatgtttactttgatgtcgtgttgttctaggaatacatcaagttcatttgcataattcatattttccactggtataatgcagggaacaccagccaagaggtagcagcatgaaaagaaaatctggatttcatataatttgatctaaaaggcagttaaagattactgggtcaagttgcagataatatttcagatcagaatcagaaagtattttctaactgaactggccttgagtggcatgtgctgagctgcctgtgaagttcatgtggacacctgcagctggagctgtgcaaacagactggaggaggcccagctggggtattgtccaggtcacttaagcatgccatgaggagttggatggcgtggcttgtcaggccccgtttaactccgaaatgtctttgttacctaaagcacaagcaggaaaatgaatataggtgatcattaaattcctttactgtacatcatattgaattaatatgaaaaatacagagaatgtagacatctctgagttaaaatattttccaaaagttttaaagcatggataatatatctttaaaattggataaaatgtgcttggatgctttaaacatatactcaaaatagtaaataaatgtttgtggccaggcatggtggctcatgcctgtaatctcagcactttgggaggctgagacaggcagatcacttgaagtcaggagttcgaaaccagcctggacaacatggtgaaaccccgtctctactaaaaacaaataataataataataataatgcagaaaaatctgggcatggtggtgcatgcctgtaatcccagctactcaggaggttgaggcaggagaattgcttgaacccaggaggtggaggttacagtgagccgagatcatgccgctgcactccagcctgggtgacaaagcgagacttcgtctcc

SEQ ID NO: 238557 - DNA, 406 bp, Homo sapiens
acattattcctctgtcctactcatgaaaacttgccaggagtgtcactcaagctaaagggatttaagtggatcccaggagaatggagaaaaatccattctactgtacccaagattttagtgttcaggttgataaaagacaggtgaatacccaaaacatggatgatgtatccatgtctcagtcaaaacttggacaagagagtctcaaggctggattctgtaccttaatagagtctagtcactggccttgacttgacctacagaagggaagaaagagaccatttcaaagaagagtcaagttaatcaatctggataaaagccaatatgtaacaaacctgcacgttgtgcgcatgtaccctggaacttaaagtataatataaaaattaaaattaaaattaaataaaatttt

SEQ ID NO: 238558 - DNA, 535 bp, Homo sapiens
ctcatttcttcataaattacccagtctcagctctttatgggagtgtgagaatggactaataaaatatctctagaattatgtttttggagataatttaaagataaacaaatattggaaacctcatttgatcacacagagaacagtaaatggaagttctactttttctccagggcctttctcatgcttatgcagggattattcacccagatatcctgaaataagacatccaattaaggtacctgctatctcatgtaacacagaagaaagttgagcatagaggttaaacattacctaatattgttggaaaagcttcgaagcgttcattttcaaagcagctaatgtaaaccatgataatcactagtagcactatgccattttaaatacttcaatattttgtagttattagattctaagtaagtataaaatgtagtgaatacaaattttatttgcctaaacagtgttagacaatataaattaacgagttattttttattctgtttaatattttcaagccaataaacactttactaaagta

SEQ ID NO: 238559 - DNA, 295 bp, Homo sapiens
gactcagaaggttggccaggctgggtgggcaggattctcgcagcagctgcgacagcggctgccagcaccaggctcctgggtcaggagtgtggtgtcctgatccgtaggggtctgacaggctcagctgcatacagacaggcgccgtctcctccgctctcctgcagcttgggagggtgtggataagatgtgaggtgcagcacctggcagataggaagttcctggcaaatacatgcaggaaaaccagctttcattcatatccaatttgatgttttggtaataaatgactttaatgtca

SEQ ID NO: 238560 - DNA, 293 bp, Homo sapiens
aaaggagacatgaaattaccacgagaatatgtggatttacaatgattctcagaatactttttgggttatttcaatcctatgattggatcaaatacatagccaaataacatccacatttggggaactttgtgtattacacacactcactcctgctcttcttagtcctctccataatttttacttctgcaaaaacctccctgtgtctgtgtttaacgtaaaattacgtatactgttcatttactaagcacaggtatatactttcaataactaaagaaagaaaaagtacttttaag

SEQ ID NO: 238561 - DNA, 304 bp, Homo sapiens
tctttgggcgcagggggcgcggagcttgggaagtggagccctggcgagtccccagcgattgcgcgcagcttcccggggtttccctgcgggggtcgcgtgtgctgggtgtctgaactcacgcgcgggccagaggtagccaagagctggaactcttgcccaagtgccccggggaagggagtgaaggcccggcctgaaagtctctgaccctcccgagtctcgtgtccctagaagcagccttgcgaggtggccacgccagctgccctgagagaagcagaggaaaatgtccaactctccctccgcccag

SEQ ID NO: 238562 - DNA, 324 bp, Homo sapiens
gagtagagaagcctagggtcttaatttgggaagagaatctaaatgaggagggggccaggcgtggtggctcacgcctataatcccagcactttgggaggccaaggcaggtgaatcccttgaggccaggagtttgagaccagcctgggcaacacggcaaaatcccgtctctacaaaaaatacaaaagttagccaggcatggtagtatacctgtggtcccagctacttgggaggattgcctgaatccaaggagactgaagttgcagtgagccatgatcgcgccactacactctagcctgggtgacagagtgagactctgtgtcaaaa

SEQ ID NO: 238563 - DNA, 486 bp, Homo sapiens
ccaactccagttctttataaggcaggctgtggcttggtcagagtatggggcgaattgccattttaagttattttggaaatatttagtaacttaaaagaacattttcagtgtgaatttttctcattagaatttaaatgaggttttcatcttactttgcagtaattaaaaggcctgagggataatcagggtgaatcacttcaaggagatagtctaaattcagactcttcgctatttgaagggaaaatagttcatttgtgaatttaaaaactatacataaattatggtttgcattattttcctccagcatgctatacattaactttgaattctatattcacttggtctttttctggcttttatatgaggattgaattaaaaatgccagaataaaatttctcagtccagcaaatgcttaatgcatagctttaaaaggcagaaactcaaatcaaaaaagcctgggcaacacagcaagaccccagtctctgc

SEQ ID NO: 238564 - DNA, 433 bp, Homo sapiens
aagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggac

SEQ ID NO: 238565 - DNA, 483 bp, Homo sapiens
tcgatgcccccaagacattccaacactgagctgtttcttctccaggtcttaagctttgaatacaagctataccagcacatctaaaatcggtctctacatttttccatcttaaatatgagctgtccagcttagtcaaaactaactgcaaaacactgggtgtaccatttgagtcatttggtcttaaaagaaacactattatcactgtgtcacagtttgagagattttcacttaagcatttaagttgcaaaccactacatatttgtcccattagtgactagtgggccttaattttggcattcaaattagggtaaaaaaccttggttcttgaaatgctacagaaaatagcttgaggccaggcacagttgctcacacctgtaactccagcactttggaaggctgaggcaggcagatcacttgaggtcaggcgtttgagaccaggctggtcaacatggtgaaaccctgtctctactaaaaatactaaaa

SEQ ID NO: 238566 - DNA, 532 bp, Homo sapiens
gaatcagatctgtttggggctgggggttggagaataaaagcaggagaagtctatgggattctagaaatagtacctgcatccagcttccctgccaaactcacaaggagacatcaacctctagacagggaacagcttcaggatacttccaggagacagagccaccagcagcaaaacaaatattcccatgcctggagcatggcatagaggaagctgagaaatgtggggtctgaggaagccatttgagtctggccactagacatctcatcagccacttgtgtgaagagatgccccatgaccccagatgcctctcccacccttacctccatctcacacacttgagcttgccactctgtataattctaacatcctggagaaaaatggcagtttgaccgaacctgttcacaagggtagaggctgatttctaacgaaacttgtagaatgaagcctggaaagagtgatgaattatattatattatataaaaataataataaaaatataaagaaagctacctttcttctatacccaaattgt

SEQ ID NO: 238567 - DNA, 378 bp, Homo sapiens
aaaacaatttctgaggattctgaaacttgatttctagcctcagcatctctactgattgacttgtaattttgactctcaacttttctatttctagcttcagcatctctactgattgacttgtaactttcactctgaacttttctatccttgcagaaatttttaattataatatataatctgttgtataacctggcactggtgattaagacagttgtgtttatatatgtcttagagctagtcaactcactctgctataaaaaaatcatgatttgtacatgcatgaaaatgttgcctcttagctaatttgatcaatatcacatgaaattccactactgttatacccacaccaccaccagtaagtaagtacttttgagtgat

SEQ ID NO: 238568 - DNA, 521 bp, Homo sapiens
gcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgc

SEQ ID NO: 238569 - DNA, 443 bp, Homo sapiens
aagtgatcccccccacctcagcctcctgagtagctgggaccccaggcatgcaccatcacgcctggctaattttttgtattttttggtagaaacagggttttgccatgttttccagactggtgtcaaactcttgagctcaggcaatccacctgccttggcctcccaaagtgctttgattacaggcatgagccactgctcctggctgagagttacttttattattggggttatctatcagccttccataactgtatgtctaacttataaataaaattctaagggtgtacagagttctcatttatcctccacctatgttcttccagaactgaaaaattttgcaagtatatatatatatgtacgaatatgtgtttctgtttcttttgagatggagttactccagcctgggcaacaagagcgaaactccatctcaaaaaaaataaaat

SEQ ID NO: 238570 - DNA, 475 bp, Homo sapiens
tgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagt

SEQ ID NO: 238571 - DNA, 398 bp, Homo sapiens
tccctcttgacttctctgtcaagaaacttcttccaggtttatacattagccagagaatacagtagggggagaaggttaggaaatctcagattacttacgagaggtgaaaaatagcattacggtggacgtatacagtttcgcaaggaaatgagcaatctcttctttgatggaatatgtgaaagccaaactggaaggaataattagattaaatagtgatgtaaactggaaaggaagcattacttcctgcactgtaccaaatgtcttacaggtgtcagtgggacccaccagctcagtaattagggttttaactgtctccacttaactatgtgcaagtggttgaaaacaggagtttcattgggacccctggcatcagaacattttggtgaagtgagctttgt

SEQ ID NO: 238572 - DNA, 674 bp, Homo sapiens
cagactcccaaagtgttgggattataggcatgagccattgcacctggccccaaatagaccaaatcttttgattagaaccaaattattcttcttctgcttatgggtggttggtatccacaaattgcaaatgcctagtcttcactcctctcagtttttctttttgtttctgtaataaacactctgggaagtttttcaaaagttatttcttttgatagtaattattgttaaattaaatgcttttatatctttagcaatgttgccaaaaacaatgagcaaaatcatgttttcttctaaagaagtgatgcaatatgaaataaagatgtgtgtgcttttcagaaagaaatgaaagaaattctagaaaattgtggttgggctggcattaatagctgaggcaataaaaaaattctctggtctgcagaaatcaatcttaagggcaaaggtagtctatagtatgggttatcaagtaaatgaatcaaattcactttagtactttatttttgtcaaggattttgtctctaatgtgtgttaagcaatacctcatcccttccacatcctgcaccagtccaggctgcagtgggaaaagacaaatgcagcagatgccaactaggaagctctcagggcacatgtagtgtttggctgaaattctatttatctgtatattctcatgaggcagg

SEQ ID NO: 238573 - DNA, 632 bp, Homo sapiens
tgcaggatgccaaagctgcctcctgaggcatgagtaggaattttccaggtggataaagagagggcattagcagggttggacagtgtttttcggaggcccctttcactgtgactgtatcacctgctgcttccaactcggactctgccttgcattttgagaggaagggagtaggctcttttgagtaccatcttgaaggttctccaggactcaggagatgccctgttggggctctgatgggaattccaggtcaccagatgcctcctgttacatctccactctaagccctgtgtctggccttggatcctcctcccttgtaaatgtggccgatgacgaaacagagacatcagtcccatttgtggctccatcagctttggaagcagatcacgggaattttctgagtctgggcccccagccagaaggcatttataatcagacatggagcaatcattagagcagaaacaataaattacaacagcaccaagagaactccccaaagctgctcacgcgaggggagatccaaggagcagaatgctagcaggctctgggcccgcctgcccctcccgctggcagccaaggcctcctgcctcaccacactcagcctctgcccccagacgtctgtgagtgatgcagca

SEQ ID NO: 238574 - DNA, 364 bp, Homo sapiens
ccttaaatatgtatgtgtacctcctaagaacaagaacattcaactacatgacataatacagttatttacctcactgaagaaattgaagagtaatgtaataccattgtttaatatattttcaatttccccagttgtcactcttagtcactgtgttccactgcctccattgtctttttctcagtgctaatacttaaccataacttgaatgtatgataacactacagagggccttcacattcatatcttttttttttaattgagacagagtcttactctgtcactcaggctagagtgcagtgggctgagatcgcaccactgcactccagcctgggtgacagagcaagaatccacctcaaaaaaaaaa

SEQ ID NO: 238575 - DNA, 521 bp, Homo sapiens
tgagggttcagtattttaacaatgtggtgttattgttgcatattagctaaatatcagtgctttcctgatatgaaacttatgtcttgagttttgtgattctacttttaaaatatctctcaaaatcatctactttggcttatctctactgcaacactgtagtacagaacacccttttccactgcaacagcattctgactgctctctgcctcaaaccttttaaaaattgttcttaaatgaggctgggaaccttaacaaatccagtcactctactatcatgtgcctggggatagtgctgggtgtgtttacaatagagtgcttaatactgttggctcctggccaatcaaagatgagcatcaaaaccatgcatggtggaatgtatctttattcccagctactcaggaggctgaggcaggagaattacttgaggccaagagtttgaggctgtagtgtattatgtttgcacctgtgaataaccaccactctgcagcctgggaaacatagtgagacccccatcttttagg

SEQ ID NO: 238576 - DNA, 545 bp, Homo sapiens
caaaccttcttggaaatgagcttaggcacaggctgcccttgtctgccctcttctgcatgatgttccttcagatgagacaggaaggcagcgctcctctccctggtggcttctcgtctccagaacacacacccccagtaccttggactttttcactctctgtagcttcatgcttgggtctatccttagaacaatactgaaggtattctttgtcccataaggagcagcactgacccatcccctccctccttttggaaattctagtaatacacctaagagtgtgctggggctgggcacggtggctcatgcctgtaatcccagcactttgggacgcggaggcgggcggatcaccggaggtcaggagattgagaccatcctggctaacacagtgaagcaccatctctactaaaaatacaaaaagttagccgggtgtggtgacgcgtgcctgtagttacggctacttgggaggctgaggcaggagaattgcttgaacccaggaggtggaggctgcagagaaccgagatcacaccagagcaagagtccatctc

SEQ ID NO: 238577 - DNA, 439 bp, Homo sapiens
cctgttcgcccacctttcctttgtttattgatatttccaccagaggaaggaccaggcaaaagggagaataaattcactttttaagataatgcttctgagttttagcacagcatcccacttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatactgtttggattctcattttacatatgagaaactgaggtttaatgaagtt

SEQ ID NO: 238578 - DNA, 357 bp, Homo sapiens
tttttttttttgagacggagtcttgctctgtcgcccaggctggagtgcagtggcgcaatctcggctcactgtgagctccatctcctgggttcacgccattctcctgcctcagcctcccgagtagcagggactagaggcacccgccaccacgcctggctgatttttttagtagagacggggtttcaccatgttagccaggacggtctcgatctcctgactttgtgatccacccgcctcagcctcccaaagtgcagggattacaggcgtgagccaccatgcctggccagatctattataattttcttatccactgtctgttgatagacatttaagttatcttccagttgtgaactgtta

SEQ ID NO: 238579 - DNA, 393 bp, Homo sapiens
tgggatcacagacatgggatatttttactctccagcatgaacacataggtggatttactgtgaaactactgaagcttacacttcagggtccctggcttcctcaaacagggcttccaagccctatatctaattttgcacttctttcttaagagttgcctgtaccaaatatataagcctcagggccccaaacctggatccagcctgagtgaatgtttttttagagccaggtctgatagaagcctgtttttaaggaattaccaggaactgagcatgctgtttttggccctcaggggtttctctcagaactaagaatttgggggctgtcctcagtcacaggtgcagcctgaagtctgttcccgccatgttcactctcctctatttaccatcacctgc

SEQ ID NO: 238580 - DNA, 2613 bp, Homo sapiens
cacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacggaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctgttgcccaggctggagtgcagtggtgctatgtcggctcactgaaacctccgcctctcaggttcaagcgattctcctgcctccgcctcccgagtggctgggattgcaggcatgcaccaccacacctggctagtttttgtatttttggtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacgaggccaggcacagtggctcttgtctgtagtcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggctcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcgggaggctgagggaggagaatcccttgaacccgggaggcggaggttcatggggaacccagcaggaaattagaatagaaccaaaaacgccagtcatgggaggcagagctgggggagcgaggctgacgatgactcctgttttcacgctgagagaccccactcccctgctgagatcgcgccactgcactccagcctgggcgacggagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactccgtctcc

SEQ ID NO: 238581 - DNA, 346 bp, Homo sapiens
ctcaaatgatctgcctgtttcaacctcccaaagtgctgggattacaggcatgtgccatcatgcctggcctttttcttgatttttaattgaacttcctgttaatcactcttatttttcttcagcttttaagttccagggtacaagtgcaggaaatgcaggtttgttacataggtaaacgtgtgacatggtggtttgcagcacagattaacctatcaccttggtattaagcccagcatccattagctattcttcctgatgctctcccttccccccaacctgcaaccctcatttttttttcttgaaaccctttgcctttggtttcagtgaactgttctatcctgatctt

SEQ ID NO: 238582 - DNA, 481 bp, Homo sapiens
aggtgatccacctgccttggccccccaaagtgctaggattataggtgtgagccactgcacctggccatatttatttttctattctctctttaaataccatagccttttacctactccatgctatcagaactgcttttgtcaaagtcagtggtcattcattgtggaattgcctgacaagttcttcctgcctgctacaaaggcaaaatctgttcactaagtctgtggcattgcagtaaagaaagagtttaattgatgtgaggccagcccatgcagaagaactggagttgtcactccaaagccttggaggttagggtttttatggacaatttggtgggcagggggctagggaatgggtgctggtgattgtttggggatgaaatcataggggtgtggaaagcagtcctcatgtgctgagtccactcaggatcagttgtgccatgactcatgagtcccatggggtcagtctgaaaaacagttcaaa

SEQ ID NO: 238583 - DNA, 509 bp, Homo sapiens
  misc_feature (464)..(464): n is a, c, g, or t
  misc_feature (475)..(476): n is a, c, g, or t
aggtgatccacctgccttggccccccaaagtgctaggattataggtgtgagccactgcacctggccatatttatttttctattctctctttaaataccatagccttttacctactccatgctatcagaactgcttttgtcaaagtcagtggtcattcattgtggaattgcctgacaagttcttcctgcctgctacaaaggcaaaatctgttcactaagtctgtggcattgcagtaaagaaagagtttaattgatgtgaggccagcccatgcagaagaactggagttgtcactccaaagccttggaggttagggtttttatggacaatttggtgggcagggggctagggaatgggtgctggtgattgtttggggatgaaatcataggggtgtggaaagcagtcctcatgtgctgagtccactcaggatcagttgtgccatgactcatgagtcccatgggtcatgntcaagttttgnnctggttttgtgtttttgggttggatatagttgc

SEQ ID NO: 238584 - DNA, 234 bp, Homo sapiens
gaatagggtggcttgctctagcaaatacagacacaggacacccagtgaaatactgcatggaatatacttatactgaaaaattattattgtttttctggaattaaatttaacgggggcccggcatggtggctcacgcctgtaatcctaagcactttgggaggctgagcaggtggatctcttgaggccaggagttcgagaccagcctggccaacattatgaaaccccgtctctact

SEQ ID NO: 238585 - DNA, 332 bp, Homo sapiens
gtctcttaattaatccaccgcttacagcttgtttcccattgcaacaaggcctcccactgcaagacagagaggagaaacccggcaagagtcagaagatctggggcaagaaatgaaccgaaatcttcactgagtgcagcagccacaagcttgatgacagagcctgtgtatttcactccaaggctgcacgtgtctgtaagaacgggcctcgcccatcttatgcaatttgcataggaatctgaggaatatcagcaactctatacaataactaaacaaatttttttcagagtaaaaatttgttatggagcttaaataaagactgacaaaacattgca

SEQ ID NO: 238586 - DNA, 420 bp, Homo sapiens
ggaattcctgacctttcctaaacatcgtcagcaatgagtctcagcccttatctttctgcctgaagagctcagggctcttcagggtcaggagtgaggaaaccggaagaggatgaagaatgcggggtgctaatgagatcacttctgtcctgtagttggaaacccggcaagagtcagaagatctggggcaagaaatgaaccgaaatcttcactgagtgcagcagccacaagcttgatgacagagcctgtgtatttcactccaaggctgcacgtgtctgtaagaacgggcctcgcccatcttatgcagttcggatcgtcataggagcagatatcaacaaatcgatccaaggtgtggctgggttctttgcagagtaataaagtgtgatggagtgtcaataaaggctgactaaactttgcaaacaa

SEQ ID NO: 238587 - DNA, 414 bp, Homo sapiens
ggaattcctgacctttcctaaacatcgtcagcaatgagtctcagcccttatctttctgcctgaagagctcagggctcttcagggtcaggagtgaggaaaccggaagaggatgaagaatgcggggtgctaatgagatcacttctgtcctgtagttggaaacccggcaagagtcagaagatctggggcaagaaatgaaccgaaatcttcactgagtgcagcagccacaagcttgatgacagagcctgtgtatttcactccaaggctgcacgtgtctgtaagaacgggcctcgcccatcttatgcaatttgcataggaatctgaggaatatcagcaactctatacaataactaaacaaatttttttcagagtaaaaatttgttatggagcttaaataaagactgacaaaacattgca

SEQ ID NO: 238588 - DNA, 282 bp, Homo sapiens
ctcccattcccccgggctattccacctatcactcttcacccatccatcttttactatcctccaaaggctgcgttatgaaatcttaatttcttccaaggcaggggcggcaaacattttctgtaaaaggccagatagtattttaggctttgtgggccatatggtctgtgctgcaactactcaattttgccagggtggtgcaaaagcagccctagacagtacgtaaataaatgggtgtggttgtgttctaataaaactttattaataaaaacaggcagcagacca

SEQ ID NO: 238589 - DNA, 180 bp, Homo sapiens
tgacgggcagaaatggagttaggtagtttttttcctctcaatttccagctcagaaaatcagttaattgagtattcagagtgatgctcacacttgttgctcatgtgtaaccacagtgggattgtgctaattaagtaaggccttggttggtttttctaattcaccccttctgtcgtcttctc

SEQ ID NO: 238590 - DNA, 401 bp, Homo sapiens
ccatctcaaaaaacaaacaacaacaacaacaaaaaaaaacgggcaagcttacagcagttcacacaacagcccagacaggacctgctggagactatcagcatcctgtttcctgggctctgccagctcctggaatgctaccagcatcatcaaaccctagtggtacttgtctccagtggcagtgtactccaggacctctttgagccaggtaatagactctcctgtctctgggtgccccatctcatcttgggcatacatatctggatttctggtctccattcattttgttcctggatgtgagttcctgcttggacagcatttttcaaattaaattttacatttagtttgtgatttctttcaagccctaccacaactcgcattagtcaaaaccagttataggccgg

SEQ ID NO: 238591 - DNA, 348 bp, Homo sapiens
aactatctgtaaaaatgctttgtgatgcgaagattcatctcacagtgttaaacatttgttttgattcagcatgttggaaaaaattttttgtagaatctacaaagggacttttcggagcccattgagaccaatattgaaaaaatgaatatccagctataaaaactagaaacaagctctcggtgaaaatgctttgcaatgtgtggattcatctctcagagttaaacttttattttgattcacccagttggagacacttaattggtagaatctattaggggacatttcatagcccattgaggcatgtggtgaaaaactgaatatcccgcaataaaaacctgaaacaagcga

SEQ ID NO: 238592 - DNA, 394 bp, Homo sapiens
gctgagatctgccagattaacatgaaaccttactttagtccaattacttcatgtatcatgtacaactttcaacaaaatattaggcaagaaaaaaaaaagtaagaagagacaaagtaagcatcaaaatcagactcagactttggaattattagataggtatatatttttttcttttgagacagggtcttgctctgtcacccaagctggagtacagtggcatgatctcagctcactgtaacctcaacctcccaggctcaagtgattctcccctctcagctacttgagaggctgaggcaggagaatcgcttgaacctgggaggtggaggttgcagtgaaccaaggtggtgccattgcacaccccagcctggatgacagggtgagactccatctcaca

SEQ ID NO: 238593 - DNA, 576 bp, Homo sapiens
tgacttaatattttagattagacatattagtccaacaatgataatgtcctctccattatatgtgaaaataaagcacttgactcagaaacattatctttaagtatttctcaagcacaggtaatggatttgtacggattcatccacatttcttttcctacttcttttgtaaccaaaagccaatctttgtgatgtatctaaatagagactcaggttataagccattgctatggaaaataacaaggtttgacaaaaagaggtagaataaatttttttttaaaaatttccaacaataacttttacccacccaaattaaatattatctaactctaggatggcatgggctcttttaatgactatcatttagagggataccggtttgactaaacactgtagctgaaacgatattccaaactagtctcccttcatgcagtatacacagtctcagggttaacccgggagaggaaattttaaatgtacaaagctgtcattatcttagatcataaccagatactcttttccccctgttttggtaaaccacagggatggtatttcagatgcaccattatatacaaaaaa

SEQ ID NO: 238594 - DNA, 623 bp, Homo sapiens
  misc_feature (1)..(1): n is a, c, g, or t
ngagtcttatctctggtgccatttggtcttcctaagtaattacagaaaaaaaaaaaataggtggaagttgcagctgcatgccccatgactcaggctgcagagaccaattcctgtcaaggctcagaataacttaaagttccaagagctttaggtttgatttaacaaagcttgaataatagtaataaataatattattaatctcaaaatcctgggctcaagtgatcctcctgcctcagcctcccaaagtgttgggattacagtttacatgaacaacagacaagctgaaaggttgtaaggaaaaggtggggagacattctctggggaactgaaaagctccctcaaatatgagggaattgagaaagccatatacatgcagggcaagatgcatgctcataaaagactcaagaagtccaggtgtggtggctcacacctgtaatcccagcactttggaaggccaaggcgggaggatcccttgaggccaggagttcgagaccagcctgggcaacatagcaagactccgtctccacaaaaataaaaataaaataaaataaaatagcaagacacatggtggtacatgcctgtagtcttaggtacttggaaggctgaggcaggataatcatttg

SEQ ID NO: 238595 - DNA, 435 bp, Homo sapiens
ttctcgcttagatgcacctttacaaagaaaatttccctggctggctgccaacggtttctctgcccacttccattttaagcaatttttatgagtgtcccatctcttctcaaacaaaggcagatggcaaaacttgctggtttacttttaaagaaaacttgacccagactgttataagctaagaagaggctttgtgaagtcacatggcctgggtttacccatcaccccctgataagcactcacacctgtaatcccagcactttggaaggccaaggcgggaggatcccttgaggccaggagttcgagaccagcctgggcaacatagcaagactccgtctccacaaaaataaaaataaaataaaataaaatagcaagacacatggtggtacatgcctgtagtcttaggtacttggaaggctgaggcaggataatcatttg

SEQ ID NO: 238596 - DNA, 576 bp, Homo sapiens
aagggagcaaagcagactttgttctcaaaggattgtatctattagttccgacctgtctggggactacctaaagaatggatgccagacattcgcttttgttttgcctgactcagaaatctctcaagatggaaaagcttctacttaagaggacagttctccaaaacactgaaaggcaaattaacaaacctctgctgtccagagcaaagattacagtttacatgaacaacagacaagctgaaaggttgtaaggaaaaggtggggagacattctctggggaactgaaaagctccctcaaatatgagggaattgagaaagccatatacatgcagggcaagatgcatgctcataaaagactcaagaagtccaggtgtggtggctcacacctgtaatcccagcactttggaaggccaaggcgggaggatcccttgaggccaggagttcgagaccagcctgggcaacatagcaagactccgtctccacaaaaataaaaataaaataaaataaaatagcaagacacatggtggtacatgcctgtagtcttaggtacttggaaggctgaggcaggataatcatttg

SEQ ID NO: 238597 - DNA, 507 bp, Homo sapiens
  misc_feature (479)..(479): n is a, c, g, or t
cttttcataactatttgtcttttgagaaaagtatttctgttgcatttgccttcacagatggagctgagcatttcataatagctaccataaaaaagagggaaactttcaagcttgttaaatttgaggttcttaaataaatttcttagagaaaatgaagccagaaaaataattatttagtttgggcactccattctgaagatggccctcagagtagcaggagctttttagagaggtagtagcagtagattgtcctacaatctgacctccactgcctatccgtgggaagttgtaaaaggctatctttaagaatattttaaagaggccaggcgtggtggcgcacgcctataatcgcagctacgtgggaggctgaggtgggagaatcgcttgaacctggtaggcagatgttgcagtgagccgagatcgcaccattgcactccaggctgggcaacagagcaagactctgtctcacatataaagangattacctaagagagctagaagacacaa

SEQ ID NO: 238598 - DNA, 781 bp, Homo sapiens
ataactgcaatgacgtttatcatgtatgatttaaagtcaggaaatgcctcttggtaacctacagggtcagtttttcactgatgggttacaactggcctaattggtttgacaaacctagcttgattacatggacaaggagacataaaaggcttgttgagaatttctcctcgaagccctcctgaaagcatgattcctagcacagaatcttggtggttgacactggagacagaatgcacactctgtgtctgtgaatacttggagccctgggtagctttcaacctgggatgtctttcagactcccagtccatgcccgcactctctttcacttgctgcaccgtattgtttgcctttaaataaaagccccatgtaaatatgttctatggaatgtggtggttcctttcaaacatccaaacaggaagcttttcagtatgtatacatttatattgagaatacacctaagaatgaatttgctctttgccagttcataaaagtatatatatttatatattgagctttagacaaaatttacaagtaaaatacagaaggaaatttcttgaaccattagagaataagttactgacctgattcccagttaccaccaaatatgttggggtttattccttacaaacaggtttctcctacgtgttcacaacacaactatcagcattggttgtattcccactaacaccctgttactgtctaatcctcagaccccattcaagaccctggcactctacattaagctacccctgggtatagttaccttcttcactctactctg

SEQ ID NO: 238599 - DNA, 464 bp, Homo sapiens
ctacactttgagaaccgctgctcttgtctcatctcctcattttatttagaaggacacggacctcggaaatccaaaatgacgcagcctgttagtgggaggatacagattagatggtttgtctcacttctcttgcttaggttttcggtcagatacttgggaaatataccctgatggcctgtcctgttctctgtagctgcaaagactgttacaatatattatccccgcaaaaattttaataaaaaaggaatcatcagcaaacctgataaattctacaacaagcatactgtgtttgaatttgagttatgacatttgaattaggatctctatttgaactgaaacactaaggcaaattctatggcgccctactccatgcaagttgttaacgacaaactgcacagtaaatatcacaaacacggaaataccacagtgtctgcatctgaaatataattcagtgacagattcca

SEQ ID NO: 238600 - DNA, 1928 bp, Homo sapiens
  misc_feature (6)..(6): n is a, c, g, or t
  misc_feature (907)..(907): n is a, c, g, or t
  misc_feature (945)..(945): n is a, c, g, or t
  misc_feature (1150)..(1150): n is a, c, g, or t
  misc_feature (1261)..(1261): n is a, c, g, or t
  misc_feature (1373)..(1373): n is a, c, g, or t
agattncttttaacaattaagatcttgggtattgcaacctattcataccccctgaggaatggacctgctactttttatagaggcttctttgttctctccagatgtggatgccgggcatcctcaggaagggcctgagaacaaagcagaggaccagatcctgtctttgttcccaaccattgtctgcccagcatatgggtcattgtattctgtaggaatagtcagcatagtgcctggcaccgtaactatttgttcaatgaacaaatgaatgaatgttgaagagagagagactagaggctggatttcacttgggcctctcattctcatttatataattaattcactcattaaacatttttttcttctctttttctcatcactgacttaaagctcacattcattaaacattaactgaatacttatactgtatactaaatattatactagatcttagggggaatgcaaatataggacagatttccaataccctatggagctaaagatctatttaatctagactgaaggggaaagaatttttaacccatccctaggagaggtataaatagtgggtcagcttactgtacttcataggagaggagagctgatggtgcctcttcttaatacagagtggagtttcatcagaaaagctcatcagtagagccggacagaaaagcttcatagatccttaaaatgcagtttcattgttttgcttgaaatgccccatagaaaaagggaacatccttttttaaatatcagtgcctgagcaccttccagaatagagagaattatttttggatcacccacataaaaataaagattactactcctggcggggcatggtggctcacgccctgtaatcccagcaccttgagaggccgagatgggtggatcacctgaggtcaggagttcnagaccagcctggccaacatggagaaaccctgtctactnaaattacaaagattagccaggcgcagtggtgcacacctgtaatcccagctacttgggaggctgagcatgagaatggcttgaaccctggagatggagtttgcagtgagccaagattgggccactgcactccagcctgcacaacaaagcaagaccccgtctcaaaaaaagttgtcagttccttagtcccaaaatagagagcttatgnttaaaacactccaaagaatctgttctgttttaaatatgtaaatatccttttttaaaaaaataatttatttcttcgaaaaaagttcagtagccttaagttgaattgttgaancgtggagatttattatgacttggtttttaaatttctttgaaattctccacaataataaagtaaaaagagattaataaaaagttcttttcttaaactgtgaaagcaattgtanacatgtggaaagatgtgcaaaagaaaacaaaattaactcatgatcccattaactatggtaatggttaggcttatttctctctacatttttccctttgcgaagtgtatttaaataaaatattcagtattgtattttgagctttatgactaatgattattgtgtacattttgtcagtaatttaacaactacttaaagttgctgcttttaatgatcattcagtgttctgtcatatgaatggatcatcatttatttaaccattctctaacaggttatatttaggacagttaggttacatttcattattcattacttttttttttttttgagacagagtctcgctctgtcgctcaggctggagtgcagtggcatgctctcggctcactgcaacctccgcctcccaggttcaagcgattctcctgcctcagcctcctgaatagctagaactataggtgtgcaccaccacgcccagcactttgggaggctgaggcaggaggatcatttgaggccaggaatttaagaccagcctggggcaccatactgagatcctatctctac

SEQ ID NO: 238601 - DNA, 472 bp, Homo sapiens
tgtctagttaatgttgatcaaattatctgttattagattccaagcatgtctttgcagatttaacttattttgaaattttagggatttattgaaacatatgctgctcctgtatttctggaaactctgatcatgagaaaaaaaggatggtctgatttacattctgtttgacaaatgcatttgttagtgatagtaaattgaaagggtcagcaaattaatgcattatccttaatttcatagcctaaattgatagtatttattagagtggttattggcttataattttttatgataaattgattattcttgaatctttagtatgtaattttcaatgcaatatctaagacataggaaatttaaatccaaacactgaatgctttttaaattatctactgatttatatttaaattttgtttgttaacttataatttataattttctattgttttctaagctttagtacactttccttaga

SEQ ID NO: 238602 - DNA, 503 bp, Homo sapiens
ttagcaagtaagtaagtgaacagatatatgatcattcctcacagtgatcaatgctatgatggaaaacagcatggcagggagtgtctcgactgtgtctgtggagggtcacttcaaatgaacacagaagggacattgagctgaggctgggatgacatgggaaagctgcatttgcgtggtggggcaggagcaccctggacggaatatcaggtgtaaaaatgttcaggcaagaaggagctaggctgctggagaggcaggggttaggcagtgaggacaagagagaaggaaggcagctggaccacgcaacagtcattgagattttattctacataaaatgatctaccactgagagaactttaagcaagacagtgatgtgatctgtttttgctcatttaaaagatcactctgcagcccagcaccgtggctcctacctgtaaccccagcacgtcaggaggccaaggtgggaagattgtttgaggccaggagttcaagactctgtctctaca

SEQ ID NO: 238603 - DNA, 445 bp, Homo sapiens
attttctccgcctgtatgtatggataatcctattcaacatttttaaggtctagaagctgctaggtcactagaaagtaattttgctatgatgtgaagaggttctctatgatgatgtatgactgataaattatgatgattaatgtcagaatataagggtcactgcctaactcattctctgttatcagtagagggaaaggagctgctttctcttcactatttttttctagaagaattttctatccctgtgttttccagtatagtgactactagccatttaggcacgtaagatgtggctagttctgagatgtgaaatagatgttaacacattgaatttcaaagacttagtacaaaaaaaagcaaaatatcttaatttgtatagtgattacatgttgaagtggtaatattttggatatttgtgttaaataaaatagattattagaattta

SEQ ID NO: 238604 - DNA, 229 bp, Homo sapiens
tcgcctgccgccacgcaagacatgactctttgctcctcattcgccttcagccatgattgtgaggccttcccagccatgtgaaactgcaaatggcaatgtttcagataatgcctgctccacaagcttggatccagagtgataagaaggaatgacagagcttccagtttattcacaatggatgtgaagcatgactaagaaataaatttctgttgtgttaagccactaataa

SEQ ID NO: 238605 - DNA, 499 bp, Homo sapiens
cagaaatcagtcatcagaccaaggggaaatcatatgggaactcacagtaaaaagggaagcatttgacttcaggcagatcccagtcttgccattagttttcttctcctctaaggtgggccccatagccactgtttctgcctgcctcgtaggatcagcctgagactcaggaatgataatggctataactgaatggctttgtgagacatcaagattattaaataagcggcacacagagatggaacccatttatgacacgtttgtggtagcatttttctactttgagttatttgtagcttcacaagaattttcatttccaaatataaagtgaaaatgttgtgtcattcgccattaagcaacccacagaacagttcctgttctttctaaaatgggatggagtgatttatcggtacaatgcagaactccttgtttcatacccgctgttacttttcaacttgtgaggttttcatatataattaaaacagcctcaatatttgtaata

SEQ ID NO: 238606 - DNA, 862 bp, Homo sapiens
aatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcaaaagtggccttccagtgtgctctgtgtgagtctttttttttccatagaaaccagccaaaggacagtgatatatttaagaaataatcattttatcagacacactgaaatggatcaggataaacaagaaagtactcggtggagccctgtgtactgccaggtgggagaggagttctcttgtgtggttattggtttctgaaaccgaagacaagaggcagcccatttc

SEQ ID NO: 238607 - DNA, 807 bp, Homo sapiens
aatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcccaaaggacagtgatatatttaagaaataatcattttatcagacacactgaaatggatcaggataaacaagaaagtactcggtggagccctgtgtactgccaggtgggagaggagttctcttgtgtggttattggtttctgaaaccgaagacaagaggcagcccatttc

SEQ ID NO: 238608 - DNA, 487 bp, Homo sapiens
caggttcccattactctgtttatccccattgtctgagtgagcctcagtgttaaatcagtgcacaattagtgctttcatatcaggttgattatttagttcttcctccacttgcccagacatagaatcttcctccagtaccctgtttcttatgtagttccacacaacatccaaatgcacacaattttttgagtaaactatttccccacttaggttacccttcttccctctcttttcatgaatcaatttcctgttcttctgtcaaaatccaaatgaagacttactggctttgtgagttaattatgcatgcccctcacatcctcagtagtattcagagttctccagagaaacagatcaataggatgtgtgtgtattttggtagggggatagggatgacggtaaagaaatttagtatacagaattagaccatgtgattttgtaggctgagaaattcagacccaggagagctgatggtgtaagttccagtcca

SEQ ID NO: 238609 - DNA, 211 bp, Homo sapiens
agaagagaggaggaaagaataaaagaagtggggtgaagttttggtttggtagaggaaacttgaagacattttcactggaaaggaagagaggaagaggagggagatgtctgtaaggacgagcaaaccgggtgacagctgatttcctcatattgaagtaatgagtcctagttataataaattcctaataaaaacccagtttatccctgcaata

SEQ ID NO: 238610 - DNA, 503 bp, Homo sapiens
tggcagggacaagcgacccagccagccctcctgcaggtgactgggaatgagagctgagcacctcccaggtagggaggataggtgcaaaggggctcaccccagctctcgccatcctgagaggagagaggaggtgcccttcgcaggcagcagagccagcccagccgctggctttcatttcccttcctcacaagagccatttatgacaatccgtcagggcaagctgatgcggcagatcgcttttggcagaagtcctttctacttgtcataaatcacagagaaagccaccggcggtgaatacaaagaaagtccaagaccactggctggaggttaacagctgttagcgacccagggttcaggagactttacaaatccacaaatacgaacaaggcaggctcctacaaataaattgggctgtgaacaactaagaatgctgtctgggatgaaagtcacaactcagaatcacaaatgataatacagcaagagcaggacaaaggcggcctgcc

SEQ ID NO: 238611 - DNA, 511 bp, Homo sapiens
atgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgttta

SEQ ID NO: 238612 - DNA, 177 bp, Homo sapiens
tccaacctcacatttctttttctttctttttttcttttttctttctttctttctttctttctttctttctttctttctcattctttctttttcattctttctttttttctttctccttccttccttcctctctctctttctttctttctctttttctctctcttctctttctttctt

SEQ ID NO: 238613 - DNA, 720 bp, Homo sapiens
ttctttcaacacaaatttggtgtttagtactatttttagtagtagttgtttggcttctgagagacttaattttttggaacacttttagatttacagaaaaactgaagaaagtagggttttcacagccccccagctcagtttctgctgtttactgccatctctcattagtgtgctgcctgtgtcacagttgatgagctgatactcatacattattactaactcaagtccacaggttcactcttaatgttgtatgttctagggtttggatagatgtgtaatgacatgtattcactgtgacagtgttgtaccgagttcactgccctaaaaatcctctgtgctctgcctgttcatccctccctctgcccaacccctggcagcccctgatcgtactgtcctctagttttgtcaagtaatactttaagaagtaaactgggccaggcacagtaggcttatgcctgtcatcccaacacttcgggaggccaaggtgggctgatcacttgagcccaggcgttcaagaccagcctgggcaatatggtgaaaccctgtgtctacaaaaaatataaaaattagcctagcatggtggcacatgcctgtagctcaagcaacgtgggaggctgaggtgggagggtcattgagtctgggaggttgaggctgcagggagctgagatcatgccattgtactccagcctgggcaacagagcaagactctatctccagaaa

SEQ ID NO: 238614 - DNA, 367 bp, Homo sapiens
cagatgtaaaatgatgtagcaatccaggtctagtctctccaactctagtacatttactgtgtcagagtattaatatctggaatattgccaggtgtggtggctcacgcatgtaatcccagcactttgggaggccgaagtgggtggatcacttgaggtcaggaattcgaggccagcctggccaacatggtgaaaccccatctttactaaaaatacaaaaattagctgggtgtggtggtgcatgcctgtagtcccagctactcagaagactgaggcaggagaatcgcttgaacctgggaggtggaggttgcagtgagctgagatcatgccactgcactccagcctaggtgacagagcgagactccatttc

SEQ ID NO: 238615 - DNA, 342 bp, Homo sapiens
ctagtcattagcctgtggttttttgaagcagcatgctataatattacagcggctcattactgacaacctactctgtgccagctgctgtaagcatatgattaccaatacataagcaaaccctgaaggtaggggtttaaaaaacaagaagctgaagttcataggttaagtagattgttgataaatcatagagtcagtaagtggctgtgccgagattcgaactggcatttggtctctgggcaaatatgctccactatgttaactacgctttctatttctggttgaaaagcatattgaaataatgttttgtattctttttgaaagagagattcttataccattacc

SEQ ID NO: 238616 - DNA, 448 bp, Homo sapiens
aaatttattgctcacaattctggaggctggaaagtgctagatcaagacaccaacaaatttggtgtttgatgacagccctgatcctcatagatgataccttcttggtgtgtcctcacatggcgaaagacaaggacactcccttcaatgttattaaaaagggcacttattccattcaggaagatggcgctctcttggcttagtcacttcccgaaaggtcgcatgcctaatactatccacatatgaatttggagggggacacaaatatttagaccaaaccaaaaatttaataaacaagaaaaactatgtggaggatggcatcattaatacttgacatgtgaaaaattgatgttcctaccacaaaggaaagaaatgacttattcttcatgttcttcatgacatagaacaaaataaaggcccaatgaaagataaatctatacaaaaaaatgaa

SEQ ID NO: 238617 - DNA, 237 bp, Homo sapiens
ctgcactccagcctgggtgacagagcaaggctttgtctcaaaaaaaaaaaaagaaagaaagaaaaaagaaaaccctagaaattaaataaaaatacactaacataaataaagaatgctgtctgggcacagtggatcacacctgtaatctcagcatttttggaggccaagatggatggattacttgagcccaggagtctgagaccagcctgggcaacatggcaaggcttcgtctctaca

SEQ ID NO: 238618 - DNA, 894 bp, Homo sapiens
cagagccagcacctcactgcggggtagactgaagagggtcataaagagcctctgggggaggaacacctctcccttacatcttccacaaaagaacttcttggtttttctcagacccatggcagagatgtgccctgtctcaggctgacagctggaaggggctgggactcagagctaggtattgccagtcttctccatgactccccccactcctcctgctcctgagcgtctccatcaccaggcaagcccccacccccattctggatagagagaataaacccaaggatggaagggtgggctaaagaggaagtgctcacaattaaaaagagaaagaattaaaagcagcaccaatagggaagggtaattatccttcagttgctgcagaaatacaattagggccatgctctctgagccgccaggatattgtggcttttgctaattaaggagcggatgtgtcctgccagcgcaattagaggctggcccaggcagcaggggctttgcctctcctccaccagtgccacactgcaagggaaattaaccagggagcccagcgctgtgcctgcagggaggggatgactgggccaggattccaccagcctcctgtccacaaccatttccccttttcctcttcctgctctgcttaccccagcaccaccactctgacttcattctgaagcttccagggctcagtaaccacaggaagaattttcaccatgggccatgcccataggcttccagaagggggaggcaccagtagagaggggtcaccatttccaagctctagtttctcttctgcatggtggttcaatgctttatgattagtaaaggaaagagagaaatgagccacttgcctgcttctctttacgttattatcccagcactttagaagctgagggg

SEQ ID NO: 238619 - DNA, 442 bp, Homo sapiens
cccacatcatgctcagtgctgtttctgaagaccatctagacttttgtgttctctggaacattctactcaccttcagctgcagcacatttcttcagcctctccaccaagctctttaaaatgaaaggcagttactgtcttcccttggacaataatgaatgtatctactgtatgtgcagaccatgtcgagaagtggctgggttaagaaaaaagagggtttttgtaaagcctgtttatttttttaagtcagttttgagcatttctattttaccacccttcacatggttttggggaacccaaattgtatcaaggtctcatgccaaaacaagccaaaagttgttttctttacctttttcctccatgcaccatgatttcaatgattgtttcagtgtcattttaaatgttttcttgtgacatgtactgatgataaaagtcatcttgacaa

SEQ ID NO: 238620 - DNA, 370 bp, Homo sapiens
caaaacacctggtagtaccaggactcaagtctccccatttctcaagtataaaggttgtattggaagccttctgaagttttctcccagccctcaagtttttagctctcaatggtactatttatgtttgtcacatgaactaatctataagaggccctgcccttctagaggatgtgtaaattcagagatgcggcccagctgcaggccaccaccctgctccctccagaatgaaacaggcccagttgagtgacatcagcaaaccgtgtccagaccgtatgatggaatcttttgggctcttatgacaatgtaatgttgacattttttgttttaagggaaaaacaagttatttcataaacatatttctttttaacct

SEQ ID NO: 238621 - DNA, 499 bp, Homo sapiens
atatctgagttgttagcaccactactctggggctattactaagtagaataagggttacatgaacacaagcactgtgacaggtggcagttggtctgataaccgagaaggctaccaagtgactaatgaatgggtaacatctacagaatggatacattgcacaaagggaggactcctgtcccgggtgggatgaagcagggcagcattagatttcatcacattgctcagaatggcatccaatttaaaactcattaatcgtttatttctggaatttgtcattgaatatttttggatcagggttgaccaagtgtaactgaaacagcagaaagcgaaagtgcagataagaagggggctactgtactgttattcagcctgttttttctgtttcccctgagagcatataaagtccagggggaaaggaccagccttatgtgtgtgggtattcaatactctgcacattatatactgtagtaaatgtattgaataaactttcagctatcta

SEQ ID NO: 238622 - DNA, 561 bp, Homo sapiens
atcattttcatctttgtgtccttagtacctaccatggttcttcgcacctaatggaatttcagtcctgtgccatggaagccttgaattccagtgcccgttacttcttctgctgccagtggctcccatttgtgttctctcctgtggcatcggattcgatgcagaaatgggatacctgtgtactcatcagctcctattcctccagctcaaccaaagttcttttaacagtaaaaaccaatatgcaaagaagaggaggaagagatggaaccatcaagccctcctgggctcagaatatgtgtgtgtgagcgcacatacacaggtgcatgcagctttgcaatataagattaaactgtacaatgttctataatctccatttttccattcactatattatgaacatcttccaaatcaccatatagttttgtataacacacattttgatgactgaacagtaatgtattctccacaatttgtattaccaaatctttactgatggacacaagttatttagagttttgatcattaaaaacatagctttaataaacattcatatatctttgcacc

SEQ ID NO: 238623 - DNA, 677 bp, Homo sapiens
attcttgataactagagagttttgttccttctaggatagactcaagaaatttcttcagaaaataacaaagaaatttaaaatataatcagaatagttaggtgactggtatattccattctgtctttcatgctaagaggttatttagagaacaattttcttttctttttttttttttgagacagggccttgctctgtcacccaggctggaacgcagtggcacaatcatggctcactgcagccttgacctcctgggctcaagcagtcctcctacctcagcctcccgagtagctggaactacaggcttgcaccacctcacctggctaatttttgtatttttttgtaaagacagggtcttgctgtgttgcctaggctggtctcaaaactcctgggctaaagtgatcctcccaacttggcctcccaaatgcctggattacaggcatgagccactttgcctggctgaacataattttaaagtttttgagtgaaaaataatacctagtagaaaaaagatatgttatactatattaaattgtctgtggaaggccgggcacggtggctcatgcctataatcccagcactttgggaggccaaggtgggcggatcacctgaggtcgggagttcgagaccaccctgaccaacacatggagaaaacctgtctctactaaaaatacaaaatt

SEQ ID NO: 238624 - DNA, 1796 bp, Homo sapiens
  misc_feature (54)..(54): n is a, c, g, or t
  misc_feature (1691)..(1691): n is a, c, g, or t
  misc_feature (1710)..(1710): n is a, c, g, or t
tacagcaaatcactgatgtggaccacagaacctcacagtttataaagctgtagntgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacntgggaggctgaggcagganaatggcttgaacccgggaggcggaggttgcagtgagccgagatcgcaccactgcactccagcatgagtgacagagactctgtctcc

SEQ ID NO: 238625 - DNA, 506 bp, Homo sapiens
gaaggctgcaccgcgtacgatcgagggggcactaactctcctttctgaaagcgctgtcaccccgtggtttctcctgcggttcgaccggcgaccctctccgccctccctgctccatctgagggtcaccgcctattcgtgacctttcggctgattactagagtgtcacaaaaaggcaccttctcccccttcccgaaagctccatttctataactcaaccagccgtcggggacccggggccaggcggggtcagacgggacgggcggacactgcccgtcaccccggggctccggccctcccgccagccgaggctcagtgggcagggggctgggctcccccgaccccgggccagggcggatcgcgggcagaggtggctccgcccggggctccggtttcaatttcgcaacgtgacggtgcaaacctgaggcctacaaacgccagcggcgacggtccgcgccccgcccgtccgccaggcccgggctccccagctccccgtacgccgcggccgc

SEQ ID NO: 238626 - DNA, 299 bp, Homo sapiens
tgatgtatgtaaaatgagtataaatatagaacttgaagtcaaagcttaaggaaataaaattgtttaactaaaagaaaagttagaaattcttccagtgcttttccttttcttttccccaagttttcacactcatttatttagaagaaacaatagagggtgaatgtgactgagagttgcatggtgtcagtacatctgagcaactccaagtttggtttggtggacaaagagaaagggaagaacaaatccgtattaaacacttctgtatgccaggtattatgttaggtgttgtacattgattt

SEQ ID NO: 238627 - DNA, 481 bp, Homo sapiens
tctgggctgggtctgtcagtggctgtgctgtggcccctctgctgggcaccttctcagaagatcactcatccctggcatcttcctgggccttctgcagcttctctgcacgtgaaacgaagtcctctggcttcacgcaggtacatttaccttgaggaacttctcgatttcaaagtgttctgctctgggaaggaggagggcacaagcccccatggccccatcctgggagccccacagactgggatcccagtggtcacaaaggatcctgccagggacggaggcaccaaatctagtctggagaacaccgggccatcctcactgccagccctcagagcctcctacgtgcgtctgtaatgcaaggcaaccctgcatgacactgtctgcaatgattctgtccctttctgtatattcttagagacaagatgcatattagttacagtttactgatatggtaaaaggtaataccctccctccgctcaccaaa

SEQ ID NO: 238628 - DNA, 374 bp, Homo sapiens
taactcccaatcaccttgactgaccttgatgtcctcaaaatttcctcaggtatattctgattataaaataacacactttcaaagatggctgaataggaacagctacagtctacagctcccagcgtgagcaatgcagaagatgggtgatttctgcatttccaactgaggttcatctcactgggacttgttggacagtgggtgcagcccatgcgagcatgagctgaagcagggcagggtatcgcctcactcaggaagcacaaggggtcggggaactccctgtcctagccaagggaagccgtgacacatggtacctggaaaatcgggacactcccaccctaatactgcacttttccaacagtcttagcaaacggcac

SEQ ID NO: 238629 - DNA, 479 bp, Homo sapiens
gtgatcctcctgcctcagcttcctaagtagctgggactacacgcatgtgccaccatgcctgtagagacagggtcatgctatgttgcccaggctggcctcaaactcctgggcttccacctcagcctcccaaagtgctgggattgtaggtgtaagccaccgcacccagctcattcttatcatttttaaatacaagtcagagaacatttggccaatctaccaattgcaccgtagaatttgaaggaaaattaacagtgtggttgttctcatatttgcaaaaaagataaatgctatcataagtattatatgccttaaaatacaatgcaaatagactccgatatttgtagataaaatattaccaatgtatgtcttggatttgcttcaaagtaataaagggaagggaggggatgggtttacagatgaaacaagattggccatattgaagaaagttatgcaaacttggaaataaaaggatgactgca

SEQ ID NO: 238630 - DNA, 363 bp, Homo sapiens
ctgagacacggcattcagtactttaacaacaacactcaacattcctccctcttcacgcttaatgaagtaattgtgcaaacgaattgttccaaagagaattttctggtcttaacttcagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctat

SEQ ID NO: 238631 - DNA, 422 bp, Homo sapiens
agatacaggggaatggacagattgaccttgcagaggagtaagcacgaggacagaggccatgcagagaggcagtcacctccctggagataatgttgagaactccatgcagccacccaccccaaccccagaccctttctcattctctttctccagtccaaggggggcatttgaactgacccaacttgagtcacgaactcatccctggaccagtctgcagtatgactggaggaagtggtcaagatatctcaatacactgacatggcccctggtacccatccctacacatcccccccttcccatgaaagagggggactcaagctgttcagctaccccctccccatatggtatctaatataactcttaaatctttccctccagcacatgttggagtatgaatcagaaatttccagttgttcccaata

SEQ ID NO: 238632 - DNA, 487 bp, Homo sapiens
ctggtagtgtaagctgtggattataatataaattttatttttcatttttggtagtcaataaaagcaaatgctataaatttcaacaggtgcaagaaagaatatggcaaaatgtaaggcttttttctatccctatcccttagctgcttagtttttctcctcagaggcaatctgtgatactagtttcttatgtattcttccagatatattctgtgtatgtataagcatatacatatatagataatggtattaaaaaaatagaagtagtaacatgctgtacacattgttttgtgtatacagcagttaattctgttaattgttaatttctttttaaatttagtagcttggagatcattccatatcaataccatatcaatttcatatgaatagaactgcctcgtgttttaagttttaaaaatagtattccattctatgtatataccatgatttatgaacattaaagatttaaggagcatcattataacatata

SEQ ID NO: 238633 - DNA, 622 bp, Homo sapiens
tatgttccttacatatatatatatatttttttgtagttacagaagcatgtaattttgctttgccattaaagcctgcctgaggtgtttactgtttagagctacaggatagctttgtctttgagaactgggttacatattgtgtgccaggcattgtgctgaggttttggaattagaaaaattgattaaaacctgttccctactcctaagaaataaaagaaaatatttggatggcacttgttatgtttgtatcaggctttcttctaagtgcttcacatacattaactcatttaatcttcacaatattgccgtgaagtagatttattattatctatttattactattattccctttatatgtataagtctaatggggcacagagaagttaaaacacttgcccgaggtcacacagataagaaatgatggagccagaattcaaaactcggcagtcttaggctggtgtctttgctttcaaccacaatataatactgcctctcaggaagacacagactgaaatcaaatatatgtagggcagtgagacaggttccacaataggttgggggtgacaaatgggacgcaggtcagttctacctcgtgagatgaggggatgatttaaaacttgat

SEQ ID NO: 238634 - DNA, 423 bp, Homo sapiens
cacatgttggcaagttcaccccaaccaccaaatgtctgagttgacagtattttcagcaaaacacagaaaatcaagtaacacatacagtggttccccttatccaagaaaatctggttcaaaaagagatgtgtaccagaaggtaatctgggagaggccacattcaaataactttcattacagtgtattgttataattgtctactcacctgatttcgggagtttgagaccagccagaccaacgtggagaaaccccgtctccactaaaaatacaaaaattagtctggaatggtgtcgcatgcctgtaaccctagctactcaggaggctgaggcaagagaatcccttgaacccgggaggtggaggttgcagtgagctgaggtcacacgactgcactccagcctgggcaacagagcaagactccgtctg

SEQ ID NO: 238635 - DNA, 500 bp, Homo sapiens
agagtgtttgctgataattattgacagtttgctaattacagcattatttggcctgttaaaggtatatgtacttctcccagttaaagaaaaagtacacaagagggctttttctctctctctctcttttttttttttttttttttttttttttaccagaaaagatactcctgtatccagataagaacccagattcccacaacagaacatttagaaaaggggtgggggagtgtagcgtatctctggtcagcaatgtctacaacatagacaataactcaacactgtacactactcagaagctaaactttccctgaacattacacagaacagtcccataaaaggtacaatttctactgcagtggtattgttttggcttgtctgagtctacaagttgtattggttctagattgggctgatctaagacattccacttcgtgtatacttatgtaatgttacacaagtgaaagaaatacatttttaaaactttttctgattaaaatacc

SEQ ID NO: 238636 - DNA, 430 bp, Homo sapiens
ctacaccaaacaccccctgtggcctctgtgttctgccccacatcagttgatgctggggacattgaatgatctagcacagagccagggtgggggcaaagtctgacacaataactctaaaatgggagctaagtcaatcaactggtctgggagggttagggaaggtacccttgagctgagatctgaagggtggatggaagttaactaggccaacaggggggtggaaaaagcattccaggcagaaggaacaacaagtgcaaaggccaagaggccgaaagaagcaactaaaacaaggccaagagggctgggtgaagtggctcccagcactttgggaggccaaagtgggcagactgcttgagtctaggagttcgagaccagcctgggcaacatagtgagaccccatttctacaaaaaatacaaaaattagctaggc

SEQ ID NO: 238637 - DNA, 414 bp, Homo sapiens
tctgtagagattgggtttcaccatgttgcctaggctggtcttgaactcctgaactcaggagatcctcctgtcttggtctcccaaagtgctgggattacaagtatcaggcaccgtgtccggatgtccttctcacttttttattttttcaactacttgtgatcatgctatatattagacttgtacagaagagaagttggactgtgatttattcttatttttaatttttgaaaagcatttgaagtaaattgaatcttacattatgtggagaagttgacctcgtgtaaaatgtattaatatttcagctgatttctggtatggttcagggtacctagaaaatatcttgtgccataaaaaatgctgaatacagactattatatgtctttatttattttctggattaggtggtttgggaaa

SEQ ID NO: 238638 - DNA, 550 bp, Homo sapiens
agtgccttcctcagtgtgtccccgctacttatttgtgggttgtcttcccatatgtttcttcctcagacactaaactgaaaccagtgtcttattcatccttgtttcccttgtgggatcaggtactccaccaacctgcttaagaaacatggaaaagattcactgcaggttcatttgtatcaaggatttgctcagatatccttctatgcgcaagccactctttcattcatttttcatcctcttggctcctgactcgctctctgaattccagaatcttattctaatgaaatatgggacacaagtctctggctctgactttgacaccgtctcacccttcccagcgcaagccactcccttgacatccctattagtagggacagctctcctggctctgccaatcactgccctaattctccatttcctggaattaaacctggcacaacaaatgttaaatgaatcctgattaaatacataggccaatgcaaaatagtatacaaatgacttattttactaggtggtagggaggtcgtctctggtttcctactcttaatga

SEQ ID NO: 238639 - DNA, 397 bp, Homo sapiens
ttgaagggaacaatttggtcccatgtccagttcctgtgggagtaagggaataaggtggtgagtgtggaggaccatcccaccactcccctgacctctgtcagcaggcagggccatgtgcccagcaggtaggggtccccacggcagctgctcacgcatgtgtcccagggtcacttggagcacctcataggagatgctgagcagaagctgcggagcttcaccctggcaccctcgcatccccctcacctaccagttctggctaatcattctccagtttcaatggcttcgcctccaggagttgccactcttcggatgctacctaggctcctggaatcactgtggctgcctgggcagaaggccagggaactgggactttacatcgcccttcccagggcagcca

SEQ ID NO: 238640 - DNA, 289 bp, Homo sapiens
aattctaaagaagaatgcagctcctttagaatgaaaagcagtatagcatcatagagtgtgaactttaacattaggcagatgggggtgaaaagttgcctttagcattatctttctgtttaactctgggcaagttactcaactgctttgagcttgaaatttctgtctgtaagatagagatgttaatagcatcttcaaagggatttgtgagatttatacaggttagtgtgtataaattacccatgtacttggcacctagcaagtgttcaataaatgatagctattatcatta

SEQ ID NO: 238641 - DNA, 429 bp, Homo sapiens
tataaattactatcatccgtaatgtgattttttttactatttcttcaagccatatttatattcatacagtatttcttatttttttcaaaatcttcaatgatggtctattaatttaaaaaacagaaattcactgttgtataatgacagtttgttgttaaacttgttcaaatttctcttcaatcaattaataccttaatctgtaacagtcaaaaaatagtctctgtagaaattagttttgagactatttgactgtgaactcagtcactgtcttgcaaacattttcctttcattgtcctaattgccttatatttcattgaaatttcactttggttgtatatttcatatgcagttttcttccaaactagaaaatccatgttctgatacctacagaaatattttttaattttaaaagtaaagtagttaaactta

SEQ ID NO: 238642 - DNA, 433 bp, Homo sapiens
cgagacaggaatggtgaaactctgttagtctacaatgtgcaaggtggcagaagtgcatgccaaaagtggacataggcaggccaggtgcggtggctcacgcctgtactcctagcactttgggaggctgaggcgggggggatcacgaggtaaggagatagagaccattcggctaacacagtgaaaccccatctctactaaaaatacaaaaagttagctgggcttggtggcgggcgcctatagtcctagctgcttgggaggctgaggtaggagaatggcgtgaactcgggaggcagaggttgcagtgagctaagatcgtgccactgaactccagcctgggtgacagagtgagactccgtctcaaaaataaacaaacaaaaaagtggacataggcattctagtcagaaagtttgtctagtagtccaaaaaaaaaaaa

SEQ ID NO: 238643 - DNA, 975 bp, Homo sapiens
gtagatcagcagtccccaacctttttggcaccagagactgatttcatggaaggcaatttttccacggacctgggggcagggagaagggatgcagggagggggtggtttcaggatgattcaagtgcattacatttactgtgcactttattatttcattgtaatatataatgaaataattatacaactcaccataatgtagaatcagtgggagccccaagcttgttttcttgcaactagacgtcccatctggaagtgacgggagacagtgacagatcatcaggcattagattctcataaggagcacacgacctagatcctcgcatgcacagtccacaacagggttcacgctcctctaagaatccaatgctgctgctgacctgacagaggtgacctgacagaggtggagctcaggcagtaatgcaagcagtgtgagcagctgtaaatacagatgaagcttcactctcacctgcagctcacctcctgctgttcagcgtgggtgtgggtggctggggacccctgtggtatattatacacccacagcaactttaggagagataatttttcccaatataactgcagattataaaattaagtcaacaggtatttttcttacccttctatggttattactattccaactaaatgtatgaatggcctaatctaattgtttttacatcttggtttaatttctcagtaacaagtaattatcaccaaaatctcattccttttttgaaatcaaaacaaaagcccaagttcctagaaattattatacagggataaatgaggcactgaaggtgggagaaccatgaaattacagttgatccttgaacaacatgggtttgaatggtgtgggtccacttatatacaggcctttttctgtaagtatattggaaaatttttttgagatttgtggcaatttgaaaaaacaaaccatgtagcctagaaatatagaaaaattaaaaagttatatagata

SEQ ID NO: 238644 - DNA, 400 bp, Homo sapiens
cttctctttaggtcatattctacatccagtcttcaagaattgtctatgtagtttcaggtcttgtttgcaaacccttctatcctttcagtctgtgctgctgctcactgattgttctctttcttacctcttccttggattatcacaattttctcctaagtcacctactttcagctgcttctggccaataggctctccatactgcttcaagagtgctggatgaaacatagcatatgatcatgtttgtggcatcacaggtggtttatgttcttagagctgtcgatcaagaaaaataatgagacaagtctcaatcattttaggaagaggtttatttgccaaagttaaggacggatcctgggagatgggtctgtgcctttctctgaagatgattttgagggctcca

SEQ ID NO: 238645 - DNA, 456 bp, Homo sapiens
aacaacttttagaaagtagaacaaaaatttaggactaacactacctgatttgtaacacttttataaacctgtagtaatcaaaacactgtggtattagtgtaaagataaacacatagatcaatggaacagaatagaaagtctagaaataaactgacatatatgtgaacaactgattttgataaagataaaaaggcatctttttcagtagagaaaagatggtcttttagaaaaatgttggctgaaacaattggatatacaaaaccaaaaaaagaatctcaattcatacctcactatgtataatatataaatatgaatttaaaatgaggccaggcacgttggctcatgccagtaatcccagcattttgggaggccgaggcaggaggatcacttgagcccaggagtttgagaccagcctaggcaacatagaaagaccctgtctctgccaaaaaaaaaaaa

SEQ ID NO: 238646 - DNA, 150 bp, Homo sapiens
cgcagcccagcagctcagctgtgtctgtgggggaaccggggcctgcaccggttcagagtgccctgtcctgatcacttccctcgtgcgatagctccatcatccaggtgtgcttactggcaggaaccgagggaataaataaagatcactgga

SEQ ID NO: 238647 - DNA, 768 bp, Homo sapiens
tggaacaaatagaggagaatctacccaatttgattttaaaaggagaaaatctgtagctaacatcatacagtcatgtgtcacattatgacagagacacattctgagaaatgcatcattaagcaattttgttgtttatgaatatcatagagtgtacttatgcaaacctagatggtctagcctactacacaccaagactgtaagttatagcctattgcttctaggctacaaacttgttttgaatattactgtactgaatattgtaggcaattgtgacataatggtaagtgttagtgtatctaaacatgcctaaatacagaaaaggtacagtaagaatgtggcattctaatcttatggaaccattattattaatgcagtctgtcatttaccaaaatgtggttatgcaatctatggctttacttaatagtaaaaaattagaagctttgccactcacatcaggaacaagataaggatttcctctctctccactgcttttcaatgtactggaagtcctaggtaatacaagaagtctgtttatagataacatgattgtctagatagaaaatccaaactaattgctcctcatggaattaataagcaattatagaaaggttgcaggatacaagtttaatatacaaaagtcagttgctttcctatacatcatcaatgaacaaggaatttgaaaacaaaacacattattatttacatgatcacctcacaaaatgaagtgtttaaaatctaacaaaatatattcaagactcatatgagaaa

SEQ ID NO: 238648 - DNA, 468 bp, Homo sapiens
ggttccagatcacggcccagggacccctggcgttcagtttgcagacattctcttgccaggcagccagctttgcttcctgtctgacttttgctcgcctttgcttccacctcgtgctcccattttctctcctttctgcattgctaatgatattgtttgttctcggtgccacataaaaaaagcacaagataatcacccaggcattagtcatcattaagctggtgataaaaacaaaaaaattctaaagtgctgtttccaggatgggtgtcgtgcctgcgatgaatggtgtttattacaaatgtgagtttcggggagccatcccagccagccgcacgggagacggaggatgcgtggccacagatggacccgatccgttaggtgtaaaaggtaaatacggcgagaagtttccatcaccacctggaactgccccaatcttcgttgaatttgtcattaaagcatcgtgctcatctg

SEQ ID NO: 238649 - DNA, 866 bp, Homo sapiens
ctttttcccaacattttccccttctcttttttgtaaaaccgccacagctatcattattactagcataaaaggtggcctctttttgtttttaaattaattgagcaaggcaattgcaggctgtgcagcctttgattgccagttggtgatccaacttcattgttcttagcccttattcaaaatggagtcgctctggtttgaatgcttcccacgtatctcccctttcccttttacaagaggacccttaatcctaggggtttcaggatgaaggtccatgctgaatgggggcaatgatactcctgcctaactattagggtctcttgtattcagggtagagaggcactcagtcagaaagcattggtccgttaagcatctgtaggtaaaaccctggcgctccagcagtttctcagcttcctgtgcggttttcttgatctgtccccatgttatggggattgcacccacacggttcgttcatctccatgaggtagaactttccactgataatgagaaacaggccccttctaatagaaggcacagagaaagcaaatggaggcttctcaaaccttcaatttgcactgtacaggtgggtccgctagatgctgtggctcatgatagatcttcagatgtttggtgggcacccacacaggcacctgattgtcacctggagagacacaagcaaatcttcttccccatataattatctttcctttttcccagctctttgtatgtgcattcctccaccatgtatcttgtccagcctttttattttccttttgtcctgttaggtgttgtttcactgcagttatgggttgatctttttgtaaatttaaaaattttaatgttaataaagctaaatgcaattaaaaaaa

SEQ ID NO: 238650 - DNA, 421 bp, Homo sapiens
cagggatttttatctgttttatttgctgctacattttggcatcagaatcacacctgatatacagtacgtaataaatatttgttaaaggaataagtaaatgaacactatgctgaaagtaaaattaggggaaatatttacttggtctgttctagatttctaaaaggcttgccaaataatgtcatgccacattaactatatggctgtaataattattgctggtgatgatcttaatatatatgtgcccttttattttaggaagtactttgatgtatgtcaggcttaaaacccagatgacgggttgatgggtgcagcaaaccaccatggcacatgtatacttatgtaacaaacctgcatgttctgcacatgtatcccagaacttaaagtaaacggaataaaaaagaaagtaatttgtttcctgcat

SEQ ID NO: 238651 - DNA, 655 bp, Homo sapiens
aacagacaagagacggtaatagaggctgcccctaggaaaggacccagggaaaagggtatgtaaatagggagactgccttttcagtatgtacccatttgtactctgagtatatctacgggataaattcctagaacaaaactgccatgtttaagggaatatacgttataaatgtcatcagatattgtcaaaatgccccccaaagaaattgtatcaatttctattaacaacgtaggagtatacttgttttcccatacactaactttggatattacccattgtattgacttttgccaatcttatagataaagtataacatctccttgctctgatttagttaaaaaaaataaataacttggggagcttttgttctattttgtataatggaagctatctcaattcatcaaataaatacaaaacaattccaacacacatatttattatctcacaggtctcatgggtcaaagtatagcttatactgaccctaggctcagggtctgatttactttctttcttcttctttttttctttccgagatggagtctggttctgtcacccaggctggagtgcaggggcttgatctcagctcattgcaacctacacctccctggttcaagcaattttcatgcctcagctgcctgagtagctgcgattacag

SEQ ID NO: 238652 - DNA, 601 bp, Homo sapiens
aacagacaagagacggtaatagaggctgcccctaggaaaggacccagggaaaagggtatgtaaatagggagactgccttttcagtatgtacccatttgtactctgagtatatctacgggataaattcctagaacaaaactgccatgtttaagggaatatacgttataaatgtcatcagatattgtcaaaatgccccatacactaactttggatattacccattgtattgacttttgccaatcttatagataaagtataacatctccttgctctgatttagttaaaaaaaataaataacttggggagcttttgttctattttgtataatggaagctatctcaattcatcaaataaatacaaaacaattccaacacacatatttattatctcacaggtctcatgggtcaaagtatagcttatactgaccctaggctcagggtctgatttactttctttcttcttctttttttctttccgagatggagtctggttctgtcacccaggctggagtgcaggggcttgatctcagctcattgcaacctacacctccctggttcaagcaattttcatgcctcagctgcctgagtagctgcgattacag

SEQ ID NO: 238653 - DNA, 506 bp, Homo sapiens
cataagagattaacaaaaataactagtagtaaaatagaatatttataacagtatgccaacatcactactcttgggctttggggtcattattaagtaaaataagaattactcaaacacaagcatcttgatactgctgcagtcaatccgataactaagatggctgttcagtgactaatgagagggtagcctgtacagcgaggataagctggttgatgggatgattcacaagtcaagtggaatggagagggacagtgtaagatttcatcatgctcctcagaatggcacacaatttaagacttatgaattgtttattactgaaactttccatttaaaattttcagaatgtggttgaccatgactaactggagccattgaaaatgaaactgggcaaggtgcagtggctcacacctgtaatcccagcacttcgggaggccaaacgggaggattacctgaggccacaagtttgagaccagcctggacaacatagaccctgtctctatttaaaa

SEQ ID NO: 238654 - DNA, 326 bp, Homo sapiens
ggaccaagggaagcccaggccgcggaggtgaccactagggggcggcgcggagccggggcccgaggcctgtcgccgaggctgagtttggccccctgccccaaattggttcccatctttcagacagacattggtgtgaggaactgtagggtttatgatagagagggaaacggcgactctcattatctgaccctaataatgacctgaaagattactagtgaactcggtaatctgaatgagagcagtacgggccccgcctctgcttttttgctcttttttttttttttcaaaactgagtctagcctgggcaacagaaaaagaccctgtct

SEQ ID NO: 238655 - DNA, 1375 bp, Homo sapiens
  misc_feature (56)..(57): n is a, c, g, or t
  misc_feature (602)..(602): n is a, c, g, or t
  misc_feature (1014)..(1014): n is a, c, g, or t
  misc_feature (1054)..(1054): n is a, c, g, or t
tttcatcgtttctgcttaccctacttttctttcccatcctgatccctctcccaccnnactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcagagcacctcagggtacccccnccaggaggtggtggatgatgaagtgtcgggaccatcaggtgaggggactggaggaagaagaggtggcataggattgactaagatgaaggaagggggccaggcgtggtggctcacccctgtaaccccaacactttgggaggctgaggcgggcagatcacctgaggtcaggagttcaagaccagcctggccaacatggtgaaaccccatctctactaaaagtacaaaaattagccaggcggtagtggtgtgtgcctataatcccagctacttgggaggctaagacaggagaatcacttgagcctgggaggaagaggttgcagtgagccgagatcgtgctactgcactccagtctgggtgacagagtgagatgctatctcaaaaaaaaaaaaaaaaaaaaaaaaaaaaaaaaaangaagaaaaaaaagaagggtcagaggtcaggaaggagaacntggggagggtgtgtgggaagaatggagaaattcaggctgggtgcagtggctcacacttgtaatcccagcactttgggaagccaaggcaggcggatcacttgaggccaggagtttgagaccagcctggccaacatggtgaaaccctgtctctattaaaagtacaaaatggagctgggcattatggcaggcacctgtaatcccagctacctgagaggctgaggcaggagaataactggaatccgggagatgcatgttgcagtgagctgagattgcaccactacactccagcctgggtgacaaagcaagattctgtctcgaaac

SEQ ID NO: 238656 - DNA, 510 bp, Homo sapiens
cccccaaaattttagataaaagagttgagggaagattatttaaaaaaaaaatggacagatttttggatcatctcagttttatggatagcatattaaagtcacaggatatggtcatttaataccctgtaccagagacaacattggcttaattcatttcgtggttttctcaactggtacagaagatgctgctccatcaacttgttcttaggccctaactcctgtcttggtttgtcctggacttctgctcacattctccctcttctccagttttggtttcactagtgatatccattgcctcgtttctgatcaggtcaatctcctggaattgctttagccaggccagctcttagttgacctctgaagcagctctcctccaccccctatcgacataagtctgcatgtgcacagctgagtccaggaaacttaatcctattcatacattgaatagtaaattattgaatgtctataaagtgccaagtactgttctaggtacttgtgatatatcagtga

SEQ ID NO: 238657 - DNA, 438 bp, Homo sapiens
ggtgggggggtgatgaaggggaaggacatgaagggatcggtagtggtgagaagaccaacttcccaaatattagtaagtttccatttcttaagcatgtaagtgcccaaactgtgctaacggctttacgtagaattcctccacctaagcctcacgacacccctacaaaattgataaagatatgaatccatttcacaggaagtacgtttagaaactcgcccaaggtcaaacgacctgcaagcaacaaaacccctcagaggtggctggaacagcgggactacagagctcgtgaactcggccgaggaggaaccaggcgaagccggcggacgcgagtccaggccggccaccagaaagacgccccgagcccgggggccaggcccagagttgcggaggccgcccagcccgacctgattcaggctccgctcgcgcgcccgcggccgc

SEQ ID NO: 238658 - DNA, 465 bp, Homo sapiens
cacatgtctataatctcagctactcgggaggctgaggcaggagaatcgcttgaacccgggaggcagaggttgtggtgagccgagatcgtggcatcgcactccagcctggatgacaagagtgaaaatctgtctcaaaaaaaatgtaattaacttgctccctaagaattgcttctaaatatacctaggatactttttataagtatggggaaaggcaacattagtgccagggtcttactctacagaaaatgattcctcaaaacaaagcagagataaaaatagaaatatatgaccaaataccattcactgaagatgcgataagtgtatcagagaaaagactggtgttgtttaatgcattatattgttgctctgcttattagaatcatgttggtttcctaatggatgtaatattttgtgattattttgtggccctttcaataaaataagtcatgaatccctttgagacat

SEQ ID NO: 238659 - DNA, 577 bp, Homo sapiens
ggtttcaccatgttggccaggctggtcttgaactcctgacctcaggtgatccaccacctcagcctcccaaagtgctgggattacaggcttgaaccactgtacctggccaaaaaccagttttgatcctgtaagaacgtcggttctcatccttttctgactcagaatgagatgaaagctgtggggccccacctggaaaactgtatagtttgttataatttcagggagtacttaccaccctacccccagcttaaaaattataagttatccagtagcacataccctagatactaaagagtgtgttcaaagctattcattcaggctgcacctaagtcaccaacagagggtccaattcagaaaatgatggcacaactgtgtgatggagtacagttcagactactgtcttactggattttacagaaagtaggttattaggctaacagggtctcactcttgcccaggctggagtgcagtggcttcactgctcactgcaacctcgacctccccaggctcaggtgatcctcctacctcagcctttggagtagctaggactacaagtgcaagcaacaacacctggctt

SEQ ID NO: 238660 - DNA, 541 bp, Homo sapiens
tgcctcatttattgagaggttttaatatgaggtctattgaattttatcaaaagccattaccctgtctattgagataatgatgtgggttttgtctttagttctgtgtatgtgatgaatcacatttatttgtttgcatatgttgaaccaacctggcctcctgggatgaagcctactttatcgtggtggattagcttttttatgtgctgctggatttggtttgcaagtattttgttgagggtttttgcatcaatgtttatcagaatatttgcctgctcctttattattgtgtgtttgtgttaagaacacttaatgtaagatctaccctcttagcgaattttaagtataccatacaatattgctatttataggcaggtcttgctttctgaaagtcagttattatatctttgatgtcttttttctaattggggtgtttgtaccatttacatctattgtaattgttgatatggttgtattcttatctaccaactggctacttgtttcctcataatcctgtctgttctgttttcctttcttcttttct

SEQ ID NO: 238661 - DNA, 341 bp, Homo sapiens
gcagggctgggtgaagggtgatcttgcctggacagtgcagaactcaggggcctcctcttgactttgacttccactgatgaacatggtcagtgtggttcactggcatatccctggggtctagccaagctcttgctgcatccttgccaaataaacaaaagatgcttctgaggaggcacatgctgttatgagttttcctatcggctctgcttcttctaacacctcacactacccttttggaaatctgtctaagctcttggtcagattccctctgaatttcaccgagcatgttgacacacctctgtacctgtgattgtcttgcctgtaaatagttgtacttgcag

SEQ ID NO: 238662 - DNA, 604 bp, Homo sapiens
ggtgatctgcccgccttgtcctcccaaagtgctgggattacaagtgtgagccactgcacccaaccacaccttttctattaaagggccagatagtccctttgtgggacatgtagtctctgttgcatatactcaactccatctttgttgtgtgaaagcagccacaggggatacataaatgaataagttaggatgtgtttcagcgtttcatctatggatattacaatttgaattttgtataattctcatgaagtggcatgaaatagtcttgttttgactttttgccaaccattttaaaatgtaaaacccattcttagctcttgagccatataaaaacaggtggtggggcagatctggcccacaggctgtagcttgccaactcctgacttactggatttgaggtacagaatgagtgagactgaaaataacattttgagcctgagtcactgagaaagttaaattgtcatttaagaagagagggagcagtttgtagcacccctcccactaccgacccccatcaccatacactagtgggatcagaaccagtgctgaaggtacatgtttgagaagcatcaaatcatctgcatagaactgctggctgacacta

SEQ ID NO: 238663 - DNA, 417 bp, Homo sapiens
tgatttaaaacacgctctaatgcagttataatattaaggcatatatgtgtgtgtatggactcaggtctggccatctgtactcatctgtgaatataagtatagtcagtcatacctgagtccacatgcacaagaaaaaggcaaggaaaggaacagtccagggtgttctttgaaaactgcagtcatttggtaaatgattatggaataaattccaaaccttgagctcatgctaaggccctttgagatcagcaagtgctttccagaaggggcttttcagcagagtgacatccttgcagctttttcccagatttttttttcacttccttcaattccttcatctctcttcctagtgaacttctactggccctatgctattactataactttctgcttttgagccatggccccttgagatcttgg

SEQ ID NO: 238664 - DNA, 440 bp, Homo sapiens
caatatgtaaatttacaaagagaaataaaaagccatattcattagaatacatgcattgatgggttggcatattcttttccaaataggaaaattgtagattcaaagcaaaatacttggccggacccagtggctcacgcctgtaatcccagcactttgggaggccaaggtgggtggattacctgaggtcaggagttcaagaacagcctggccaatgtagtgaaaccccgtatctactaaaaatacaaaaattagccaggcataggtgggtggtatgtgcctatagtcccagctactcaggaggctgaggcaggagaatcactcaaacccgggaggcagaggttgcagtgagccaagatagtgccactgcactccagcctgggcgacagagcgagattctgtctggaagaaataaaaaagcaaaatactctctcaggaaactg

SEQ ID NO: 238665 - DNA, 177 bp, Homo sapiens
atctgaaaacagagatagccatactcagctcctaaaagtactaccccctcactgtaactaaatgattcaatgtatgtaaaatgccttatacataacaagtactagaaacgtttgttctgtgttctcttttccttctctttccttcccattcccatttctgattacagggaatttaca

SEQ ID NO: 238666 - DNA, 604 bp, Homo sapiens
gatactgtatctcaattattagacagtagcaaactgtcaaaatctaaaaagtaacatggaatatgtgagcccaaatggttggaaatgtattattcatttttataattgagaaaaatgtgttaacgctctggaatgtccatgtgtggaaaaataaaacgttatatggaattgcacacacatatgatttataatgcatgcttccaggaccagaaatcctaacgaagaaccttattcaacagaaaaaaacatttttttttcttcagtatgtgcaattctggtatactgtaatgctgaggccaagcatatattttattagtttaaatcctagctaagcaataaaatatgtgtcattttaaataaaagaaaacatgtttttcacaaaaaaaaaaaaaaaaaaactcgagttttttttttttttttttacttgtcaaactgtttatttgccattcacactgattgtaacactggatttacagaagaaactgtggtacaaagagaggaaggctctggtggctcctgaacagcagcagtccagctgccctgctcaggctgggcacgacgaatgctcccaggagaggggaggcggcccacccgactgtgtacc

SEQ ID NO: 238667 - DNA, 220 bp, Homo sapiens
tttaagcaatgaaaagtgtatgtgtatatacctatatattatatagcttatataatatatatttcatattatatattagatattatatatatgcatacataagatatatatacacacatctatacagatatttatttatttattttaaaatatgtaattttgtaatatgtattccttgtcaaattaaagcagccattattgtttgcaatcattttatctc

SEQ ID NO: 238668 - DNA, 1855 bp, Homo sapiens
atagtataattatagctcccaattgagaggaaagagtatttctcttactgtttgcatataaaatcctaggagataactccagttggtctaacttagccaattcttccaaataggccttaagctgcaagaaagccggacatttcctcaactaagaaactgcagcaacacggtgggacaaaaaatggataataacctcctagaaaggatcactgtggagatcagcataactgagacttctggagacagctgcaaacaaggaagggcaagagctatttattggccatgcagtggttgccagcacatccccaaagactggctctgtggaggactctggtgatcttcatgcctgaggcctccacagccctgtggcagccttgaactccttagttccctcctagtatttagtggaggcatatggaccccagtagcttgtgccatgaaagataccagcagctttcaccactgaggtagccaacagccaatgccaccttgtgtccttgggtgagggagatattgctgcactccctgactcccaagaaagagctgctcttgtaccaccctgggacaaggcaaccactcttgccaaccttgggcttaccctaaccgcaagtggtggttgctctagaccctggctcctatgcagcctccccatctccagcctcagacaccagagccaatccacagcaggcgcctccacaccccttgctgcaactctgcttctgcccaggctctagacactaaattcacggctgcccaacaagctcccatgcctcatacaccattaccaaagaggcagtgggaggccctgcaccatgaaaacaagggcctctgctgtctcagacccaggaggcctgaaactccgtgacaacctggttctagacatgggcttcctggccactccctgggcaccatgcatcaggcagtgtccctatcatataagcacacctgtgagctatacctggcaccaagagggattccttcttctaagacttcctctattggagaaaaacagatcaggacgacctcagcagtcttcaccacctaagaccccaacagctgtcctcaatgctgtggacataacagcattggccactgggaccctgcaatcttcagcatcactgccctcagctgatgtagctgcacctagactatgtagactatgcccaaatcagaacgggaaccacatcatcccacccagtgcacaaatagtcttaacacatttaagaaagttgaaatcatctagtatcttttccaaccacaatggtatgaaactagaaatcagcaggaggaaaactagaaagttcacaaatatagtcatgtgtagtataataacatttccatcagggactaactgcatatactactgtggtcccattagatagtaatctagctcaaaaagtcctgtttcctagtggcatggcagcagcctaatgactcagcacaacacattaccttttctttgtttagatacacaaatacttaccattgtgttacaattgcccatagtattcagtacagtaacaggttgtacaggtttgtagcctgggagcaataggctataccatatagcctgtttgtgtagtaggctttatcttctagggttgtgtaagtactctctattttgttagcacaaatgacaaagtcacctaacaatgcatttcgcaggatgtatccctgtcgttaagtgatgcagactgtttgtggaaatcaaacatcatacttctgaacatccaataggtcaaagaagaaatcaaaagagaaaatagaaaataagagaaatgaaaacaaaacacaacttaccaaaacttacgtgatgcagcaaaagcagtactaagaaggaaacacatagtgatat

SEQ ID NO: 238669 - DNA, 497 bp, Homo sapiens
actgagtctcgctctgtcgcccaggctggagtgcagtggcacgatctcggctcactgcaagctccgcctcccgggttcacagcattctcctgcctcatcctccctagtagctgggacaggtgcccgccaccacacccggctaatttgttttgtatttttagtagagacagggtttcaccatgttaggcaggatggtctcgaactcctgaccttgtgatccgcccgcctcggcctcccaaagtgctgggattacaggcttgagccaccgcgtccggcaggggccagagaattgtttattgtgagaggctgtcctgtgccttgtaggatgtctggaaacatccttggcctctacccaccaggtaccagtagcacccccacccaccaccaagttgtggtgatggaaaacgtctgcagatattgccagatgttccctggggagcaaaaccaaccccagttgaggaccactggcacaccccaaatcccttctgctatgttcc

SEQ ID NO: 238670 - DNA, 2035 bp, Homo sapiens
cattccaaatggtcaacattggctcaacactgagtgagaagaaaaggcagaagaaaaccaaagggcagaactgatagcttcaggtcagtctgagtgcagaatgaaagactcagctgtttttattatttccagcttgttgaccttgctatacattcacagaagtttgaacttttctagataatcagcaaaacaaagcaagatgagaagagagtttgaagggtttgtttaggctcctctttgtagacttagagcagcagtttcaaaattcagttccagcagcatcaggtcacctgggaacgtgttagaaatgcagattcttgtgccccattcaggcctactgaaccagaaactggagagtggggcccaggaatctgtgggctaatttttttttaatgttgtagttatatatataaaacatagcattttctattttaactgtagaattcagtgacattcacagtgttttacaaccataaccactatctgtttccaaaactttttcatcaccccaaacagaacctttgtaattattaagcaataattcctcactccctccaatccccagccccagataacctctaatctccttctgtctctatgaatttgtctattctagatgttatgtacaagtggaattatgtggcctttttagtctggtttattttgcctagcagaatgttttcaaggttcctacatgttttagtatatagcaatacttcgatactttttatggctgaataatattccattgtatggctataccatgttttgtttatccattcatctgttgatggatgcttgtgttgtttccaccctttggctattgggaataatgctgaaatgaacactggcatacaaatatcagcagtctgtcttttaacaagctctccaggtgactctgatgtacactgaagtttgagaagccctgaagtttccagagaccaagtgctgtttttaaacaggaactcagaacgctaggtggaggctgtgtgccctactgcagctttctgcatcccagccaggggtcaaggctgtagccacttacatcttatttctgctgccaagatcaacatttagagtttctcgaaggtcctaagactagacccaggagaaaaatgcctttctggattaagggttctctttgaccttgtttcaaggtgatgtttcaaaatatttcaaagggatggcagaaaaacatttattaaaaatacatagccattcagttgtttttgactagactgtctggactcagatgttttatgttactccatgattaccttgatattagatataagaatgactcattctacttttatgtagagaaatcaggtctgttttctgagaattatagaagtagtaagtgagaggaaaaggagaaagaaaaaattgtttgttataagttcacagatacttggcttatgtttgattatgattgtataagaatttccaggttcaaagaccttcttaactaattccttcatgttcagaaaggttaaataattttattgcagttttacagctaggaaatgacaaagtcaggattagaatccaggtctaagtccaaagttgctgaataaatcaatttatactggcttctagaagcttaaaacagtatgcctttcagagatatttgggtttttaacaggggactcctggatatatcatattttaacctgaagaaatctgccttcaaaggtagaatatacctaaggcagaggaaggggaggccttttcaacaatcacaaaatgatccatgtaatctgcaagctcagctctagcaatctctgaggtgcaggttcagaagtatgttgtgtttcatcttgtgtcacatgttaagaatgaaatggaagtgtaaggcagagcagcctggcccatgatggtctggatgttatgatgccttaagtacagtaggagtaaggcaggcgcagtggctcacgcctaaaatcccagcactttgggaggctgaggcgggaggatcacttgaggccaagaattagagaccagtctgggcaatatagcgagatcccatctctac

SEQ ID NO: 238671 - DNA, 388 bp, Homo sapiens
ggaggattgcttgagtccaggagatagaggacgcagtgggcagtgatcatgccgctgtactccagcctgggtgacaaactgagaccctgtctcaaaaaaagaagaagaaataactatatgccagtgtaactgccattagagagccaattgatgatgccctaggagaaaccaaggaagactttcaggaggcttgagtctgagaggcattgggatctacttcttaagtataggaaggtactagtggcacgtgtgctgaaggcagatagatgtggtatgggagcttctgatttttatataaggaatcctctaaaatgctttgaagaaattttaaaaagtttagcatatagaaagacttaccatgttcttgcaaaatagatttaaacattgt

SEQ ID NO: 238672 - DNA, 480 bp, Homo sapiens
tgcgcggccgcgacttcggggacctgctcatctactcgggcgcgctgctggtgttcctgagcctgctgggctggatcctctggtacaccggcaacatcgagatctcgcgccaggagctggagcgcgactacggcctgcggccctcggcgctcgcccgcctggcgcgcaagctctcccgccgctggtcggcgcccgccgccgcgggccagcgccccgcgcccggctcccggagagcgcgccgagccgcccgcgcgcccccgccgcccgccgccggctcccgccgcgtgcgcctgcagctcgccacgctcgaggccgggcccggggcggcgggcgcgggcagcgagtgaggcccagacaaccccttggctccagctgtcaggaccagactgagatgtgcagctgcccctacatccgtggccagacggacgctccctgtaccccctccctcctcacttggataaaaagcagatttgccttagt

SEQ ID NO: 238673 - DNA, 388 bp, Homo sapiens
tgcgcggccgcgacttcggggacctgctcatctactcgggcgcgctgctggtgttcctgagcctgctgggctggatcctctggtacaccggcaacatcgagatctcgcgccaggagctggagcgcgactacggcctgcggccctcggcgctcgcccgcctggcgcgcaagctctcccgccgctggtcgccgcgtgcgcctgcagctcgccacgctcgaggccgggcccggggcggcgggcgcgggcagcgagtgaggcccagacaaccccttggctccagctgtcaggaccagactgagatgtgcagctgcccctacatccgtggccagacggacgctccctgtaccccctccctcctcacttggataaaaagcagatttgccttagt

SEQ ID NO: 238674 - DNA, 340 bp, Homo sapiens
tgcgcggccgcgacttcggggacctgctcatctactcgggcgcgctgctggtgttcctgagcctgctgggctggatcctctggtacaccggcaacatcgagatctcgcgccaggagctggagcgcgactacggcctgcggccctcggcgctcgcccgcctggcgcgcaagctctcccgccgctggtccgggcgcgggcagcgagtgaggcccagacaaccccttggctccagctgtcaggaccagactgagatgtgcagctgcccctacatccgtggccagacggacgctccctgtaccccctccctcctcacttggataaaaagcagatttgccttagt

SEQ ID NO: 238675 - DNA, 457 bp, Homo sapiens
tggtaacatatcatgcagcaatgttattctaatacattaaacagcagtatttggaacaaaatatccagtcagtttcagtaactattgtaccgaaatttttttaaatgcaattcagccttacaagtgcaaccaccataaaatcaaagactgtaagttcctaatgatgaaaccgtgtattgtggccatcatcgtacttagcgtagtaccgagtacacagcaaaggctcagtaaatacttgttgatcggttggttggctgcttggttggtgaatttgctgatagatggcattgaggcaagatagatagtgcactactagtaagttaaaagaagagagactctatttgctaagtgtttccacacgtgtcctaagatctgccttaggcagaaaacttttccaaatggtaagtttatttatccagcaaacattatcagtcccctacagtgctagactctcata

SEQ ID NO: 238676 - DNA, 270 bp, Homo sapiens
attgcaccactgcactccagcgacagagggcgacagagggcaacagagagagactgtctcaaaaaaataaatatataaactaaaataaaatattgaagatgatgaggttgttcagtgtggagaaaaaagcattttatcttctttctgtttcctcatgctggaaagaacagtatcttgggacccagtagcaatgagtttggatcccaggtgagccacttttggcagtatgacttcagaaaagctctttaacatctctgagttttcttttct

SEQ ID NO: 238677 - DNA, 567 bp, Homo sapiens
tctaatttgatttcaaaagaatattagtttaggtagatatacatacacgttaaaagttcctgaattccaggcataaactgtagtatttttattgttgagctcttttttttttaaattaaattgggttatgagagaaggtaaagaggtaaactttaggctgtgctattctcagtaacataattaaatgtaggtttttgattcttgatctattaactaataattttgtagttatttgtgcttatgaggtgtttgtgttggaatatagggagcgcgtgattggttaacctgatcatctgccagtaacatcatgtctttttcacagtatttttaactagtgagcttttgctctcgcttatgacacagggtaaaataaatatccatgatatatattttctagaatgattaatgtatgtaattcttctaaacagatcactgtttctaagtgtgaatcaatatttcccaagcttaaaatatttgcatttcttcacagcaaaacagttatgttgttaaaccacttgttttacttttctctcaaccatcatcttattttctttcctcccctcctgt

SEQ ID NO: 238678 - DNA, 621 bp, Homo sapiens
ataaaacagaaacataagtttcatgaaaccacactcacacaaaccaagtgcaatgcattctgatatgttctgttctcttcccttctatcacattctatttatacatagtctccaatttatattatatattttaatttatgttacatatgtttacattatatattttatatattcttctagcatatatataacagttttaaagttttgccaaaggtcaggatccagaaaccttcagtgtgaaaaacaatgccccaagaggaagaggtgacttagctttcatctctcaccatggattaaaagcctctgttcctaaactatcgaaagaacaaaaaaccaaacaccgcatattctcactcataggtgggaattgaacaatgagaacaacacatggacacaggaaggggaacatcacactctggggactgttgtggggtcgggggacggggggagggatagcactgggagatatacctaatgctagatgacgagttagtgggtgcagcgcaccagcatggcacatttatacatatgtaactaacctgcacattgtgcacatgtaccctaaaacttaaagtataataataataattttttttaaaaaactaactttttaaacattaa

SEQ ID NO: 238679 - DNA, 2029 bp, Homo sapiens
  misc_feature (1211)..(1211): n is a, c, g, or t
  misc_feature (1512)..(1512): n is a, c, g, or t
cgcgtccagatcccccatcccacaggcctgcataggcagcagcggtccatctgtttaacagaaatgtgctgagcactcccatacaccaggcgctggtgtgtgggcagagccccagcagggcacagaacagatgaaaatccgcccatctggatcttgacagagccgaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataacgggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtganaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttnagcaagtcaatgaacctctgcatcagtttccttatgtgtgaagttagagtgcttggctgtgctacctgattcctgagattggtgaaagagggcttggtttaccaaggctctccatcaagtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtctcaaaaaaataaaaaataaaaaataaatttcatataatcttcagatatattcattcatttacatattgtctgtggttgttttcaccctttaggtcagaagtagccgacaacctttacacagtatttaccactgttatagacatctttaaatatggtttacttttgcctgtttttgtactttatagaaatgaagtaataaagtattgtctgtcttgca

SEQ ID NO: 238680 - DNA, 2313 bp, Homo sapiens
  misc_feature (1211)..(1211): n is a, c, g, or t
  misc_feature (1512)..(1512): n is a, c, g, or t
  misc_feature (2051)..(2051): n is a, c, g, or t
cgcgtccagatcccccatcccacaggcctgcataggcagcagcggtccatctgtttaacagaaatgtgctgagcactcccatacaccaggcgctggtgtgtgggcagagccccagcagggcacagaacagatgaaaatccgcccatctggatcttgacagagccgaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataacgggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtganaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttnagcaagtcaatgaacctctgcatcagtttccttatgtgtgaagttagagtgcttggctgtgctacctgattcctgagattggtgaaagagggcttggtttaccaaggctctccatcaagtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccncctctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctc

SEQ ID NO: 238681 - DNA, 1874 bp, Homo sapiens
tgagacggagtcttgctctgtcgcccaggctggagtgcagtggtgcgatctcagctcactgcaagctccgcctcccaggttcacaccattctcctgcctcagcttcccgagtagctgggactacaggcacccaccaccacgcccggctaatttttttgtgtttttattagagatggggttttaccatgttagccaggatggtctcaatctcctgaccttgtgattcgcccaccttggcctcctaaagtgctgggattacaggcgtgagccaccgtgcccggccgggtgtatcatttttaaacagagctgacaacaacagtaccttccttctagttatgctgttgagaatgaatgtcgcatgtacaaagcacttcgcaacatgcctcacatatagtaagtactcaataaatggcacttatgacatttatcaacatcaaatttttgtgaattaccaattttaaaaagcataaggttcaaaatatcatatagagcatgattattttatatgatgtatcctagtatttgaatagtcatctttgggtgacgggttgtagtgaatttcattctttgattcttacctgtattttctaatatttctttaatgaatgtgatttgcttgtgtagtcagcattttaattagtgggatatgggggatcagtgagcaatttgtcgtaggaacaggagtcaaagcaggggagaaagctttagttctgttttctcaatttctaagtcattcatccaccttaaatcaaatttaaatagacttagtttttttctctgttttgctcaatcttggcctgaacaataatgcctataaaaactggaaatttgtcaagtgatttatacttacgttttttctctgagacagggtctcactctgttgcccatgctggagtgcagtgatatgatcatagttcactgtagccttggattcctgggctcaagcaatcttcctgcttcagcctcttatgtagctgtgactacaggcacatgccaccacacctggcaagtttttatttttattttttttttttagagacggggttcttgctatgttgcccaggctggtcttgaactgctggccttaagcgatcctcctgccttgacctcccaaagtgctgggattacaggtgtgagccatcatggctggcctgatgtatacattccctggaccctcacatcccctgagttttctcacttgtaaaatgaagcctgagattcgatggagattctaagaaaaccactgaagcccaccacaaaagcagggagaggttgagcaggtgagcctggatctgagatcatccccaccttgccacccacatcagagcagctccatgttttccacttgcttcattacatttttgtgtaagctttgaataaggggttcccaggctttaaaacatgacttgaaatcattagtttacactttaaatcatctctaaaagtggatttatgagtgatggattttgtcctattttttcatttaatttttactaatattctgtatagcatactttaggaaactctacactagacaaatgtattttccataaaaaccagaatattaggcatgtcaaaaaatgtatacaagcaattctgatgatccatattatttcagatatgatgatgatatttttaaaaaattaccaaagaataataagaagggaagtttcccaatggtaagaaggggtgtttaatgtaagtttcacctctttctctctccctcattctctccctagtgggtcaagggagagggaggggttaaagatgacttcctccaagattgttccagatctattgaggcctgctctgtctaaatagtgcttccaggaacagcagggtctcaattatctcaccgtgggctgtgaaattgt

SEQ ID NO: 238682 - DNA, 759 bp, Homo sapiens
agcgggagaagcagagttttgaggcagagctgatcaagggaacctcaacaaacaaccccagccatggaggcggcggtgtctttgaagaccccatgagagcatcaaacaagggagagagcctggaacaaatcatcgtagtaaaatggcggcagagagctagtaatgtgtctggaattggtgggttcttggtcgcactgacttcaagaatgaagccgcggaccctcacggtggtgtctttggtggctgttcacccttccacagtaaacatgcttgggaagcaactttgccaaaagccttcggacagtccagcgtcaacaccgcaagccaagtggaggagaaaaatctgcgcctctttctctcaagggatactttgtctctggggtactttctgacccagtggacccctggcagaagtaagcgtggactgtggctgcaggaccacgcagagtcaacacgaaccgaagccaggccttggccacggcagctctggggtccaaccacttgatcaatgcaggaaatgctttgatggcagaattcttccatggccagcttctcatattctctgggacagacacaaaccaagaaaaatgagtgtggcgcagaatctgatgtgtccttccttaccccgtgctggtagcaaaaagtatgtcttgaacttttctttgttacacacagtctgggtaataacagactgaaggaaaactaaagaagcttgggaggctaagttcaatgacaaatgaagaactaaggcagagaaaa

SEQ ID NO: 238683 - DNA, 584 bp, Homo sapiens
cctccagtgaaccatgtcttctggtatttacatcttgtgtggtcccctccattaaatttgggctttaaccaacagaatgctgcagaagcgacaccctgccacttgtgcttttgtgatcctagccaccagtaagaagccctgtgaccttgctgagaccctgaagagaccacatagagaggccacttgaagggcaaggggtcctgactctacatggagagagaagcccagccatccctgtttcccagctgagtcctgaccagataactcactacaagactgaccacaggcaagaacagcagaagagctgcccagctgagcccatccaagagtgcagaatttcaagcaagtaaaatgactaatgttgtaagccactaaaattctagggtggttcttacatagcaatatgtaactgtgataaactaaataaatgaataaaagggaatgaagaattacttcacagaataagtttcatgcaaagacatctcaatgtctctaagaaacacttctaaggaagagcagagtcaagaaaatagcaacagaactaacaggaaatagaggaactcataccaccagcttccatttac

SEQ ID NO: 238684 - DNA, 1528 bp, Homo sapiens
  misc_feature (378)..(378): n is a, c, g, or t
agcgggagaagcagagttttgaggcagagctgatcaagggaacctcaacaaacaaccccagccatggaggcggcggtgtctttgaagaccccatgagagcatcaaacaagggagagagcctggaacaaatcatcgtagtaaaatggcggcagagagctagtaatgtgtctggaattggtgggttcttggtcgcactgacttcaagaatgaagccgcggaccctcacggtatgacagctcctctcccaacagctctactttctacatctactctctaccaccgcaaaacttctttcagttccatgaaagggccatgtttttctggtctcttggcctaggagcatgttgttcttctgccagcaaccttcttcaaccatcnccacaggatgactcctctattggatacttccatgaaaagtccaggcctgggttatgtacccttcccaaagtgcaccccagacacccaacagtttttccagcccagactcaccacactgtgtggtaatttcctgatcactcagttgtgctccccacagactataagctctatgagggcaggggccacagtttgcttgttcactactatatgctcagtacctggtaaatattagttgactgaagaatgactatgtggtaatctattccattggtggcctccagtgaaccatgtcttctggtatttacatcttgtgtggtcccctccattaaatttgggctttaaccaacagaatgctgcagaagcgacaccctgccacttgtgcttttgtgatcctagccaccagtaagaagccctgtgaccttgctgagaccctgaagagaccacatagagaggccacttgaagggcaaggggtcctgactctacatggagagagaagcccagccatccctgtttcccagctgagtcctgaccagataactcactacaagactgaccacaggcaagaacagcagaagagctgcccagctgagcccatccaagagtgcagaatttcaagcaagtaaaatgactaatgttagaactcagaatgaaggggcctcaggttacctgcatcattctggttttttgctcctgttttactacgaagcaaacacctcgactataagccgccatagaccagggtctgtgtctcattcgtgtctggacaatgcatcacagacactcaactgttttctgcctgagcagaattaagacttggcctcctaactcctccatcaccatcttctccactctcttccttggccttcatcaccaacaccacctcatcaaccgtgaaagattcaaagagtaaggaaaaccatttctaggaccatgaaatgtgtcactggatctcctgcagaaatctgccagagctacaatgtgactggtttctacatgtctgacaaatttctatttaaataagtatttttcaaaatgcaaattgctacctattctttggccatcaaatcactttagtgggttgcaaccggctttttcttcttaatagaaaaggaaatgtgttgcatttggtaaacatggaaattgttttat

SEQ ID NO: 238685 - DNA, 229 bp, Homo sapiens
gttttcccttgagccttgagcatgaaaagtgtgctgctggactgtgatcttacatacattctctctttatttcttacccattctgcctgaagagctggcaacaatttgaaatccatcatcccggctgtgttttgtggattaaactacttattctcatatgttctacccatttccttgtcaggagtgaattctgtgtattacaaataattgatgatgttgggcacatctc

SEQ ID NO: 238686 - DNA, 467 bp, Homo sapiens
cctttcaatcttttccttgcttctggcatgagttaccatctcttttaagaaattggttatgcatttgaaaatacacgtagctatacatactttaaacatatcatttagcaaggatgctccttatcggaccgttgctgggaacagagaacacgacagttccagactgtttccaagattggatgaagagattcaattgacaatgctgtgaagagagggatttggagcttgttgggggaggtagtgttgacttccttgtgcaatctaggattgagtgggggatgcagttggaaggcaagagaagtaagactcctccatcttcctggtccagagaaattatgctggatccccctacccttaatgagaaaggaggtgtttgtgtttccagcatctatgagatctgattgctaatgtagctacctttaaagaattctgctatttacaataaaagtgagatctccctcctccaa

SEQ ID NO: 238687 - DNA, 418 bp, Homo sapiens
tctcttccctggaggctcccccatcctcgtggcctctgcgcggtccagctcccctccgagctggctcaaggggtaacttgatccaggtcagctggtggagtatgaggtagcgtctagctgagcgtcacggtattttattaagtccgaaatgtgatcgctactgttgtcacactttagcgcccccaacaatccccttacaaatgagaaaaacagagcctccccaaatgcctttcctctgacatcaaggaaagcgcatggaaccctgcccagaggcctgagcccgggtgaccccaggagtggctccagagcttgaggaaaggcctggggggcggagggggtgtttttccagtttcaggcaaagcagtgagctgggggctatctgctgtttcctctgcgcctgggtctgtaaagtcagcgg

SEQ ID NO: 238688 - DNA, 364 bp, Homo sapiens
caaaaaaaaaaaaagaaagaaaaaaaaagaaaaaaaaaaccctataatactagctcactgtatggcctatagcatttacttaatgagtatatttattaatattattttacaaataaatatttataaagaaatgattcgccttccctttgaagggatcttaacactcttaacacatttgaagtctgcacagctagtacttaactcttagcactgtttgctcttcatttttcattatcagcctcatctccctggttagaatagatgagattataaggtttttgatgacaatgtcatactgatgcgacctccacagtaaatctggcacagtggttaaagtaaacacttaataaatatttaattagca

SEQ ID NO: 238689 - DNA, 462 bp, Homo sapiens
atactatatatttataccctatatatgaatttatgcatatataaaatatataaatgtatttacatatatacataaatatatagtattatattgatatataaatatatttatatacttaaatatatatttttgcatactatatatttatactatatatttaattatactgtattataacttttgagaagatcagtattttcattttttaaaatagtcacataattgttcttgaattcttttctgccatttccctacttctcctaaaatatcacacaaaatctggactgtataagatacatagaaatatattttaatattataaaatcaatacattaaaaattttagtgatcaggtgcagagtggctctttcctgtaatcccaatactttgggaggccaaagccggagggtctcttgaggccagaagacaagtctgggcaacacagcaaaaccctgtctctaca

SEQ ID NO: 238690 - DNA, 357 bp, Homo sapiens
ctgagtacaggtgagcacctgagcctggatctggctgccctcagctgcatgggcttaacagccggtgctgtcaatagatgtggccagattatctcaactttagacatgtgaaaatataaacaagagctgcttcgagttttccaagtgtgttcctctgtggggggacatgtattcctgtgctgattgaatgaggaatatcactctgtaaatttttttttttttgagatggagtctcgctctgtcgcccaggctggagtgcagtagcacaatctcggctcactgcaagctccgcctcccgaattcacaccattcttccacctcagccgccaccacacctggctaatttttgttttttag

SEQ ID NO: 238691 - DNA, 163 bp, Homo sapiens
cctccgcctcgctccgcaccaggtctgaagcccagtctgaggccgtcgcagctcggcggcaacagaaccacggctgggatggggctcctgcccctccgacctgcaggtcactgtttgtgagaggtggacaccttaattttctttagttgatcagaatggaaca

SEQ ID NO: 238692 - DNA, 439 bp, Homo sapiens
atatgacagcaattccactcttagatctacctaagggaacagaaacaccttcagaaagactcacatatattctagagaaacaccttcagaaggactcacgtgtattctagagaaacaccttcagaaagactcacatatattctagagaaacaccttcagaaagactcacgtgtattctagagaaacaccctcagaaggactcacgtgtattctagagaaacaccttcagaaggactcacatatattctagagaaacaccttcagaaggactcgtgtattctagagaaacaccttcagaaggattcacgtgtattctagagaaacaccttcagaaggcctcgtgcgtatttgtgttatagtttagtgctagtgccactgaactgtatccctacatatggctaaaatgacgtgttttctgtattttacaagaaaaataatt

SEQ ID NO: 238693 - DNA, 224 bp, Homo sapiens
agtttatatgaagaggcaaaagccccataatagcctacacaatattgaaggagaaaaacaaagaggactcacaccatccaacttcaagacttactgtaaagctacagcaatcaagccagtgtggtgttggtgaaagaaagacaaaccagattaatgaactagattagagagcccagaaatagactcacataaatatagtcaagtgaccttttgtcaaaggagca

SEQ ID NO: 238694 - DNA, 278 bp, Homo sapiens
agccctttgcatcaccccagcccttccctgccctgccctgtcctggcccaggcaaccgcctcttgcctagttgcccacagcagccttcactcaggccttcctgcctccagcctggtccccacaacgtgcctcccccgatggccatggtaatactggaataaggtccttgtgataggccccacatgcctgaactctcccccccccatcccccttgtatttgtctgttttcacattgctataaagaactacctgagactgggtagtttatgaaaaaaaga

SEQ ID NO: 238695 - DNA, 509 bp, Homo sapiens
cagagaggaggaatgtgtgtgaaaggaggtgcccagagggctctttggggacccttcgtgagtccttggctaagagtgaggcttcacatgcacagggtgaggcatatgaagtttgccagagagaagctgctgcagcattgagatcagaacagaaatggtagaagtcgaacggtactgggagatgttgaaagtccatcccagccagagtggcaagacctcatgagcatgtcctaacattccagacatgtagctgagacccccaggggctttgttttaggagtaagaagcacacggtagagaaaaatttactctggatggtccctgaagaacactaaggccaagcctagaaagatcaatagggaagacaagagtttagaggctgaacccttccagattagagcctcttgagaaacaccttggattttccacagcataccctggcaacaacagcaaactcctacataagctcaaagtgatcagctcatagttgaacttcctgctagaaagtt

SEQ ID NO: 238696 - DNA, 441 bp, Homo sapiens
tacacagctgaaaaatcgtgtatttctaaaacacttgtaatcatgtttcactcattttttatttttgcttgtgctattgtttctttggaaaaggctgaatcataaattcaaagttctatttttcagtaatttgtttaaccatgtatatattggctttttaagattcttgagtttattaaagataaaatgaaggtaaacaaataatattaaatgtcagtcagttttgatctgcctgcttgtaagagaggaaactagttttgactggaatgtctagcagttttgtaatttttaattaaatatcgtcaatgatttgcaaggagaataaaacacaatgaactaagtatttcatttgtgaggtgatagcaggtctttctgtttttcaattcctccacgattatgattatgaaataaatgattaaagattgtcaaatttacaaacgt

SEQ ID NO: 238697 - DNA, 441 bp, Homo sapiens
caataggaatatggtattagtttatataatattttatcttgttcatggctaagatatatttgtttataagctttagcagacttatctgggtggatcatcatgagttttatgtttatggtgccttccagaagagtaagaatagaatgtataaatattaaaatagaaaaaaatggatttagctaatgtaaagtaataacagaaaaagaagtgcaataaaagtattataaaatgaaacataaaaaagatggcaccaataaggtctaatttaatagtaattaaactaagtgtatataggttaaacttactattcaaagacaaagattcagattaatctgtgaaaacaaaccaagatctagaaatacatttcctaaaaataagaaaagagagaaaactttaaaacaataagtttgaatatgaaaaaaatataaaggcaagtaagaa

SEQ ID NO: 238698 - DNA, 228 bp, Homo sapiens
tgaggtcaagattatctcacttgacagcttcttgcctgcagagagatcacagccaggaagtgtgagcctctgggttgagacctgcacaatctcgggtagtttttgtataaagaacaggtttttcttttcttccccccccaccccatcatgaaaagaggctttgcagagtaaggcagaggaggctgctgacatctcatccagaataatcagtagagcaaaatactctta

SEQ ID NO: 238699 - DNA, 521 bp, Homo sapiens
agttcggccacttaacggttatatgacctaaacacagtttcttgcctctctgtgcatgactcttcagctgtacagtgaggataatagggcctaaatcctagggttttggtaaaattaaagcagttaatgcaaataaaggagccataaaaatgcccagcacatagctagtgtacaggaagtttattagctcttatttgttgattctgttagatcatgacaaatgttaagcctgaaaacaagatggccataccactggcttgtaacccatgttcattctaattcttccatctggggctataatagtagttgaatgtttctaacactatccttggcaaattcccatatattcacatacagcatggatataaatattatgaaaaaatgtctcattgagaattgctgtctagtacactagtaacactagacatacaaccacttaaatgctgagtgtcagttttataattagagaatgaagcaaattgtttcattacttgtttaataaacttgtgatttatgtttat

SEQ ID NO: 238700 - DNA, 666 bp, Homo sapiens
gtggcttaagcctgtaatcccagtgctttgggaggctgaagtgggaggatttcttgaggccaggagtttgatacaagcctgggcaacatagcaagacccctgtctctacaaaaaatttcaaaaattagctgggcatggtggcacacacctgtaatcctagctacttgggaggctgatgtgggtggattgcttgagcccagatgtttgaggctacagtgagctatggtggcaccactgcattcaagcccgggagacagagggagaggccatctctaaaaaagtaatgccttctcttgatccactgagaaagggttctactgaggttagaggctgaagaatgctgattcaggaccataccctaccttgtttcccaccagtcttcaagaaaagcttgcctatgcttggctgggatacacaaagagacataaaattaatactctgtagctgcatttcccactttctatgatattagaccatcttaggtctaattcagtgctcttcctatttatcaacacgtgacttagagctgatcttcctctaagattttaggggagacttctttctccttgttctcctaacatctgatctcaagaaagaaaggtacaattatgtttgtaaaacatagctaagagtttgtatcaaataatctgtacattttaacttgtt

SEQ ID NO: 238701 - DNA, 364 bp, Homo sapiens
acagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccaggcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaag

SEQ ID NO: 238702 - DNA, 579 bp, Homo sapiens
aaaagtgcttcaacccaaaacttatttccatggcttacacaggcctatcaacctgaatccagtccacgttttcaggttgatctctagtcatttccaaggtatggggtcttgctattacccaggctggtctcgaactcctgggctcaactaatcctcccacctcagcctcctaagcagctgggaccacaggtgcacaccaccatgcctgctcctctgtgaagtctttcttgaaaccatcatgcaaattctattgttctttcatctatctaagagcacccgtattttctttagtatttatcatatgacatttgaataattttctatctatctatgtatcaattatctgtctcctctaccaggtgaaacttcctatcaagaaaaccatgtctaagttctttttgaaatacccagtactcacccagggttcaacagtgtatcattctgaaagtatctgttgaagccaggtgtggtggctcacacctgtaatcccagcactttgggagggtgaggcgggtggctcgcttgaagtcaggaattcaagcccagcctggccaacatggtgaaaccctgtttctacta

SEQ ID NO: 238703 - DNA, 488 bp, Homo sapiens
agcaaacaaatagcaagatgttagatttaaacctaacctgatatatcaataatcacattagatgtaaatggtctaaacactccgattaaaaggcagagattgtcaaagtggattaaaaagcaagccccaactatacgctgtctataaaaaatacactttaaggtaaaaagatgcaaatagattaaaagcacaaggacagaaaaagatataccatgccaatactaatcaaatgaaagctggaatggctatttcaatcaaaatagatttcagagcaaagaatattatgaaatgattttatttatccctagtaatgataaaggaattaattcattaaagggatgtaacaatcctaaacatttatgtacctaataagagtttcaaaatacataaagcaaaaagttacagaactataaaggaaatagacaagtatccaaaattacagttggagacgtcaacatacctcttaataactgacagatcaaatagac

SEQ ID NO: 238704 - DNA, 307 bp, Homo sapiens
taagctgggtggataggggaagagaacactacagaaaatccagattcatgtttaaaagtatgggagagttcagggagagcagacatttatttagtagaactggtattttcctttgtttgccacacattcttttttaagtatcttattacaaagacaagtaatgagaatcatcagaggtctctattacttcattattccccttttcttacatttacagaagtattttgggagaccaaggcaggcagatagcttgagcccaggagtttgagaccagcctgggcaacgtggcaaaaccccacatctctac

SEQ ID NO: 238705 - DNA, 498 bp, Homo sapiens
cgtcgacctctgtctctgccttccccgaaccgggacccggccagccagaatcacaggcattcccacctctggcgccggaggggaccgactgacccgcgcagacggggtcgcgccgccgcccggccctcggcccccagccagcctgccccggcccacccggccccgccggccagacacggcgacctatacggaccgcccccacgccgaccctccaaaggcccccggccttgggtttcccgtgccggggcccccgggcagtcctggcggcgtcagggccgcgaccggaccgtgggccccgcccgcccgaccgcagatgcagagccggcctccgggctcggggccgggctgacacggccgagaaagggcccagccccgcgcggaccacagactggcaggccggccagacagacggacaggctgaccccggcccgggggagcaggcgcagcggctgcgcaggtcccgccaccgccttctggccccaggcggcccctcagggc

SEQ ID NO: 238706 - DNA, 432 bp, Homo sapiens
cagaataatatttttaaaatttttagtttctaagcttatctgaaattttaattttcttttcttatgtaataccagagttattaggaaggtattatctaataacactattttcagtgatattttaagtagttgtcctagaaaaatttctattttttaaaaatgtatatttaaaaatacattaaatgtgtatatacatcaatcatatgtatcgatttctgtttttcttgaattgcaaatgaaatttgtatttttgtgttcctggaataaaataaactcgaatgggtcgtaatatattattcatgctgtaattcaacgtatttgaatactttaagaatgttacatttatagttaacagatactgacctataaattttctgtcatataatgatgctgtgagacaatctgagaagaattaaaatttaaattcatgta

SEQ ID NO: 238707 - DNA, 1343 bp, Homo sapiens
cctaggagatcatctgtctcatactctgttccctgagctgaggctggcagtagtagtgaggtggagtggcatgggttgagggactaaacctaagttcccactctagctctgtcacttcctggccaggtgactctggatgtatcacatcatccttcagagcctatttcttagattgtaaaatggaagtaaaacaaaaaatgagattcattcagtgttcgttcaacaaatagttttgactatctgggctatgtgccagtcactgttctaggcatttggactacatcaaaggaaaaactatataattccatgctcctttggcacttttactcaagtgacgaagatgatgacgataacactcatctcaagagctgtaccaagtgtgtgagatacaaacgtgagggcactttatagaccacagtaaatgatgggtttcattactcttgtactcaaacaggtgaagtgacttgcccttgggaatgggccggccctggctaaggattcttcccaccccactacccctcgggtattcattctgtgaggacccctgttataatgtccttgcaagcagctcatagcagctgcaggttctctgagggctgggagaggctgaggcgaggggggggtccccttctgtaacctctggccccctcctcccctgccttctcctcctgctcgtttattttccggagccatctccctgcctctgcctggctccactctacagggggcattccctcccctgttgctgaagaatggccacagggcaaggtgtcacttcttacccttcacacacactctgcccagtacacgattttgttctgtttttagtctttgcatttgtttgaggacagaaactaccagctgggaagtaagatggtagcaacacctaagcctgagtccgcccacacctgtcaccaagttcctctaactgtcacctggacacctgtgctttccctatgccctcacccgatgcctccctttgctctgtgtgcctgcctccccatcaacagaaagtccatggacacctgtgctttccctatgccctcacccgatgccctccctttgctctgtgtgcctgcctccccctcaacagaaagtccatggttcatctttatcttggcacttaggcgcttaggtcagctcagagcctcattgctcgcctgggttgttatacccaccactccaccctactgcgttcttttgcctccaaatcctcccttccttctgcaactacaggaacctttgtacttcaaccttacttcacgtcaccacatgtaactattccagttagtcctgtgtgttagtccattttgtgttgctataaaggaatatctcaccgggaa

SEQ ID NO: 238708 - DNA, 356 bp, Homo sapiens
tcgttacctaatccccttagtctttttcagaccttcgcaaagcgcactgccccttcttaggccttatacacaaaaggagcttcgacgggaacgccctcgacttcccactgccaaacctatactcttacccgcagctgcttcaccttcttggcaggaaaagtgtcggttgtttctctggcttcacgctgatccctcgcttgagctcccctcccgcccctgcctccgtctgagtctcacattgttctcggtattggggcatcatccccttccgcattcccacctgcctctagatcccattcatcctcccggcccaactaacgaatgaacgaacgaatgaaaatgtatggagtacctat

SEQ ID NO: 238709 - DNA, 448 bp, Homo sapiens
agctgggccaatatgtggaaaatacctaaatttaagtgttattacaaaaatgaagcaataatgagattctggctaaaggggccactaaataagaataatatatatttaaaggattgtgtaaaaaagtagttctaggtgcactgtaagcatatagggttttttcccatgtgtatttttaaagaatggaaaggtcaaaaaatagggtcacctgtgttagactaatttaccttattgtatatgctgcatgagatggaactttgcattatagttatcatagagaagcatagtttgcctcatattatggcaatttatcttcaatcaaaaccttccagagtcatttcattttggaatgtcctgtaaacattcaaactgccagaatatgactgtaaaacagcgaagtgttctcttgcattaaattgaagatatctgtttaattttttaaaaagga

SEQ ID NO: 238710 - DNA, 361 bp, Homo sapiens
ctatcggattttttgttttctctctcattgtaagtgcatattaaatatttcctattgtataaacttcttaattatttctcttcagaactcttgttaggtttccatcagatttgcacctggtgacactttattctcttcaggttattactagcccagctgcagttagtggatctttgtttgtttcaattagcctttccaaggcccaggacattcttatttgtgtaccccaagcattttatgagaacataagtgtccaaatgttagctcttcaattagaatttccaccttcaaattgctgtaaaaaataagtactttgtaccccttgacaatgataaatacactatgcttttatgttgtgaca

SEQ ID NO: 238711 - DNA, 416 bp, Homo sapiens
aattgaccatcttaaccatttaagtgtacagttcagtggtaattacactcacgttgttgtacaacccatctttagaacttccaacaggaatacttttgtccagtgatatttacaaacatctctgatatctccttggggtagcaggttcccagcagtggaattattgaactaaatggcctgcatttataaagagtcttgatacatagtgcccacttcctttccagaaaggctgtattgatttcatattccccccagcattctttgagtggctgctttttgaaattcacatcttctgggaacagcttaaatggatggtgctttgtgcggcctaactgtggactactgacaattttaagaggctgagacgtcattctgtagctgccttctttagaacttcccttctgtctgcacttctc

SEQ ID NO: 238712 - DNA, 387 bp, Homo sapiens
gacgggcaccaccatgcctggctaatttttgtagttttaatagagatgggtttcaccatgttggtaaggctggtctcaaactcctgacctcaagcaatccacctgccttgggctcccaaagtgttgggattacaggtgtgagccaccgcgcctagccactcttctttttattaaggatggaggaacaagtttctctttgttctaatatttttggagtgtttttccaagagaaaaaaagaatagagatacagctttattctgctcttttgaacccaagcttctccaaattattatggtagcatttcttattaaatatttacttctctcttattcttaaattgctttgttcatcttcattagtaattggtaaaggcccatcccttttaa

SEQ ID NO: 238713 - DNA, 1080 bp, Homo sapiens
gattgttccatttatttctctacttggtgtattccattctattatttaaaaatcatcctaatcctaatcagaaaaccttacaatatgacttcctcatggaggccattcacttttatagtccttccttcagtagatcacactgggtaaagccatctcacctgttattatgcctttcctcaatcccaatgtgacacccatttcctactcaacttggcttctgaactttcttgtccattagagccacaccacctttctcgtttcctccgttcactcatccatcgtgtaagagatgccaaacacaggaggcttcctaaatgaagaaatgttgttcttgatgttaaagattttagtttggtgaaattctctatctttcagaatcttctcctcagctcctaaatgtgtgttgcctccagtgttggcttggattctcagctccttatgtattttcccttggcaaattcctgtatcctactttctttcccattctgcttcatcccactacagcatgttatgtttagccagtttattggaaacagtcctggagaaggaatggagagatactagttctgacaaggttgccatttcatttattggcttctcaattgctcacttcttaggagaagagttgggctaactcagcgattcccaggcttgtctgcacattggaattacctggagagctttaaaaaatgtggatagagcatccctcccctagagagtctattgtaattagtttggggtgtgggggggtttaaagttttcttggtgattctaacgtgcaggcagggttgcgaaccactatgctgaatctacttaacgctaattccccactctctagaacaaggaactgcttcacagtgggatcaggtagattttggagtttaatagaccaggttcaatttccagccagcaatgacacctcagggaaaatcacttcacctttttgagcctaattccactatgaaattaatgaagattaataatatctaccttccaaatataaggatcaaacaagatcatagaacaggacaggcattcaagcaaaggtaattattattatttctcctaaaacaacagttc

SEQ ID NO: 238714 - DNA, 315 bp, Homo sapiens
aggtcagaaattgtgggttgcagaaatctgtgttttaataacccttcagatgactgtggtgcccgacaaagttgaaatgcctgctcccatgtgtgctgggtttagtttgtgctttagcaaagcgggataagaaagaaaggaggccaggatggaattcgctggtttccaactagaagtgacagaaaatagaaagagtccagtaatgtgaggtcttgaagtgttgggagaattcattcatcacttctagattccagacaatcagaaataaaattttaaaagtctttcaatgacaaactaagacttctcagttgggaa

SEQ ID NO: 238715 - DNA, 425 bp, Homo sapiens
tatcctctgtatttttcgtatgcggttataaatgtgttttggggatctattttattccttaatttatatatttgattctagcgtcaagcaggttccctttgaatttttcctttaaagaacatgtgctatttcctattacatcctgtacccctcaaactgcccaattaggtatactcctggggaaaatatggcaaagtttgttgtaatgcagtttttttacctaattaagtagctactaaaataattaatttcaaaaatttggagcaaacctagaaagatgcagatgtctttgtggcttttcacgcaatcaagtttacctatctttgcttttaatatgtatttcctcttgatgaaatgtttatttagtttagtaaacttgggatatgtcatttatatccataaatcaactttttaaaaaagagata

SEQ ID NO: 238716 - DNA, 249 bp, Homo sapiens
agggatgtgacttagctcctgtctggcacgaccctaggtcctgtttatgatctctgttttaatattaacgttggtcagttgtgtctaaattccaaaagagaaagtatagtgaggcatgtccaatctcctttcacatcactgctgggaactcagcttttcaggtttctctggggttccgtttggccaagagggggcccactcagttgggggacttaggatatttatttatttatgagacagagtctcgct

SEQ ID NO: 238717 - DNA, 360 bp, Homo sapiens
cccacaaacttctggaatgagaatcttaggaggtgagctagagttatttacctggtacttccagttacttctgatgctgacaatcaacagaccccacttgagaaattctaatcaaggacttagcagtactgaaatgatattttgattgaataattctttctcttttctctgactctgtcttactctgtgtagctcacattttctcttgtggaagaaatagagaatgcattaggtctacttgtttaagcagcctccaggggtaacaaaactggaactcgtggataataacatgtctgtacaggaaggaagtgcaaagggtgtgttgagttctgaattgtgtaggaacccaatctgtaacag

SEQ ID NO: 238718 - DNA, 1736 bp, Homo sapiens
  misc_feature (63)..(63): n is a, c, g, or t
  misc_feature (810)..(810): n is a, c, g, or t
  misc_feature (814)..(814): n is a, c, g, or t
  misc_feature (871)..(871): n is a, c, g, or t
  misc_feature (1169)..(1169): n is a, c, g, or t
  misc_feature (1219)..(1219): n is a, c, g, or t
gagtaaaggtgacttttgttatgttttagaagagactggtggcattttgcctctgccctaganatttgtggaactttgaacttaagaaagttgatttagggtatctggcagaagaaatttctaagcagcaaagcattcaagaggtgatttggatactgttaaaggcatttagttttataagggaagcagagcataaaagtttggaaaatttgcagcattactatgcgatagacaagaaaaacccattttctggggagagattcaagccagctgcggaaatttgtgtaagtagcaaggagcctaatgttagtccccaagaccatggggaagatgtctccagaccatgtcagagaccttcaccacagcccctcctatcacaggcccagaaggaaaaagtggttttgtgggcctggtccagggtccccttgctgtgtgcaacctagggatgtggcaccctgtgtcccagctgctgcttcagctgtggctgaaaggggccaatgtacagctcaggttgtggcctcagagggtggaagccccaagctttggcagcgtccacatggtgttgagcctgcaggtgcacagaagtcaaagaattgaggtttgggaacctctacctagatttcagatgtatggaaatgtctagatgcccaggcaaaagtttgctatggggtggggccctcatagagaacctctgctagggcagtgtggaagggaaatgtggggttggagcccccacacagagtccctactggggcactgcctagtagagctgtgagaagagggccattgtcttctagaccccagaatggnaganccactgacagcttgcaccatgtgcctggaaaagctgcagacactcaacgccagcccntgaaagcatccgggagggaggctgtaccctgccaagccacaggggcagagctacccaagaccatgggaactcacctcttgcatcagtgtgacctggatttgagacctggaatcaaaggagatcattttggagctttaacatttgactgccccactgaattctggacttgcatgggacccgtaaccccattgttttggccaatttctctcatttggaatggctgtatttacccaatacctgcacacccattgtatctaggaagtaactagcttgcttttgattttacaggcccataggnggaagagacttgccttgtctcagatgaaactttggtctgtggacttttangttaatgctgaaatgagttaagactttgggagactgttgggaaggcacgattggttttgaaatgggaggacatgaaatttggagggcgcaggggtgtgatatggtttgggtgtgtcctcacccaaatctcaactcgaattatatctcccagaattcacatgtgttgtgggagagacccagggggaggtaattgaatcatggcagccagtcttttccgtgctattctcgtgatagtgaataagtctcacaagctctgatgggtttatcaggagtttctgcttttgctgcttcctcattttctcttgccaccgccatgtaataagtgccttttgcctcccgccataattctgaggcctccccagccatgtggaactgtaagtccaattaaacctttttttcttcccagcctcaggtatgaatcagcagcatgaaaatggatttgaatacagaagcctaatcaaatttgctgtccctcatgggtctatagatggttaataaaacattggggtaattaacc

SEQ ID NO: 238719 - DNA, 346 bp, Homo sapiens
cctcattcattcattcactcttccactcattcctccaagcccatcgcccctggagtgtgccaccctgggctgggggcttgatgtggatgaggaaaccagccccggcccattctgtgggaccccagtgcaccaagccagtcatgaagtggaggcgatgagagccgtgacacaggtctggacggagagatagtggggcaaagagaaggaaaggaccaatgacggggaagcagggcggggagcacgaaggcaatggtgaccacagcaatcgcagcggttatctttggagcgcctaccagctccaggccctgagctgacactggggtggtacctagttaagagtttgcca

SEQ ID NO: 238720 - DNA, 205 bp, Homo sapiens
tccccgatgctggttcaaatcacgtggaaatttcatttctgagctgccaccagcacagcaaagctggtgccatatttgccatcagtcttttgacatggagctatgcttacaagaacaaggcccaatgcttctgttaaagatgtgaaatgttgaatacatctgacatcaaactgttgaataaaatcaacgtcaaaccacagctgaa

SEQ ID NO: 238721 - DNA, 398 bp, Homo sapiens
gctcttagaggtcagaatagaagttcccttgaggttgggggtggatagtgaatagagctggaagggggattctgggatcatgagaatgttctgtttcttaatctgggtactgatttaagcatgtgttaagttacaagatttgttgtacttttgtgtatgtacaaaggagttttacaaagttcctgctggaaagccaggagaaatagacaatcatgtgattgctggtgagattgtccattcaaataacccctatggaagcaatctggcaatatctatcaaaattataaatgcatgtatcctttgatctaaataattttcctttttggactttgtcctagttgcacacatggaaaatgatatgtaaataagaatcattgcagttattgtctgtgatagca

SEQ ID NO: 238722 - DNA, 1702 bp, Homo sapiens
  misc_feature (1205)..(1205): n is a, c, g, or t
  misc_feature (1251)..(1251): n is a, c, g, or t
  misc_feature (1270)..(1270): n is a, c, g, or t
  misc_feature (1274)..(1274): n is a, c, g, or t
  misc_feature (1583)..(1583): n is a, c, g, or t
  misc_feature (1617)..(1617): n is a, c, g, or t
  misc_feature (1620)..(1620): n is a, c, g, or t
  misc_feature (1622)..(1622): n is a, c, g, or t
  misc_feature (1624)..(1624): n is a, c, g, or t
  misc_feature (1628)..(1628): n is a, c, g, or t
  misc_feature (1639)..(1639): n is a, c, g, or t
  misc_feature (1645)..(1645): n is a, c, g, or t
  misc_feature (1652)..(1652): n is a, c, g, or t
  misc_feature (1657)..(1658): n is a, c, g, or t
  misc_feature (1665)..(1665): n is a, c, g, or t
  misc_feature (1690)..(1690): n is a, c, g, or t
  misc_feature (1697)..(1697): n is a, c, g, or t
caattaaatacagtggacacaagccagtgttatttattaaatcctggtgctcaataagggtgcctgctgagggttgggagcctggggccactacatcctgccttttctctaaggagattagctagtattaaagaagtgttaagactagcccagactgagtctttctcctcaaagcatgaagcacctgagagcatcctgctttcagcaggagggagccactcagaaactgttccctagaaccctgttgttcaaagtgtggtaggaggaccagcagcctggctggtcaaagtagagttctcacctaggagatgtgggaactacagaaacttggccccctagatcttcagaatcagaatctgcactttaacaaagttcctaggtacctcggtgcccattaaagccagaggacccctgacctacaggccacagacccagataaagcagcccaagctatcgtttcctcttgttctcttgagtcacaccagcgaggcttttgtggtgcctttcattcactgcagtgtcgagatgtgccgccaagtcacgaatattgtccacactgtccctgcagtgtaacattatcagggcctaggaacgactgagcccctcgtaggcatgtgacactgtgttcctaagactgcttctctcttttcatgaataaaagcagacacaacgcaggtgtttagaaaactagtctggtattaatattttaagctagaccttggatgccatcagactttatattcgtgtttattttcaattctgttcattttattgtctcttacattaaatatactgtttggccctagaaatgcaaaatcacgaagtcaccactctgcctgcccttaaggagctcacaagccattaggaccattagacattagcttttcgtttcttcttaaacaaccagaataagggcattctccatctctagcccctttgaatggttaccctagagtactctgagtccatagcagccaggaagtcttgctttaacattttgtccacagcaactcagatgtcaccaggtcatttctcttacctaagtaccttctcataaagtgaacctggcagttttggacagatgtcgtcctcagtcctgtggtggtgatggctcaggcctcctaggctaggaacatatcagctaaggcctactgcagccactcaccagaagggtctctccactagagaacagtagctgcgcctcnagcattgctctgtttcagaggtgtgtctctctggtcagtcagttcnagaaggttaattaataaancccncatgctgagaaatgagtttcctcaagtgggcccagttttcagggagactggcacatgcctgtcatccctgcttctacacgagatttcttagaacagtcgcagtctgccttctagattccatcctgttttgttctaactcttgggttcaattttagaaaaatcaggctgtaatcccagcacttcgggaggccgaggcaggtggatcacaagttcaggagattgagaccatcctggttaacacggtgaaaccccgtctctactaaaaatacaaaaaaacaattagccaggtgtggtggcggtcacctgtantcccagctactcgggaggctgaggcaggagaatngcntnancccnggaggcggagnttgcantgagccnagatnntgccacngcactccagcctgggcaacagagcnagactcngtctc

SEQ ID NO: 238723 - DNA, 473 bp, Homo sapiens
gtgaattattgtttgattttgctttgaataatttgcatgccggagttccttcctttctctgtaaatctgtaattctctagggtagtgcgacctaatataactttctacagtgatgctgttttgtatctgcactgattagtatggtagccactagctgttgagcacttgaaatgtggctaatgcaactcaggaaattaattttaaatacctaattttaatttaaatgtaagtttaaacaattggctatctaccatattggacagtgcaatcctagtgttctctggccttgagatggctcctcgtctgtgatttcctgattggtgaaagggaatgatacatgtgttcctttttttccccaagactcaactccaaagtgactgtgggaatcctatagtgcagtcagtcccttagccacagaactgtaggtggctggcattgatgcctgtgagaaagaaccaatagtagcacctgta

SEQ ID NO: 238724 - DNA, 655 bp, Homo sapiens
ggtgggctgggcaccgcttctgcctgctggaccctactagggcagctccggcctcactaactggggctctaactccctctggggcacgtacacctccaaaggacggagcccagagcccccactggggcgttgccagaggccacatctaacagcaagcctttctgtgccggctgctgcccttaagcttgaactcagcctggctccaggccccagtcaaacccctgccctcagaccggcgtgggtggagtccaggaccagatggcccaggaggaagtggatgctttcttggtagggaatggggcagagctctgaagaaacctttgactggtgacttctcactccctgcctcagttttctcaaatggaaaatgggtccgggtgcagtggctcacgcagtaatcctagcaatttgggaggccaaggtaagcgggtcacttgagctcaggagttcgacaccagccttgccaacatggcaaaaccccgtctctagaaaaaaaatacaaaaattagccaggtgcggtggtgtgtgcctgtagtcccagctattcaggaggctgacgcaggagaatcgcttgagcccaggagttcgaggctgcagtgacctatgattgcaccactgcactccagcctgggctacagagtaagacctgcctcta

SEQ ID NO: 238725 - DNA, 311 bp, Homo sapiens
atttcgcagagtaatttgctatgatttaaagcctaatattttgtcattcttagtaaatctctggacggatatatttataacttgccattttaattaagattcttctattagcgagaggcattttaaaaatcactattttgtttcttttgttgtaggacatatttcagaatcccacaagggggagttctagcacctccaaactgcccttcagaagtatgctaatttttctaaaagaaaaagtttcaagtccatatctttctcaaaagaacaaaacaattgggccgggcgcggtggccaacgcctgtaatccc

SEQ ID NO: 238726 - DNA, 463 bp, Homo sapiens
caggcttctttgtaaggtgcaggtggggcgccctgtggtcctgtgaccttgaaactcaaagacaagttatctgccccgacatactcaggatcagtggttggttagaaacaggaaaagtgcagtacagcttccatccagcaacacggaaagggatgcacacagcagtcgctggagcaggaagtcctgctgagtgaggacgcctggcttcctgggtaccatctagcaccctgctctgctctcaggaagatgtgccagagccattgccttctgcagactcagctctgccctattctccttattcattattctccatggggtgggtcttgaggggatacgccatttctgggggccacacggcttcctgttggtgtgagtctggagtcctgggggtggcttcaagtattggctgttactcaccaaccttgcattcttttggagaatacatttactcaaaaacttggtt

SEQ ID NO: 238727 - DNA, 354 bp, Homo sapiens
gatgtcatgagtccgcaggtgctgcttttccgctttgccggccaagtaaatggaagacacggcaatcagtacagatctcaaagcaaggcttgttggacaaataaatgaagatgagcccaagagcccaggagagggaccgggaacagcagggcctccgtgactcacacaagcttcatccctgaaccaaggacgcagcctgccaacaatggccccaagccacaccccgccacagggggaactgatgctgcggtgagaagtgacagctttctgttgactcttttttttttcaagcagaatatgaattgagacatactttcattttcataatcagaacctaacacttagtaaccaatg

SEQ ID NO: 238728 - DNA, 512 bp, Homo sapiens
gatgtcatgagtccgcaggtgctgcttttccgctttgccggccaagtaaatggaagacacggcaatcagtacagatctcaaagcaaggcttgttggacaaataaatgaagatgagcccaagagcccaggagagggaccgggaacagcagggcctccgtgactcacacaagcttcatccctgaaccaaggacgcagcctgccaacaatggccccaagccacaccccgccacagggggaactgatgctgcgctgaagaaagccaccactaagaaaacgaaaagagaagcagcagaccaggagaaaatatttgcaaaaccaaatctgataacggacttgtatccagtatttgcaaagaacttctaaacttaataacaacaacgacgacaaaggagcaaaatccctggtggtctagcagtgaggattaaaaaagaaaagaagcaaaatatatgaacagctgtttctccaaaggagatataccaatagctaataaaatatgcacagatgctccacaa

SEQ ID NO: 238729 - DNA, 447 bp, Homo sapiens
cagctttgcgcagaaaagcctaactcttagctcgagattaattaaaaaacaaaaacaaaaaatgaaaacactgacttttaaaccttaatgtcatatactgccaaaccaggaacacttccacagacacacacatacatatgtgtatatattacaatgtgccaggaatatggttaatcctccaagcaattcagtgaaatactgttgctctgagtcttctgagaaacatttgccaagagaggattatacacgcaaggattttgttagagaaaacgccagtgaaaaaaaatgattaaagagcagaagaaggctggagaaccaacacacagaaatgccagactgactctgagtgaaaaagagagtaaaagaaagtggaatgaaagcatactcagtaccttgtagtctaaggaaagcccagcctggccttggggagttctccagctaaagctg

SEQ ID NO: 238730 - DNA, 398 bp, Homo sapiens
ataatctgggaagtactacacaaactccagttatcttttttctcaattgaaacacattttttctgacttctaaaggtctcttagaaaagaaatcataacttctacagaatgagggagtttttattgatcttacttataaaaagaaagatccagcactatcttcaaactctatgacaagatgtaaacgtctaattttcttcattctctagtcatttcacagttgcctaaatcaggtaaaggtgacttctttcccaaaaccaatcatagcctgtttatctgtgtataattttatgttggggctgtttttttttcataaatttggttgattttggtggtgtagatgcaattgacagtttctagagagcatgcataatgtctattattttcattttatttcc

SEQ ID NO: 238731 - DNA, 235 bp, Homo sapiens
ggattataggcgtgagccagtgtgcccagccagatatgtattttaaaaatattttcttccagtccatggtttgtcttttccttaacaatgtctttcaaggagcagaagcttttaattttgatgacattcaatttatctttatggatagtttttttgatgtcatttcattgtatgtgtttttcaacttttctctgggtttgaaatcttttataataaaaagttgagagaaaaaggc

SEQ ID NO: 238732 - DNA, 382 bp, Homo sapiens
ggctgaaaaccaatatgtaaacttagtatcacagtcctaaagtatacagttgcttggcagaagttaaaaaacaatgggaagatcaagttccacaagggcttattttgactttgtaacatatgtgtacaaatccttatttatcctctggcagcaagaaaagaacgttctattgaatcacagaaaaaagaaaatgttattccatggtctttggggcatgggaatttttgcaattttccttccctaggtattctagtttctgaaacaatagaaaactaggcagcacttcagtatcctgtgttcagctgcaactggaagttatttttctgaagggctgtttctctctctctcgtttctctgtatgaatatatcttctatattttaa

SEQ ID NO: 238733 - DNA, 548 bp, Homo sapiens
cagcacccctttgtccagcatatgcacgctatagacacttcccatttgttagtcacttagtagccatttccgttatcagatcaactatcatggtatggcagcacttgtgtccatatggcccttattttacttaataatggcttcaaaatgtaagactagtgatgctggcatttcagatatacccaagagaagcttcctttaagtgaaaaggtgaagggtctagatttactagggaaggaaaaaaaatagttgctaagatctatggtaagaatgaatcttctttctgtgaaattgtgaggaagaaaaataattcatgctcgttttgctctcaaacctcaaagtgcaaaagttagggccacagtgtatgagaaatgcttagttaagaccaaagaggcataaaatttgggggtggaagatatgaagagaaacatattctgattgatggcagtcaggttcagtactatctgaggtttcagacatccactggaggtcttggaacatatgcccctcaaataaaggagggactactgtatatgttaataaaatga

SEQ ID NO: 238734 - DNA, 255 bp, Homo sapiens
gacagttactttctggagagattaagtagacagcttctggactttgggatactaggcacccctgaggcaaagcatgagacaccataatgaaaattggggactgactgattcccccatccctttctggtgcctgactgacaaataggtttatcttccaaagatagaagtgtggaagatttcttaacgaggaagaggttgctggaaagaagaaacatttgagggatgagatgatcctttaaaaattataaccatgat

SEQ ID NO: 238735 - DNA, 393 bp, Homo sapiens
acacacacacacacacacacacacacacacacaaacacacacacgcaacatttagagtaaccacaaagctatgcaaagagatcttttcaaaaacagtgcaaagtggaattcttaaaaatgttcacaggaaggcagaaaaagaaaacagaaataaaaaacagagaacaaacagaaagcaaaaaaccaaaatggcagacttaagtgctaacaggtcaataataacatcaaatataaatggtttaaatataccaattgaaggacagagattggtgagttaattttccaaaaaagacccaactatatcctatctggaagaaattcacttcaaatataaagatataggcaatgatagaggcaggttgaaattaaaaaatgataaaacatatataatcc

SEQ ID NO: 238736 - DNA, 486 bp, Homo sapiens
tgagaaagatataaatatccaggtacaggaaggtcttttaacaccgaacagattcaacccccaaataagactacctgaaggcatgtagtaatcagatgctaaaggccaaggacaaagagaaagtccttaaaacaccaagagataagaagcaaatagcatataacagagctccaaatcgtctggcaacagccttctcaacaggccagtaggtattggaacattttaaaaaaaaactgtcatctaggaatattgtgtccagcaaaattgtcattcaaatatgaaggaaagatatagtctttcccagacacaaaagctgacccatcctgcaagaaaagctaaggggagttcttcagtctgaaagaaaacactaatgtgcagaagaaaacatttcaaggtgtaaaatacactggtagaattaatactatgtatataattttttagtatagagcaattttatagtatagagaatagagcaattaggcaaaa

SEQ ID NO: 238737 - DNA, 6017 bp, Homo sapiens
  misc_feature (1110)..(1110): n is a, c, g, or t
  misc_feature (1689)..(1689): n is a, c, g, or t
  misc_feature (2686)..(2686): n is a, c, g, or t
  misc_feature (3447)..(3447): n is a, c, g, or t
  misc_feature (3847)..(3847): n is a, c, g, or t
  misc_feature (5376)..(5376): n is a, c, g, or t
tttaatgggaaactccccccgcacacacacacactttttttttgaggcacagtctcactatgttgtccagactggttttgaactcctgggctcaagagatcctcccacaccagcctccccagtagctgggactacaggcatgacccactgcacccagctaaatttttcaattttaaaatgttggcaactcacttaaatgtaagacaaataaacacatctgtaggctggcagtgctgcccacactgcccagactaggggttagggggtctgtatgggccatcaccaggctgctaaccacagcaaccaatatgtgccaagcctgactacacgtaccttctcattccaccctcctggcagcctcacatctgctttacaggtggggaactgaggctctaagagactaagaaaattacccaaggccactgcagctagccaggggcaggtatgggagtcagagctgggtgcagctgactacaaaccctgtgctcaggatgacaccctctaggagcctcgacctctctcccagttctcttctccctccactcaggcaaatgagctctgccttcacagggcaccaggctggaacatatgtctggaggccaggggcggtggctcacgcctgtaatcctagcactttgggaggccaagatgggaggatcattgaggtcaggagttcaagaccatcctggccaacatgatgaaaccccgtctctactgaaaatacaaaaactagctgggcatggtggctcatgcctgtaatcccagctacttgggaggctgaggcaggagaatcacttgaacccaggaggcagaggttgcagtgagctgagatcgcgccattgcattcaagcctgggtgacacagtgaggctctgtctcaaaaaaaaaaaaaaaaaagaaggaacttctgtctggggtgtgcctagcagtcattcacaccctcactgaaatctcagctccctgggaaaggatgtcgtgttaaagggagaggaaagaacagacagcgtgggagtctggggtctgagctgggccagccatggaggtgatggggcccccgacagccagaggccagatgcagcttgaggctttgtcccgtaccacgcctgttgtnctgtggggtgtactttgccatgcataccttgctcgcgtgctgcgggcattggctgtcccagcttggccccactcttgcaaagtcagcttgtgccaggtaagcaggaaaaagccgatggcttatctgattcccggcaaggcagaagcaggctgggaggtgcgtgtgtgtacattagcatgtgtttcagcgtatccagaccagcttccgccaggagctaggaccaccttgggcaggtacatggtgacccatttgacctgcagattcttaggaaactttttggaaaccatatgcccacttgcagtgagacacagtggttaggagcatggagccagttggcctgggttgaacagtttattagctgtgtggcctggggcaaattacgccctgggactctcacccgcaaaccagagataataatagtacctacctcatggggctgttaggcaaattaaatgaggtcagataaatgcaaagtgcttagaatggcgcttgatgtgtaagaagggctcgacaaggttctctattactatcattatctccagcccaggcccaggaatgagcttccactctagtcaggangggtgaagcccttcctggcttagcaccacccttccatcaccatgacaacgcacatctccttgtgggagtgggggcagcatcaggagaactggaagccaggagctggctgtgcaccttatctgacctgcttctagaggctcctgggcacctccaggacttaagggggtagactaggacttatggcaccccaaatgtgctggataaccctgactggagcatggcaccgaagcttcttgactccaaagccacagactggggagaaccccggaattcctgaaaatgtggagggccttagctttaccctctgattcgaccccagtccaaagggaacctacaggatgctccgaggggttgggaattggtgggtcacactccccaaggactttttatactgcgtctgaatggtgtttgcatttttttgcaaattggttgctacctttaaaactcaggaaatggcacataaaaaattcaggtatctggcttttctttaaagtgccagaagatcaagccacggtggttggcattcctgctggggcaaaaatgcagctgcccttgggccaggccatcactctgcagttcttacctccccttccccttgccctaccaccctgcaccaggcctgcaggcttaccatgtgtaaccacctctctgaactacaagggaatccagaaattggggtgggcattatcctggccctcggtgcccttgacctgagatcagtgcagcccatcccaaattcctttttccaggactcccacatacacccacttagaacacatctgtgagccagatttacttcttagcacactaataaaacaatgagcagtcacctaggttcaggtaatgggttgtacgagctcccagacctttctagaacaacttaagcctcagtcattcctaaaagctgggggtggaggatggggtggggaagaaaccatgccaagcagtgaaaggactgataatagaatattgcagacacgcagcctttccttcccantcaaaatggaagcatttgaaggaaggctctggctcaagccaggggggccttgctctaatgagtcacctactgcgtcgccgctggtcagcctgatgttgttaggatggaaatgagctggggttgccagatttggcaaatacaaaaacaggacacccaggagcattgatgttttggatgaacaatggaaaagattttggcgtaaatatgtcctgtggaatatttgggacacacatattaaaaacgtatttgaaatttggccaggcgctgtggctcacacctgtaatctcagcactttgggagaccaaggctggtggatcacctgaggccaggagttcgatatcagcctggccaacatggtgaaaccgcatctctacaaaaaatacaaaaattagccgggtggggtggcacatgcctgtcatcccagctacttgggaggctgaggcaggagatcacttgaacccaggggcagaggctgcagtgagccgagatcgcgccactgcactctagcctgggcaacaaagagagactccatctgaaaaaacaaaacaaaacaaaacaaaatctgaaattcacatgccactgggcatcctgtgttttatctggcaatcctgagaagagtcttagaatgcttgaaaagagctttaaacatcatttcttaaaatgccaagcctccctttggtggcactccccttatagctgagtgtaagctctggatgacaggcacgtgggtgccaggaggccaggacctaggagcgggaccngactctctgcagccctctcctctcactctcttttcccttccagtcacagtcactgcagcagacatcatggctgtggatgtggcagaataccatctgagcgggtccccggggagaccctcatcctgctgcaccctggggatgagcctgtgactcggaatccactcaccgaggccttctgtggagactgtcaagtagccaagggaaaataagcccaggaaggtcaaggttagattcatggggcgttaaactcagagaccacccagtccagaggcagaggttatagtgagctgagatcacaccactgcactccagctttccagcctgggcaacagagtgagactccgtctcatcagaaaaaaaaagaggccacccagtccagggccatggctcccaccttgtnaccctttgcctcagcagggagatgggagctggctgggagatgcctcgagactccagacatactcctgcagccctccccatggacagcggatggggtcagagaagaaacataccagccgtcttttctccctttgttcctctcctcattcacagatgggagaagtgaggcttagagagtaacggggtcaggatgtgcactcaggtctcctgactcccagccccgtgctccccatcactctagcccctaccctaacgcagcccctggggagcccagggctgatctgaagggtgtgcccgggaatcacctttcccatcactttttcccaaaagtgagccagggagccgcacttttcaccctcaggctcacaggtcttgcccccctgcccccaccctgccccctacccgtatggccttgggcaagtggtgaaaccggaacttctacttacttatctgtaaaatgcaaaagatgaggcttgcctcagggctgttgggaagatttagagagctgatggttgtgcagcgcccagcatggtgcaaacgccactcttccagtggcagcgctttgcacacgctgttcccctgtcctggagtccttccctgcctctgccactgcctgcctgagtcctggcacctggtggtggggttataggtgcagatctggacccagtctgtctggaggcagatctctcctccgtccctcagcttcctcatctgtaaaatggggaaaacaatagaaccaacctcacaggattgccttgactccatgggttaatatacgtgacgtgcttagaacagggcctggcaaatcataaatagtaagtgcttcataaggggagctattcctcctcctcctcatcccactcgtttctggtcttcgcctagaccccacttccaatatcaccccaagactggtattccataaaatcaataaatgaatgcgaattgtcatttcatgtcaccttcctggggcttttccttctgtgcccccagccctgcccccttttctgccaccccgggcatggctccacccttcagctcccaaagagcctcaggcacaggggagcctgaacctgctttgccacctggctgtgcccacagcctgcttagagaccttgggcctctggtcctgccctctagccaacccccggctactacccagccctgctgtgaccctgttcccaggactcccagaatacaccaagccttagcagggcggggcccgggagcctccatggatctctttgtcatgggcatacgtagcccacaggtgacattctgtcaacagcggcaggaggaaggagggtttcttcacagcccttccaccgtcgttacccattccttctgtttttccctggtctgcccagcccgtgactatgtgctgcgtgacttttgcgcacgtcacacgattgcgtgattagaccatgttggggattcatttttttcctctcttaacaatgccagaaatgtgtctctgcattgccacagtgccatcctaatgacctcaattgtcattctcgaaggccagtgacntttcctcccaagacagagccaccagccctcactggccccctcggtgggaccttcaggctgtctccagatttctgctgttataaatacagcctcgatgactcatcccagacacaaaacctgttgggattttccctttagaataaattcaccagagtgggaccgctggatgggggatgttcttgtcatccgcattttccaaacggagtatgaagcccagaggtgctgggtgacttgcctggaagccaaggtaccggtgcccggctctgccgtttctcaccgctggccttgagtggagaaacagatgtgctcattacccttccttggtctcagttttcctcttttagaaagtagggccttggccaggggcggtggctcacgcctgtaatcccagcactttgggaggccaaggcgagtggatcacctgaggtcaggagtttgagaccagcctggccaatatggtggaaccccatctctactagaaatacaaaaaattagctgggcatggtggtggacgcctgtaattccagctactcgggaggctgaggcaggagaatcgcttgaaccggggaggcagaggttgcagtgagccgaaatcgtgccattgcactccagcctgggcaacaagagtgaaactccatctc

SEQ ID NO: 238738 - DNA, 404 bp, Homo sapiens
atgactcaagagcaagtacttaatttggaaggtgaaggaactgctggtagctctctgtacagcagctgtataaataccgctcaggcagacttcttggcaaatacagcaaggctgctacaaacagccaaaaacaaagcggaattgttctaggaaataaattacttgaacagcggaggagactttgccctatttgatatggaaagcacagccatgggtatggatatcagagcctcagagttaggagctgctccaagccttcttccctagatgcctcacacccctcctggacaacttccaagtatcacagctctggatggccactcatcttctgtgtacagggtccggcccagctgaaacccaaatcatgcacatgtactttatataaacctaatttatttatgaaa

SEQ ID NO: 238739 - DNA, 264 bp, Homo sapiens
tcatctaaacccaaagtaagcagaggggaggaactagtaaagattagagtggatataaatgaaatagaaaatcaggagagaaaaccaacaaacccaaaagttgtttccttaaaaagataaacagccaatggcaaacctttatctagactgttcaagaaaaacatgatcaaattactaaatcaggaatgagagtggggacattaataatgaccttacagaaagaaaaaggattatgagaaaatataacaatgctaaaaaacatag

SEQ ID NO: 238740 - DNA, 201 bp, Homo sapiens
aagaaattgatgctgcaggagagagggaataattgccgaagcaaagatcttgaggcctgcttccactgagggactggaggctccttgagcaaaattatctacctcttcacctttggatctttcacagttcccagttcggtgtactacagattgtacttgctaaataaaaaatcattgtcatggtttacctaaatgcctgaa

SEQ ID NO: 238741 - DNA, 148 bp, Homo sapiens
aaaaaaaaagaagttttaagtgatttttgttaatattactctactttaccaaagtgaagtccagtttcttttcacagagctgtaaatactcagataattagtcaattcagacagaatgaacaaaaaatgctcataatccttcccatcc

SEQ ID NO: 238742 - DNA, 758 bp, Homo sapiens
ctctgttgcccaggctggagtacagtggtgcgatctcagctcactgcaagctctgcctcccaggttcatgccattatcctgcctcagcctcccaagtagctgggactacaggcgcctgtgaccacgcccggctaattttttgtatttttagtacaggcggggtttcaccgtgttatgtaggatggtctcaatctcctgacctcgtgatccacccgcctcggcctcccaaagtgctgggattacaggtgtgagccaccacaccaagccggttgggtgtacttttcaggtgttctcagagcagcctaagctttccctaagcgtcacctcactatacacttggccgcaacctcccaatccacttactaaaatgtaagctctgtgaaggcaggaacattttctgttgcaggaaggagccctgggagctggaggaaaccagaaatggccctgccttgaaggagatccctgaaggcaaggaagccaagagagagattaaatgaagccaagaaagaagctgggggtgcaggtccagatacaattaactacatacaagttcccagggtacacagaggatgtacatggcagggcggggagtgaggtcagcagtcaaggagtagtgcaaagatcagactgaagtcaggcattgagacaagagagctccatttctaactcaccatcactgttacacagagatactcttttaggcaggttcacacaggtgggacaatatctccataccttgtaaaaatgcaccaatttcc

SEQ ID NO: 238743 - DNA, 3106 bp, Homo sapiens
  misc_feature (920)..(920): n is a, c, g, or t
  misc_feature (944)..(944): n is a, c, g, or t
  misc_feature (1045)..(1045): n is a, c, g, or t
  misc_feature (1107)..(1107): n is a, c, g, or t
  misc_feature (1130)..(1130): n is a, c, g, or t
  misc_feature (1201)..(1201): n is a, c, g, or t
  misc_feature (1211)..(1211): n is a, c, g, or t
  misc_feature (1369)..(1369): n is a, c, g, or t
  misc_feature (1429)..(1429): n is a, c, g, or t
gagttcgacgttctctggaggcttgggagatgcagccagggcgcagagttggcagtggctgcagacatctcttttcaatgtggacctcctgccacagccacgagattcaaggattttctaggaaaatgaacgccagtggatgtgtggaattttttcacaaagtaagtgacgggggtccctttgcacttctcatgcccccatggttaattgtgtgtgtgtgctggaagtggaggagggcggtgggtggtgcagctgtttgaggactcacccttcttcggaaggctggggtcaatggggtgctgtttccccgagtcagttgaaacgcccatggctaaagcctgtggatcatctcacccctgcatttcctatttggctctcactttggtcgaaagacagcggagcgcagaaaatctgtcataattgtgaaagtaggacctgtcatcctctaagggtcattcttcctggcccaccgggcttgttgacacctggagttgggtagcagagagagggatgtcgggaccgtgaattaacagtggccaccacttcatggtgaatggcatccagacaacaccttcacctgtctggggaagaacataggctaggcctgggagaggctgtctactgaagtccctgcaggggtccaggctggactatacccctccagcttggcgagagagccaaggaccagcaagggaagtgatgtacgctgagaaccgtccgggcgcccagcacgggtcagggcctttggcttacaggctgtgtttatttctgagcagccctatgcagttggcattagcatcctaccgttcccactagccagctgggactcaaaccgattaagtaactgtctacctgcttcctgtgttctgtgtctgttggtgttgattaaaaaatataaaaggccaggttcatgcctgtantcccagcactttgggtggccgagncaggaagatcacttgagcccaggagttcaagaccagcctggggcaacatagcgagacctgcatctctatttttttttttttttttttgagacagagtctcnctctgttgcccaggctggagtgcagtggtgcgatctcaactgactgcaacctccgcctcccnggttcaagcaattatctgcctcngcctcctgagtagctgggattacaggcgcccgcgccacgcctggctaatttttgtatttttattagagacngggtttcacngtgttggccaggctggtcttgtactcctgaccttgtgatccacctgccttggcctcccaaattgctgggattccaggcatgagccactgtacccggcctcaaaatattttttaacagaagtagcagggtgtggtgatgcctgtagttgcagctactcnggaggctgaggtgggaggatcacttgagactgggaggttgaggctacagtgagctgtgancgcgctactgcactccagcctggatgacagagtgagaccctgtctcaaagcaaacacacacacaaaaagtaaaatccctgtgattatatttttgctagtacttgctaagctgtagctgcttcaatttgagagcagagcctgggctgcccaaagaaagtcctgaccccttaactcagaactccgtcagcagaggaattgggttctctgggctgttctctactcaggcacacccttgctgggcctcccatgccccagggcagtccaggaaatagtgtgtgcatggtggaggggaaggaccttgactgagaccagacagggttggaatcttgggtctcctacttcctgtctctgtgaccttggccaaccatttaacctcacttgaggaaattgagcctcagtttcctcatctgtaaagtggggttgttatgacgataagacaggataaaacacatgaaacagccagcattttaccacttttaacctacagaacggcagtttgacatggctcactcaagtatgtccatcatggagatgcctcagtgaggtgctgggacatggtagactcagtaatgttcccttcctctcctccagccctcagtgttgaaggctttgtcatcctgaatggcgacgaatgggaagtgagctctgaaactgaaaccaccatttggggacaaaagctggcattgtagttgtggctctctgggaaggtctcatctgtcttctcggggctgttccctaaagctgtcattacgctggctttgcggcaggggtgcagcagcagtgggtggtgatgcggctgctcttgagtggcctggtggggtcatttcagtttcaaggccttggagagtgtgcttagcaggtggggcctaagatttgcatttcagctgcccaggtagtcaagaagcggtatagcaaagcggctgtgagcccattctctggagtcctgctggctgggtttgaaccccaggtctgcctcttgcctgctggtgcactcagccaagttacttcatctgtctgcctcgatttcttcatctctagtggtttctacctcagagactctgggagccacaaacaggatcccacttcttgaacaatgcctagaacaaataagcaatttctatgctgtagagagtgtttgcttacttaaaataatgcttattaaaaattggcgggtgcagtggctcatacctttaatcccagcactttgggaagccaaggtaggaggatcatttgagcccaggagttcaagaccagcttgggcaagatagtgagaccccatctctcagagagagagagagggagggagggaggaaggggagagagagagagagagagagagagagagagagaagatagaaagaaagaaaaagaaagaaaatcaagatgagctgtgattaataagtagggcctgattattggaacttggcattggatataattaagttgatcagaatttctcatgactggagagtcagacagtctgcccattgtgctgtgtgaccttgggcaaataacttaacttctctgagcctcattcctgtgtaaaatgggtgtaggaagtgaggaattaggtttataagaagggttgtgaggaggaagtcagaggctgcttctgggagggcctaatcctggtgcctgggtctcccgtaggagctgctgtcgtgagtgtgtggctaa

SEQ ID NO: 238744 - DNA, 185 bp, Homo sapiens
taaagagctgggattacaggtgtgagccactgggcctggctggcattctcatagatggaaaagttaacattgtacagcccttattatttatttgttttttaatgtagttccaatatggtgggagaaaacgtaaggggaagaaacaatattgggaatgtggtataagggggaacaacaacaacaac

SEQ ID NO: 238745 - DNA, 1161 bp, Homo sapiens
cacttccacatgtctctcctacctggaacgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaagctaacaaagcagagacgtcagtggctacacaagacaaagaatacagacttataacacaattacatcagaaaagttactaaaaaacaaaaataccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaacagaaactgttccagaggaagcccagacataaaacttattagaaaaagtctttaaatttagttcaaagggttaaagaaaaccatgtctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaattatgaagaaaaatgaacagaacctcagaaacctgtagatctctatgaaacatactaacatatacataatggggagtctcagaaggagcagaaaaagagaaaggtgataaaaatatgtgaagaattaatgtctgtaaacttaacaaattgtatgtaaaaccgtcttaaactggcactttcccagaaaacacaacacacacagagaaaagacaccggttgagccgcatactgggcccctcttcaaaagcgtgctggacacaccgcgatttggggaccgcgcccacataggtacaaca

SEQ ID NO: 238746 - DNA, 442 bp, Homo sapiens
aaatcttgcagctgctcactctttgggtccacgccacctttatgagctgtaacaccgcaaaggtctgcagcttcactccttgaagtcagtgagaccaagaacccaccaattctggacgcaggctgacagtgaagggttgaaaacagatatcccatgtaaatagccctcaaaagaaagcagtagtggccattcttatatagcacaaattagaatttaagtcaaaaactgtcccaggagacaaagtcattacataatgataaaagggtgaattcaacaggaagataacagcaattgtaaatacatatgtacctactattagactacctaagtatatagaacaaatatcaaaatacctgaaaggagaaatggacagcaatagtgtaatggtagaataattcagtaccccactttcaataaaaaatagaaaatccagatagaaaat

SEQ ID NO: 238747 - DNA, 3071 bp, Homo sapiens
  misc_feature (1834)..(1834): n is a, c, g, or t
tttgtcacttccagtgccctgcccagccctacagaaaatacgtgattatttaagggtgaagaagccaaagctgggagagttttagtcacctatctaggggaaagtgtgaagatttcaaagcccagggtccttcacggagccacacggctctccttggcacttaatcttcaagctctcctcagcccacacttgacccttaacaggggagacaaaggcagactccaggtaagttgtcagggttagcataagcagctcagggcaactggtgggtagggagctgtacagcccagggattgcagcctcttgttttgcatttcctggagtcaaggctaaactcatggtctcctcaggggtcaaagcaggcctgactttcagtgtcatcttcaggacacacacacgcacgcgcacacacacacacacacacacacacacacacacacacacacaggattatacatgcaactaaccaatcacacagagctggaccatctagcctggtagaaggtctgccgagttctgcgggtcaccatgaaccaggcttgtgagccctcttagtcatatgtaaagggctgtgtttgagacccggtagcccacaaagctcttttctgcccaagccttggtttttccgtatgttagtggggacagattggaactaaacagaccttgagtcttttcagggtcagtctcaactctcttagatgctagagggatataggcagggctagcacagaacagaagcaagaaatagtcaaaatgaatattttggactgcatagactcagaatgtgctttacttgggcacccagggcttctcagacttcagttgttttcattccaccattcccttcctccccctcctcatcaccagcagcagcagcagcagcagcagcagcagcagcagcagcagcagcagggcgcacagctctggggggaatcaggcactgggctgtggtggtaccgaggttacccctgaagtcctcacgcctccctgtgaggttgatagattgaaactaccttattttgagtatgaggaaatagaggcacagtgaggtccagagaccgcccaagagcacacacctaggaagctgagtgccaggtttcaaaaccaggtctccctgggcagggcagggcatggctgtgtttgaaccactcaggtctcctttgtcatagttgacagcactagttacttgataatgtctttttaaaaattaatttacttaaaaaaacttgagtgctattctaagcaatgtgacatcgtggatttcttgggctagttatatattttatgatgttcatcaatgtacaattatgtaaaagttgaatgatcaagttctgcctaagaccatctcatgtaccagcagcgaggttagattcaaatagaaaaaagggatctggtccaagatttgacacggattcactgtctgtgggaccccttgctagggcacttgatcatctgggtcattaaatctgggggccaggcacattctcattcattcgagacgagcccatcctcttccagagcatgggggcttcttgaaaccctgtcctttccaggcacacactgaggtggggagagggaccctggagtcagaccacctggctttgaatcccagctgtctcctctgagctgtatggcctaaggcaagtcatttaagcttcttgtacctcagattctccaactgcaaaacggagatgataataggcagaagcctcgtggggctgtgagaatcgagtctgcatatgtaaagcactgggcactgtgtctggaggctgtgagcaccaagcggctctaatcattcccgttttacaaaggaggacagagagactaaggaganaaactctttctcatctctcgttgtgtgtcagtgcaggggcaggactaaaagctggtctgtggtctgcaagctttaggggttacagagtccccaggaactcctaggaaattcagctggcggctaccttccaccatccccaggttctgattcgtgggcctggggtgggacccaggaatctgcatttcagttacttcccaggggattctgatgcaggtggtgcgaagaccacttactgagaagctgcaagctgggtttgagaggtccctacctccttcttccttccccgagccccacccgcccccttctttccactgggcaactatgtaaacagcattatttctacccttgcacggacagaaaggggtctgtgctgctgcctctgttggtgcctcttcaggtcagggtgataagaagagaaggaacaaagaggggaaaaagatcacagcagagagacagagtgctcattttaaggtggaaatatgccatttcctgaccacagcgggacttccctaggttgtattaaaaaatcctgtactgcccatgtctggtacagaagtatgtatagaattgtagagaaaatgaacactttgggatgatttgaaagcaaattacagaactaccagtttcaccactttaaaacttttggggaatggccatttagatataacctggtgcagtcaggtaaccccaaacagagtttttaaaagtttccacacccttctttgctggtgcctgccctgcatcatgctgtcgctgtgaggagggacttgttccagatctctggggcagcccgagtgactcacctaaagtcacacagcttccacggaacattactggaagctcagtgagggccttctgcctctgaaacttgctctatttccctcaagtcctgcttccttttgtaggtttaagacattagttcctgagaaattgactaatcaagaatattctggaaatcttagtttagcaaaacaaaaaacaaaaaaaaaaaacaaaaaaacagatgggtaaagccatgttccaaggcattcactgtcctggcttgggagaagaatgatctcccaaaagctcagaaaacatggttgtctaaaagtgtccaggctggcctctgggtgatccttgtgcacggccagggtctgtggagggtctgtggtgcctctctggcactgaagctaatgtgggagctggctctaattgcacattggcctaaagcaaccagcaagacctgcaccgtctc

SEQ ID NO: 238748 - DNA, 3050 bp, Homo sapiens
  misc_feature (1813)..(1813): n is a, c, g, or t
tttgtcacttccagtgccctgcccagccctacagaaaatacgtgattatttaagggtgaagaagccaaagctgggagagttttagtcacctatctaggggaaagtgtgaagatttcaaagcccagggtccttcacggagccacacggctctccttggcacttaatcttcaagctctcctcagcccacacttgacccttaacaggggagacaaaggcagactccaggtaagttgtcagggttagcataagcagctcagggcaactggtgggtagggagctgtacagcccagggattgcagcctcttgttttgcatttcctggagtcaaggctaaactcatggtctcctcaggggtcaaagcaggcctgactttcagtgtcatcttcaggacacacacacgcacgcgcacacacacacacacacacacacacacacacacacacacacaggattatacatgcaactaaccaatcacacagagctggaccatctagcctggtagaaggtctgccgagttctgcgggtcaccatgaaccaggcttgtgagccctcttagtcatatgtaaagggctgtgtttgagacccggtagcccacaaagctcttttctgcccaagccttggtttttccgtatgttagtggggacagattggaactaaacagaccttgagtcttttcagggtcagtctcaactctcttagatgctagagggatataggcagggctagcacagaacagaagcaagaaatagtcaaaatgaatattttggactgcatagactcagaatgtgctttacttgggcacccagggcttctcagacttcagttgttttcattccaccattcccttcctccccctcctcatcaccagcagcagcagcagcagcagcagcagggcgcacagctctggggggaatcaggcactgggctgtggtggtaccgaggttacccctgaagtcctcacgcctccctgtgaggttgatagattgaaactaccttattttgagtatgaggaaatagaggcacagtgaggtccagagaccgcccaagagcacacacctaggaagctgagtgccaggtttcaaaaccaggtctccctgggcagggcagggcatggctgtgtttgaaccactcaggtctcctttgtcatagttgacagcactagttacttgataatgtctttttaaaaattaatttacttaaaaaaacttgagtgctattctaagcaatgtgacatcgtggatttcttgggctagttatatattttatgatgttcatcaatgtacaattatgtaaaagttgaatgatcaagttctgcctaagaccatctcatgtaccagcagcgaggttagattcaaatagaaaaaagggatctggtccaagatttgacacggattcactgtctgtgggaccccttgctagggcacttgatcatctgggtcattaaatctgggggccaggcacattctcattcattcgagacgagcccatcctcttccagagcatgggggcttcttgaaaccctgtcctttccaggcacacactgaggtggggagagggaccctggagtcagaccacctggctttgaatcccagctgtctcctctgagctgtatggcctaaggcaagtcatttaagcttcttgtacctcagattctccaactgcaaaacggagatgataataggcagaagcctcgtggggctgtgagaatcgagtctgcatatgtaaagcactgggcactgtgtctggaggctgtgagcaccaagcggctctaatcattcccgttttacaaaggaggacagagagactaaggaganaaactctttctcatctctcgttgtgtgtcagtgcaggggcaggactaaaagctggtctgtggtctgcaagctttaggggttacagagtccccaggaactcctaggaaattcagctggcggctaccttccaccatccccaggttctgattcgtgggcctggggtgggacccaggaatctgcatttcagttacttcccaggggattctgatgcaggtggtgcgaagaccacttactgagaagctgcaagctgggtttgagaggtccctacctccttcttccttccccgagccccacccgcccccttctttccactgggcaactatgtaaacagcattatttctacccttgcacggacagaaaggggtctgtgctgctgcctctgttggtgcctcttcaggtcagggtgataagaagagaaggaacaaagaggggaaaaagatcacagcagagagacagagtgctcattttaaggtggaaatatgccatttcctgaccacagcgggacttccctaggttgtattaaaaaatcctgtactgcccatgtctggtacagaagtatgtatagaattgtagagaaaatgaacactttgggatgatttgaaagcaaattacagaactaccagtttcaccactttaaaacttttggggaatggccatttagatataacctggtgcagtcaggtaaccccaaacagagtttttaaaagtttccacacccttctttgctggtgcctgccctgcatcatgctgtcgctgtgaggagggacttgttccagatctctggggcagcccgagtgactcacctaaagtcacacagcttccacggaacattactggaagctcagtgagggccttctgcctctgaaacttgctctatttccctcaagtcctgcttccttttgtaggtttaagacattagttcctgagaaattgactaatcaagaatattctggaaatcttagtttagcaaaacaaaaaacaaaaaaaaaaaacaaaaaaacagatgggtaaagccatgttccaaggcattcactgtcctggcttgggagaagaatgatctcccaaaagctcagaaaacatggttgtctaaaagtgtccaggctggcctctgggtgatccttgtgcacggccagggtctgtggagggtctgtggtgcctctctggcactgaagctaatgtgggagctggctctaattgcacattggcctaaagcaaccagcaagacctgcaccgtctc

SEQ ID NO: 238749 - DNA, 303 bp, Homo sapiens
catttcattttaattgatacctctaaaaatcatctcttcagcccgattgtattttccagacctgacctttgagtcagaagagagccaatttgcaaataaaggggtgtctcatggctgcctgctgagggactgttcataagcctttttgtgagggtgattcaatagctccattctggtacagtgagtcctgcccgttttagccatttgcctataactgttttactgttctgtgaataatttttatttatcttaatattattttcatgcataataactataataaacaaccctgtcagtgcctcc

SEQ ID NO: 238750 - DNA, 413 bp, Homo sapiens
attaagagaggccagtgtggtgctcttaaaaatagtttcacacacaggactaaagaaagcagaggctgaactctggatctcctgaggagctcactcacagccaccatccaccaatgttggccgtgccgcacactgagataaactctttaactaagttatcttgttcaagcctcatacatcagctttgcgaggcaaactctgtttttattccttttggcagatgagaaaattgaggcttagagagcttgtctgacattcacaaggttacagggccaggacctaaatgcagaactatttggccaccttactcctccccatctatgcaacttagctgagtagtagtttctctagaccagtcacctcactcatcactatccctgattggcactgtagtgattacaaattgttttttg

SEQ ID NO: 238751 - DNA, 195 bp, Homo sapiens
caggcaatcaaggaaaacttgccaagaaatatgagtgaataaatgattttgaaagtttcattgagcaggaacatgaaaaggatgatttggggatagctggaaggatagttacttgcatgaataatatttattcaccgtcagtgtgatatttctcaatagaaagattgtatttaaaatgtacaactacaataacag

SEQ ID NO: 238752 - DNA, 482 bp, Homo sapiens
aaagggaagtagagagtgttccaaggaggaatagcgtgtgtgaagaaatgatgatgtgtctgtgaatctgtactgaagtgtaggtgtggggacatgaaattggagcggtcagtagggatcagatctcgagggtcttgcaggccaccctaacggtcttgattttatgctgcagaaaatgaggacttgctgaaagattttaaccaaaggaatgtttggagatatttgcctttcaggggaaaaattaccctgacaacagtggggagtatggcatggggtgagttgcttctgggccaggaaaacaaagtgaagagaccattgtaaatataccatgtgattcagaatgagaattccaactagggcactagcaataagaatggagagaaaaggcaggagaatcgcttgaacctgggaggcggaggttgcagtgagctaagattgtgccactgcactccagcctgggtgacagagcaggactcatctca

SEQ ID NO: 238753 - DNA, 261 bp, Homo sapiens
tagaaatcagttacaagaggtactttgaaaactgtacaaatacatggaaattaaacatgcttctgaacacccactgggtcaatgaaaaacttaagaaggaaattttttaaaattcttgaaacaaatgaaaatgaaaacacaacataccaaaccctatgggatacagcaaaagtagtactaagagggaagtttatagcaataaatacctacatcaaaaaagtagaaagatttcagataaacgatctaataatgcaccttaaa

SEQ ID NO: 238754 - DNA, 647 bp, Homo sapiens
ctgtctcctatggcagccccttctatccaatgcaagagctaacatccacctccttgtccccccactccctgcccgccgtccccagggccccccacctggcttctaacatcacctttaagagccctacacggtatccctgatgcctcagccactgggcagccctgcagcaacgtgcagaaaatgatgcaatctgcagaaacttctcaacttctcatttatatctaaaagcagactgttctcaaaaaaaatattttcaaagcctatcatgcagacaaagggggagtgcgtttgatgtgtaaagacctacaagtaaataagaccaacagcctaatagaaaaataggcaaattatttatacagacagttcacagaaaatacaaacgactctaaaacgtgtgacaagatgttcaacctcactcataagataaatgcaaattaacacaacaccgagcaaccatttttcaattaagagattggcaaagtttggaacattcctggtgggagagcaagttggtataaaccctactgagcaatatctaccaggatgcaggagccctttgatgcaacaattccactgccaagaatttctccggcatttatacccacacgagtggaaaccaatgtgcaaggaaagtcattgcagctttg

SEQ ID NO: 238755 - DNA, 828 bp, Homo sapiens
cactaatatcatggtgatctctttacctgagtacatatggatcttgcatcccttatatagctttgtaatattccttaatatgggtggactatattttaatagttctgtattgattctaatgttgcgctattaggcagtattgcagatacatccatgtgcatatatctttgtatgttggtgtttatatctgtagtgtagattcatagaagtaggatatagctcagttttaacacaaagccctaaatgttggcattataatctaagatattgacagccattgaaggttaattttaatttttaaaattaaaatagaagaaaacacatggagccaggtgtggtggctcacacctgtggtctcaactctttgggagactgagccaggaggattgtgtgaggccaggagttcaagggtgcagtttgatatgattgctcctgtgaattgctactgaactctagcctgggcaatgtagcgagaccctgtctctacaaaaagacaaacaaaaaaaaaaaagaagaaaaagaatgatttggccaggcatggtggctcactcctgtaatcccagcagtttgggaggccaaggtaggaggatcacctgaggtcaggagttcgagaccagcctgaccaacgtggtgaaaccccatctctactaaaaatacaaaaattagctgggtgtggtggtgggtgcctgtaatcccagctactcgggaggctgagacaggagaattggttgaacctggtaggcggaggttgcaggttgcagtgaactgagatcgtgccattgcgttccagccagggtgacaagtgaaactctgtctcaaaaaagagag

SEQ ID NO: 238756 - DNA, 331 bp, Homo sapiens
agtatttgttgcttatgtgtaattcatatttaactgggtatcctgtatttttacttgttaagtccggcaaccctagcccaggctttctcaggttttttttaacagggatcccaagctttttctattggtttgagagcctgctacacaaataatatgatcttaacaattgaatagttatgttaagagtgtagttactgcagttagactgccaaagttcaaatcactgctctactacttcttaggtgtgtggtcttgaataagttttttgacctctctaagcctcagtttcttcattaataaaatgagttgcatggcttatatgaaataatgc

SEQ ID NO: 238757 - DNA, 427 bp, Homo sapiens
ctaattgcagtgtcccttacaagagagaggcagagtgcaattacaaacacaaagaggagaagcttatgtgaagatggtgtttaaaaggccacaagccgaggagtgctagagcatgctggcagccaccagaagctggaagaagcaaggaatagattctccctcagagcctctggagggggaatggccctgctgacaccttgattttggtcttctggcctcagatctgtgacagaatgcattaccaccgaatttgtggtaaattcattacagcggccataggaaactaacacagccttatatcagaatttacttaaaatggatcatggacctaaatgtaaaacctgaaactgtgcaacttctagcagataacataaaggaaaaattttgtaaggctgggttaggcaaagatttcttgcatatgacacca

SEQ ID NO: 238758 - DNA, 504 bp, Homo sapiens
ggcacaaaggcccagctttcccatctaatgagacaacttccaccgaactcacaacaccgtaaaccttctagagaccaaggcaacgtgcacccagaaaatgtttggatcattctctgcctagactaatttagagggaagattctcagcgaatccagcccccaacccttgattgtctccggcaaggatgttaggtccccctgtgcttcaacatgtttggaacaagaaccaattcgtttgttcctaacgtgacacctggaggaggcagagtcgctgtggatgccacgccacctcgcagccgtgacagctaatgacgcctgcagtccccaccatggtccctgcctcatcctctgtgccgttgtcttgtgtgttccatttatatgaatggcaacaaaagtagaaaccaggaaagcaaaatggcttcagtgaggctgttttgttttgttttgtttttcttcttcaacctgggaaattcaggtcaataaaagtgtaacagaaagatgagaa

SEQ ID NO: 238759 - DNA, 379 bp, Homo sapiens
agcaggaaggctgtgtctcccttccccacactgtattccaaccagacagctcccttctattttatatgttgggctagtatgaaaaacaattctgctaggaaagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaacctt

SEQ ID NO: 238760 - DNA, 423 bp, Homo sapiens
ggagatgagactagctgatccaggaggcaattatggattctggttaagagagctcaggctttgaagtcagactgtctggattaagatcctggctatgtttcctcttagtccatgacgttgaacaggttacctaatccaagctcggtaacaatcatagctcctaccgcctgttgtaaggattttaaaaaggatcatacatccttttgacccatggaaacaatgttttttctcttctagttacaaatttcagtaactctttttcctatacaaataggagatacagaggaaatcctctcagtgagaaattatcattcccttcctgcaccccctgtcagttcccattttgacagcattttgttattgtcattgatgacattattaatatagaagcaggaaaaaagctcaaatagatttctttcatcc

SEQ ID NO: 238761 - DNA, 574 bp, Homo sapiens
aggtacagttaacttacagtgtctcacttacatgcgctgctgaggtgaaggtgtttaaaatcaataagtgtaagtagtttccctggaagagagaagtaaaacgtaccaatcactcagtgctggaatatttttatgctaagcataatttccttctttagtagttagagcagttttttaaaaaaaaatagttaacacgatgcagaagtcaaacagcatgattctgtttccgtattttcctcactttttggtatgctgcggcacatttagaacatgatctgtctggaggttttattcacatggtggcctgcccttcagggagaacttgcttgccttctttctttggcagtttggatttgacctagccctgtggtatgtgcaagtaggaacatctacaaacggttaactctttaagtcttcctacgatttatgttcagttcattcacacacacacacacacacacagacacaaaagctttgattgtaattatgaacgtgaattaaaactgtttcaggccatcagatttatgtaaaagttaggcttgttttgttcattttaataaaagaatagtgaata

SEQ ID NO: 238762 - DNA, 859 bp, Homo sapiens
gtacagccggacaacaggccaatgcccccgactcttctccctgcacaatgctcctgctcctgtccctctatttctacctaactcccctgcccaatggcgggaggccccagacactgcaggcatggtgggggccaggaacctcgttggctggagcatgtttcctggtgatcctgaggcagcggggccaacaccccagacatctggagccttggtggtccagaccaagacggatgcttccctcagctacccacccaggctctctcttctggagctcatttccggtctgagaaagaaggctcttaattcaactcctgatacccgaatgacctcagccttcaagtgacctggcacaaccctccatgaacagtttattcaggcgctctttccagactcatttgctgaaccccccctcccaaatccccaagaccccatcaatgcctggcactgtgccctgaggcactggggtttgaagatgaatgagtgagaaccgagaacctgctcacatgaagctcataaccaaggggctgagactgcctggtcacccccaacgctattgtgtgggaccagtgcaggacagagatggacagacagaagtcaggaagaccagggtctggtctcaagcatgggggagaactccactgaggacgcccaggatggagaggtccagacgtatgccctggagtccagtatgtatacccccaactccatcactgattagagcctgtttccttgtcaacaaaatgggactaataatgccttcctttgcaaagctattgtgaggctaatacgtcatatgtacatacaatgcctaacgtggttactgcacacagtaggtactcaataaatagagctgttagta

SEQ ID NO: 238763 - DNA, 812 bp, Homo sapiens
ctcccctaggtaggcttctgagcttccaccagggctcatggccctgtcctggtaaaccagctgccctgggaggcctgtgatcttaggccctttacccgggtcctggctccccagctcccctctgtctccatgtagggccaacaccccagacatctggagccttggtggtccagaccaagacggatgcttccctcagctacccacccaggctctctcttctggagctcatttccggtctgagaaagaaggctcttaattcaactcctgatacccgaatgacctcagccttcaagtgacctggcacaaccctccatgaacagtttattcaggcgctctttccagactcatttgctgaaccccccctcccaaatccccaagaccccatcaatgcctggcactgtgccctgaggcactggggtttgaagatgaatgagtgagaaccgagaacctgctcacatgaagctcataaccaaggggctgagactgcctggtcacccccaacgctattgtgtgggaccagtgcaggacagagatggacagacagaagtcaggaagaccagggtctggtctcaagcatgggggagaactccactgaggacgcccaggatggagaggtccagacgtatgccctggagtccagtatgtatacccccaactccatcactgattagagcctgtttccttgtcaacaaaatgggactaataatgccttcctttgcaaagctattgtgaggctaatacgtcatatgtacatacaatgcctaacgtggttactgcacacagtaggtactcaataaatagagctgttagta

SEQ ID NO: 238764 - DNA, 446 bp, Homo sapiens
taatcctagatcaatgatttccagctttgtaactttgggcaaattctcaaattctctgtagaggttataaaattatgctagacatggtaactccctcatgttgctgttgtaagggctaacacgtggaaagcctaagcaaactagaatcataataaggattcagtaaaatccccaagaaaactctagagatgctggattctgcccttatccttctgttcctgccatgattttaatatttctctgtgagctttgctcgggtccaggcaccctaggctcacttctagcaaataattctgaaaaataattgtttacttttttctctcctatcaaaccctaggttccttaaagccacagaatgaaatacatcttttcttcttcccagtagtctgagcaatatttggcacattatagaaacttaccaaatatttgttaaataaaaatgaata

SEQ ID NO: 238765 - DNA, 574 bp, Homo sapiens
tatatcaatttatggccaatctggtttcatttataacatcattcgctcattcctaactccctggattatttgattgacatgtttctaaagttccttttaatctgtaggttccccctctcatttaatcttttgcaacttattcattgatgaaactgggttatttgtcctttattgtttctctcattctgaaatatgctgtaatgtcattaaccatattcttctttcctgtattttctgtaagctttgagctaggcagaaatattttaatcagattcctttttttttcttttagcaagatttcttcataaataatattgtatgtgttcatgaaaatagaaataaaaatagaaataaagaagaaataacagaaaaaggacagaaattgttaaaatttttttatgaaaacagatagtaaataacattgtaataaatcccaacagaacatagagaacctgactttattgacgttagtgggaggaggtttgtgattttaaaactatatattatggttatgtcatctaaaaatcaaatattcaagcacatatattaaaattagtcatcattacatttttcc

SEQ ID NO: 238766 - DNA, 205 bp, Homo sapiens
ctgtctccctgatggtgcatggaaaggacgttggcatctggcactatcaccctgacagtgcatggaaaggacattggcatccagttggcactccttctcccttattcaatattaggtttgatttgccctttgccgttgtttccaaagatcaaggaatgtcaataacttttttttttttttgagacagagtctcgcattgtagccc

SEQ ID NO: 238767 - DNA, 2095 bp, Homo sapiens
tttcagattttaccatggaagatttaggtcaggtattatttcctgacaacaagagttgttaaatcaatacctacatacattaccaagagaattatcttttccaaaggtctttaaaaatgtagtacatttttttttctctgtaattgtttaggaagcagtgcttcctgaaagaccaaaccaagatttttgcattatgtggctttgcacactagatgagcatttaataagttcaagcttaatttaaaaccatgatgacacaggtgtgaatgtcatttctctgaggagttaaaaatacaggcattgtcatactatcatacactctggaaaatggtattacatatcataaaatgttatggcttgggtagaaattgtagtttgctcttttaaaagctttagttaaattttgctcatttgttttgcaaatgattctttttaattgagtgaatcagatgcttttcagttcattgaaaatccccctttgacaaatcatgttttgatgagcttacgttctgtttctgggttcagcttctcattttagttgtcatacaaagcgttggcttatattatggttaagtatgtgctttattggaggttttgcattaccttatgagaaattatagagtgtttgtgggagaggcgttatgatttgttttaatttttttcaggatataatctaactaccactagggataatgtgtagtggtacataattatatacattatgttatatgtatgctatcctgtgaggcatccatcattggtcactgtcaaagacaggctgttagagtagatgggctattggactggactggtggtggcatgcccatgttttaaaaacaaatatttgtacaagttatttgaatttatgcaagaaattaatacagtgttatgttggagatttaatagcataaaagacaagaggttttttttttcttttttctttttttacttttggcatagctataacccctttgtatgtatttataatacactctttcagtatgagattatatattagtgtatgcagtcacacagaatgttatatatgtaagataaagagattatagataaatattttcctgaatattatttactacataatctgtcactggcccaatttcatgtgatcatgtaatgaaagatccttctgcagttaagcctattagggctttaaccctaagtctcctgaatatattttaatttctatttccaaattaatgttatattggtatggtataatagtatgtacttattttcttttgggagggatataattatattaaaaggcaatacaattaacaaagatttttcacactggttaaaggcaaagcaagagatgtgatggaaagacatgtgaagctgggttattatactcattacataaacatagtgatcttcttcctaaatgtggttttaaaatttatccttgtgtccctttctttacaacttagatagaatgcatatgttgaaaagaaatgtgtaggctgtggaaatactggtagcagtagccagcttttagttaaagttagtagaaggagggagagaaaaagagagggtgaatacacatttccgtacaagttacaggattatttgctttttattaaaatatattaaaccttcagaaatttgggctgaggatagaggatattctgattatggacttatttttattaaaagttaaattttatggttaactatccagagtaactagagtaggttaatgaaatggcaaatagaggaagagatttcttttaatgaaatgaaagaatggcaactagtacgttaactatttcagtatataattcttaaaaatgtacagttattaaaatgaattattccgtgttctatttttaaaggctatcagatgctaattagtgttattttgttttactatttaagtattaaatgaaataatgaggtcatagagctttggatttagacagactgcttacaagcccaatttcttcattcaagagcagtgtgacatcatacaagttactttacgtttttatgcctcagtttcctgcatctggaaatcagggtaatagtttatgttggataaagctgatttaaagattaaatgagatattgtgtg

SEQ ID NO: 238768 - DNA, 2074 bp, Homo sapiens
  misc_feature (1447)..(1447): n is a, c, g, or t
  misc_feature (1879)..(1879): n is a, c, g, or t
  misc_feature (2005)..(2005): n is a, c, g, or t
tatttctttgttgtctcttttttattttttagagacagagttttactatattgcccagactggtctcagactcctggcctcaagcgatcctcccacctcagcctctgagttacaattgtctcttgaaagtaatttcaggtaggcttggggctaccaaggcaagcctagggaagcctactacatgaagaggattagagtcctctggagaagttggattcatatgaagagatactaatcagaaagttgggagttagtcatccatggaaaacaggcatgtttgagaatcatattctggcagtgcccatccatgcattatcagtggagagagaaccttggctaatggacttccccagttttgatcccatggataagaccatgggggagagggtaaggcttaggctaatgcatattcttggatcattcagtcacctccttccactctgagtccctgttgaccagggaatgtcttggtgtcatagcttggctttccaatggctctccccgtggggaaagaatacacaggctgtgttgatggtattctagtcctgacgagagctgcgtttctcatggtcagcaaatgaattggcatccgatatataagcaaatcttgtgactgtaaagtcatatactttcttgttagttgagggaatcagatttctgagggtaagaggtgaagccaagaacatggcaaattcattatcttgataaaaactacccggtaaggctgcccattttctttcaaactgcaacaccatatgtccagcgaggttcctcttacgagacatcaggggtatcaggagtgggtgccaagctggagtcctgagaatgagggaaataggagaccatgagttttgagcaccaccgcaatttctcttctccttttgtccctcttgctttaggtagtaatgcatgccttaagataataaaaggtctgtctttgtgggctcttcattgccatagaaaaatgattggtatgagtttcccaaggcctcggataaaaatatttcttcagagagggttttgaaaacttatgccagttacctgggtggactccaatctttcaagcactgtgtgtcttttcctggtcctccctcgctccctccttcctttccttccttctctaaacagagtctaaggtaatgcccctctccagtttcttgggatagggaagggggtggaattacttctgactcacccttacccttatggtgtaccctttggggttctggctaaaatatatgtattgggaagtgggacgcagtggctcacgcctgtaatcccagcactttgggaggccaaggcgggtggatcacttgaggtcaagagttcaagaccagcctggccaacacccatctctactaaaaatgcaaaaattagcctggtgtggtggtgcatgcctgtaatcccagctactcaggagactgaggcatgagaatcgcttgaaccngggaggtggagagggtggtgagccaaaatcacgccactgcagtccagcctgggtgacagagcgagactctgtatcaaaaaacaaacaaataagtaaaatatatatattggggtccattagtttttccaccctgggtggactctgacctttgacttctgtcatccttgccccatgaagccatcggaactgcagctcgttttccgctttttcatcgccatttctttcagctgacaaatgctgtttacctcactggcttctcctttattcttaggttttggcctgacagttgctatttttttttttttttttagctctttgatacttttaagaaaatggtttttaggccatgcacaggggctcatgcttgtaatcccagaactttgggagaccgaggtgggtgaattgcttgagctcaggagtttgagaccagcntggccaacatggtgaaaccccgtctcgattaaaaatacaaaaactagccgggcgtggtggcaggtgcctgtaatcccagctactccagaggctgaggcaggagaattgcttcaacccgggaggcanaggtggcagtaagccgagatcgcaccactgcactccagcctgggcgacacagtgagactccatctcaat

SEQ ID NO: 238769 - DNA, 403 bp, Homo sapiens
gcaaccatgtgttctgcaaattctctaatagggttagtttcaaatactgtatcagtcttgttaaatccatacatcatctaaatgacctggaaattgtcatgatcttgcattcacattacatttcacaggcgatctttcctacccagagtgacatacagaaaatattcattagaccttgggaattaatatggagaaaatattatcagcatatgtcagtgttcactttgtaaacagatatcatttaaataatttttggtaaagctagtggcattggcaatatgttaaaactcttgcataattttgtaaaaaaaaaaaaaagtctaatttttgtagatgaacactgaaatgtatgggggtaaatgttatagtgtctagatttgtgttaatattgccacaaatgaat

SEQ ID NO: 238770 - DNA, 484 bp, Homo sapiens
gagacagagtcttgctcagtcgcccaggctggagtgcagtggtgcgatctcggctcactgcaacctccgcctcccaggttcaagcaattctctgcctcagcctcctaagtagctgggattacaggcacccaccaccatgcccggctaatttttgtatttttagtagagacagggcttcaccatcttggccaggctggtcttgaattcctgacatcatgatccacccacgttggcctcccaaaatgctgagattacaggagtgagccaccgcacctggccagattcattcattcttattcagtgctgtgtacttggggaatcttctggaggagagggacaaaaagggaaaaagccattttttctaaaataaaccggaaacattcaaatttggaactgaagctgattctgggtggggagggatgattgcaccaagcatcctaggttctgttctggagaatatccctgccctttcctgcgtcttctc

SEQ ID NO: 238771 - DNA, 1618 bp, Homo sapiens
  misc_feature (21)..(21): n is a, c, g, or t
  misc_feature (855)..(855): n is a, c, g, or t
cagatatggtgatatccttanttctggaattcaaatcaccagttaggggtaccttctcaaataaataaacataatagcactttacgtgtgaataaactcagagaggccctgacaaaccagggttgggctttgcttgggggtaccaacaggcatctactttccatttctattactgtcttgatgtttcttagaattccatcctggaatgctgaccctcaatgagaaggataaattaaaactttattaggctcatttaaatgtcaattaacaaaggatgttcttttttagatcatttaaatttatttcataagctagttgcccaaaagctgctctgctgggcactcatacaaaattattttttaaaaatatacaaattaaatagcagaagagcaagctccccagaacagaaagaaaacaagcagtgctgatcaccatctgggtctccttttgggaggcagaacccaaggggaaaatagaccacatcccctcctttggacgcaatgccaatgcctagggttttgtcagccctggagagagagagagagggagagcgcaggtgcaaattcctcctgtcaatgtaagaattctgtgcttttgatacctccaagagcctctctctgcagaaagtatggaaaatatcgcactgttaaaataacaaatgcagtcagaacaataagaaatacaaaggttcatacctaaggtgtgaaataagaatttacttgcaaactataaggaaggagcacaacaagacagcagatgctaaaagcaccaaagaagagaccaggtcatttgagctgtaatagtttaaagtttggagtgaaaggcctatggaaagaggtaggactacacttgacntttgtagtgcgtgtttgttgtttcagcctgcccaggatcccaccccttattctgaagacagtacctaggttttctattgggacctaccctactcctacttttaatccaaatggcttagataaggtggaccattcccatccttggatctagagagtggcatgtcatccagccttggccagtcagagtcactgtggcttgtgcagggatgggcacatgagctaatcagagcagatgagagtcatccccagacttttgtcagaactgctgggaaagcctatgcccttccagtgggcattgctaagctggtacaatgcaagcctgatgctgtagtggacatccttccaccatataaagacagcctccctgggaaagcagagccatgaaacggagaaagacttcttactaaatccttagagcactagatccagcattttccatctgctatcgctgcatgacaaaccaccttaaaatgctttggcttggccaggtgcagtggctcacgcctgtaatcccagcactttgtgaggcagaggtgagtggatcacctgaggtcaggagttcgagaccagcctgaccaacatggtgaaaccccatctctactaaaaatacaaaaattagctgggagtggtaatgggcacctgtaatcccagctactcaggaggctgaggcaggagaattgcttgaacccgggaggcggaggttgcagtgagccaagatcacgccactgtactctagcctggatgacagagcgagactccatctc

SEQ ID NO: 238772 - DNA, 1650 bp, Homo sapiens
  misc_feature (21)..(21): n is a, c, g, or t
  misc_feature (855)..(855): n is a, c, g, or t
  misc_feature (1627)..(1627): n is a, c, g, or t
cagatatggtgatatccttanttctggaattcaaatcaccagttaggggtaccttctcaaataaataaacataatagcactttacgtgtgaataaactcagagaggccctgacaaaccagggttgggctttgcttgggggtaccaacaggcatctactttccatttctattactgtcttgatgtttcttagaattccatcctggaatgctgaccctcaatgagaaggataaattaaaactttattaggctcatttaaatgtcaattaacaaaggatgttcttttttagatcatttaaatttatttcataagctagttgcccaaaagctgctctgctgggcactcatacaaaattattttttaaaaatatacaaattaaatagcagaagagcaagctccccagaacagaaagaaaacaagcagtgctgatcaccatctgggtctccttttgggaggcagaacccaaggggaaaatagaccacatcccctcctttggacgcaatgccaatgcctagggttttgtcagccctggagagagagagagagggagagcgcaggtgcaaattcctcctgtcaatgtaagaattctgtgcttttgatacctccaagagcctctctctgcagaaagtatggaaaatatcgcactgttaaaataacaaatgcagtcagaacaataagaaatacaaaggttcatacctaaggtgtgaaataagaatttacttgcaaactataaggaaggagcacaacaagacagcagatgctaaaagcaccaaagaagagaccaggtcatttgagctgtaatagtttaaagtttggagtgaaaggcctatggaaagaggtaggactacacttgacntttgtagtgcgtgtttgttgtttcagcctgcccaggatcccaccccttattctgaagacagtacctaggttttctattgggacctaccctactcctacttttaatccaaatggcttagataaggtggaccattcccatccttggatctagagagtggcatgtcatccagccttggccagtcagagtcactgtggcttgtgcagggatgggcacatgagctaatcagagcagatgagagtcatccccagacttttgtcagaactgctgggaaagcctatgcccttccagtgggcattgctaagctggtacaatgcaagcctgatgctgtagtggacatccttccaccatataaagacagcctccctgggaaagcagagccatgaaacggagaaagacttcttactaaatccttagagcactagatccagcattttccatctgctatcgctgcatgacaaaccaccttaaaatgctttggcttggccaggtgcagtggctcacgcctgtaatcccagcactttgtgaggcagaggtgagtggatcacctgaggtcaggagttcgagaccagcctgaccaacatggtgaaaccccatctctactaaaaatacaaaaattagctgggagtggtaatgggcacctgtaatcccagctactcaggaggctgaggcaggagaattgcttgaacccgggaggcggaggttgcagtgagattgcgccactgcattccagcccgggcaacaagagcaaaactctgtctccaaaaaacaacanaaaaaaagggttgaatatctcat

SEQ ID NO: 238773 - DNA, 392 bp, Homo sapiens
tagtggcatgccaaatgttagaactaaaattgaacttctggcttttctgaatattgtgggatctcaggttcctaactgctaagccacagctaaggctttttctcagaccttcagcagcttctctgctaaggttgacctcttccatgcttcattcctgacctgtgtcttggctctccaagccccagtattctgccttgaattttcatttcactgctcaccatagcccaggcagaaatactaagagaagtcaaccattaaataaaaagcaaaaaatcggagggagtgggtggctcacatttgtaatctcagcactttctgaggccgaggcaggaggattgcttgaagccaggacttcgagaccagactgaacaacatagtgagaccttgtctct

SEQ ID NO: 238774 - DNA, 701 bp, Homo sapiens
  misc_feature (673)..(673): n is a, c, g, or t
  misc_feature (701)..(701): n is a, c, g, or t
ggaggcgggagggtgggacttattaatgaggcttgtttccgagtccgggtagcagatacacgtgacatcagaaacatctcataatcacgaaagaaatcgaagcacgcgtgctctctcgggagggccctccttctgcgtgccagcccttgggatctggacttctggctcctggaaacattcaaaaggaaaccggtgggccatggaaccgctgacaggattggatggtaaaacagtgtcttagatccaccctcggtgcctacaagggtaacaggccacacccccatctcagagatggcagcgacctcatccaaggggcaggggaagcctcagaggagtgattttagcagcctctcacttcctcatttgcctgtgttcattgtcctgggcaaatcttcagccccagagacagtagtgtttattttagaaccaaacccgctggccaggacaccatccacgtgaaacatttcttcctaagcctgaagctttgttgtaaccctgttgtcttcctccttattggctcagcagtgagatgggctggcttgaacctccaggtcttgaaacctgcccaagataccaacaaccacctgtaataagcaagaggataggtagcacatgccagggagatgcgagatgaagccacaccacggctcaagggctacagtctgtgaaagancgtcctatagaccagatgggtctgtgan

SEQ ID NO: 238775 - DNA, 378 bp, Homo sapiens
cctttctccacatccgttcctatttctcagccatctcagtgacatccgccatcttgagagtcaactactgactggactgagttgtgtggtatatgcttctgtttacttctcttctgtcttttttaagtggccaaatagcaaacgcttaaataggaaatctctgggagacttgaataaaagactttgcttggtagaacagtaggattaggattcctgtctcctttcagattcaaatgcatctgtttctggggttaacagtggactgttaagaggctgtgcagcttgggttaagtcattcttatctctgggcttcaggagcttagaccagatagtttctacaggctctcttggtgctgatgccttgggattctgtggctg

SEQ ID NO: 238776 - DNA, 437 bp, Homo sapiens
catgaatgggcttagtgcccgtataacagacccctgagagctccttcgtcccttctccctgtgaggatgcagtgaaggcaagaaggtgccgtctgtgaaccaggaattgggccctcaccagacatcgaatctgccggcacctcgatcttggacttctagcctccagaactgtgagaaataaatgtctattgttacaacagccagaacgaactaagaccaagatgtgtttttgacagactctgaaggctatttatgtgctgggatcattgcaatctgttcttcacctttttaagagtgtgggatttcacttcctagatgttatcaaacaggctgcattcataattctggctaactatatgtgagtgatttctctgtacccagcaatgtgctaagtactttgcatggagtaataatatttctcttaataaacctatgca

SEQ ID NO: 238777 - DNA, 901 bp, Homo sapiens
aacagcttttggtaattttaggacaggtcttgcttcttttctttcagtggtcagaaaaagaccacgtttatccaagccctgtgcctatgctatagctctctaatcaagaaatgtttctttcaactgaccacggctcctaactttatctctctgtcctttgaagccgatagctattatttctaacgaccatcactaattcaagaataaacactctgttttctcccaaattgctacattctgttaaagggaactagaattaaaatcccaatttctatcagcactctattttatgaaagggtactaaagtaggatgccacaaggcttgagagcagaagcaaagcgtgacttctctgtgctccctgagtggccccttctcccactgtgacggtcaagtccacctacttacgggtgttctcagattgactctacgtggtgaatgaggactcaaagataaggactgctacctttcttttttctttttctttgtttgtttgggggcatggacggctactgttttttttttttcccctgtatcatcataaagacatttattctggaaaagatttgatctttgccccttatctggctggaagtaatttagacaagaaggggaccttgcctggggaggaacaatctcccccagaaccacgatgggggctgttttttcaggtttcagatgcagcctgtgactgtcttggttacgctcttgtgaaaaggatccttcctgcatctagaacttctacagcagtagggctttctggtcctccagacttccagaagcagaagcctcaggaaatgaggccacttatttagcttgttcatggccattggttgtttggtctatgtctcaccgcattggctgttgccttgctctgtgccccaataatacagaatgtaaata

SEQ ID NO: 238778 - DNA, 1977 bp, Homo sapiens
  misc_feature (481)..(481): n is a, c, g, or t
  misc_feature (493)..(493): n is a, c, g, or t
  misc_feature (531)..(531): n is a, c, g, or t
  misc_feature (535)..(535): n is a, c, g, or t
  misc_feature (779)..(779): n is a, c, g, or t
  misc_feature (1140)..(1140): n is a, c, g, or t
  misc_feature (1545)..(1545): n is a, c, g, or t
  misc_feature (1653)..(1653): n is a, c, g, or t
  misc_feature (1873)..(1873): n is a, c, g, or t
  misc_feature (1971)..(1971): n is a, c, g, or t
aactcctgggctcaagtgatcctcctgccttagcctcctaaagggctgagattacaggtgtgagccaccacgcctggccaagaagagagttttaaatgttaataaattggcctgtgataacactgaattatattgggtttcaagaaatcacaaaaaaagcaacacctccctgctgtcagcagctcatagaatggtgggctagacataaacgtatacaaggaaattgccacattgtaagaaaatgtcctattagtggcacatactcatggccatggaagagcaaagaagaggagatagaaagagatagggtgaaggggggaggacaggaaacccagtcaacttttagttcatgtcttttaaaataaggaagagactctaatcagaagttgacaagtgtcaccttccaatattgtgactttctcaatatcacagaggccagggttttaagaaaaatcactctgcgaagatgacactgactttntcttaatctccnctacctcatcttcccaaaaagattaactgaactaatanactncaaacttctggcctaacttccagtttacaggaaatcatgaatgagagaaactgaacagcctcaacaggaaacaatcagacacatcctccatgtgggatgtcctccaaggcaagtggcctggtctctttctaaagtcaatgtcaaaaaaaaaaaaaaaaaatcccaggcacagtggcttacacttgtaatcccagcactttgtgaagccaaggccattggatcacctgaggtcaggagttcgagnccagcctaaccaatgtggtaaaaccctgtctctactaaaaatacaaaaattagctgggcgtgttggtgggcacaagtaatcccacctactcggaaggctgagacaggagaatcacttgaacccaggaggcggaggttacagtgagccaatatagcaccattgccctccagcctgggtgacaagagcaaaacgccatctcaaaaaaaaaaaaaaaaaaaaaaagtgagagaactgttctagatgctagattaaacataaaagagtttaggactacaatatgaattgcaatgcatgagcactgtgtatctgaatttaggaagaaaaaatcgccataaaagacaatttggagacaactagatanatttaaatatggactggataccagatataatgagaaaattatcgttcatttttcatattttgaaatgttagtgtctttatgtacgagaatgcccttactattaggaaacagatgctcaagaacttaggccaggcacagtggctcatgcctataatctgaatacttgggaggctgaggcaggaggatcacttgagtctgagaccagcctgggcaacatggtaagatttctctctatagaaataaaattaaaattagccaggtgtggtggcatgtgcctatagttccagctacttgggaggctgaggtgggaggattagttgagcccagaagttcgaggctgcagtgagctatgattgcaccactgccctccagcctgggtgacatagtgagaccctgccttaaaanatatatagagagagagggtaagcatcatgacatctccttaccctgattaatctcaaactgttcagcaaaaaacatatatatatatatacacacatccgcataccttcncatacacatatacacacacaaatagagaaagcaaatgcaggctgggcacggttgctcacacctataatcccaacactttgggaggccaaggcaggcagatcacctgagatcaggagttcgagaccagcctggccaacatggcaaaaccccgtctctactaaatatacaaaaaagttagctggatgtagtggcgggcgcctgtaatcccagctactcgggnggctaaggcaggagaatcacttgaacccgagaggcgggggttgcagtgaacggagatggcgccactgcattccagcctgggtgacagagcgagatgantgtctc

SEQ ID NO: 238779 - DNA, 846 bp, Homo sapiens
agaaatgctgggctttgaaagcaccttagatgtcatcaactgcaacctctaaaacttacagactttggatggtgtcattagaagtcaggggccaagggactttaattccactggaagcagaacaagaagagaaacttgattctatgcagagctgacctccaggtggatataaattattgatgaggactcagcctgatgaatttgggggtaaacatggattggctatagatgaatcacagactttctctcaaccagagctcccggggctgggactctcactttccagatgaggaaacaaaggaccacagaagtcaagcaacttgccaaggtcaaacccaagttacagccagagctgggacgattcctgcggctgaccccttgctgggctcgtttccttccgcctgcccagccatctctggttttatctgatgtgtctgatgtcaaacgtcatgaatatggaaagcagaagaccttgttctgggttgacaaatgcttgcagttagggatttttttttttttttttgctcaagcttttccaacatctatcaaatgcacctgtggaatatgcaaacaaaattcctgctgcatctgggccgatctaatatatcttagaaactcagtgatcattgtatccttaaaacgggtttggaaaattaaataaaattttatccacagagagaatgtaattgtgaactgcctcccaaaatctaattgttttatttctcaggatatgggttatagcaccacggtgtgctacaaggaactcaccaattacagcttaaaacttccaggcttggccaggtgtggtggctcatgcctgtaatcctagcactttgggaagccgag

SEQ ID NO: 238780 - DNA, 495 bp, Homo sapiens
tgcaggatggccagagatgtctgccctcactccgctaccctctcagtcttctttgaccactctggtcccccaacctcaatgtcgaccccacatctgcaagtgacatcactgtccatgtagctctgtaagtcttcaaactgggagtcagcctacctcctgccatcactgaccttcaagcaatccagatgaaaaatgcctctgggcattttggggacaggagatataaggaatgagtcataaatatcctgtcatataaaataggatgctatgaaacactccccgggtcatgtcaaaaggagacaggagccaacctgaatacacttccaccagccaaaggcgagattttttgagcaccagtaagattaataactgcaatggattgacaccaatcagacatgtttaaatccactgattcacacatatttaaaaataactagtttttcaccttagggggatgctaggcagctggtaaataaagggaaagcattaaatatt

SEQ ID NO: 238781 - DNA, 443 bp, Homo sapiens
aaggtctcactctatcacccaggttggaatgcaatggtatgatcatagctaatcattgcagcctcaaactcctgggttcaagtgattctcctgcctcagcctcccaagtagctgagactacagtcgcacaccactgctcccagctaatttttttttttttttttttgagatggggtttcgccatgttgcctaggctgattttgaactcctggcctcaagcgatcctcctgcctcagcctaccaaagggctggggttacagatgtgagccaccacacctggctgcttcaccttaattacctggcatcacatgcttaaaataagggcatgccaaaaacacactgttcttgtcaatatacttcaaaataatgaataatacagcatcttaagatgtgtataaactcataaaaatcagaacaaaaaaatctattctttatatttttcc

SEQ ID NO: 238782 - DNA, 731 bp, Homo sapiens
tctcactatgttgtttgggctggtctcaaaatcctgggctcaagtgatcctcccattttggcctcccaaagtgctgggattacaggcatgaaccactacgcctggcctcactttctttaattggctacacagattttctgtttcatctatgtcagtcttggttgaatttttcaaggtatttttccatttcatataaattgtcaaatttcttttttttgttgttttttttgtgtttgtttttttgagacaggttctggctctattatctaggctggagtgcagcctaatctcagctcactgcaactttcccctcccaggatcaagccatcctcccacctcagcctcccaggtagttgggaccacaggcgtgcgcgaacacacccagctaatttttgtattttttgtagagatggcgtttagccatattggccaggctgtactccaactcctgagctcaagctgcccacccaccttggcctcccaaaattctgggattacaggtataagccaccacacacgcctggcccttaatatcttttaaacatctgtaggatccacaatgatgtcctctttctcattcttgagatttggggtttattttctctattgtctttttaatttttatttctgtttttgtttgtttttcagaccgagtttcgctcttattgcccaggctggagtgcaatggcgcgatctcggctcaccacaacattcacctcccagattcaagg

SEQ ID NO: 238783 - DNA, 445 bp, Homo sapiens
caggtcccaaaacacaaacccgaccccactttgttttcagcacagggacttggtatagaacttgtgagcatcaggtcccaaaacacaaggccaaggccatttccttgttttcagcatgcatcttagctatgtcaggcaatggttaaatagccaagcgtgatggctatttaaagatgtactagtatttaaaaaaaaaaattttctttgcccattttcaagaaagaaaaagacttccaatctgccttactttgctctattgtgtttacttatctggagctcttgtcacttcaatggactttttttatttatcacatgtattgtttagtatctatctactacaataatatataagctctttgaaaaaagtgtttctttcttctcttttcattaccagtttacccttaatgcagagaatagtggatggctcatagtaattgatttaaaa

SEQ ID NO: 238784 - DNA, 360 bp, Homo sapiens
taaaaatttttaaacagaaaagttaatagtcgtgtgaacaaccatattccttttctttttttatttttaagtttgtagctatctatctatttatttatttattttgagaccgggttataaggctggctaatttttgtatttttggtagagatagagtttcgccatgttgcccaggctggtcccgaactcccggactcaagcgatccaccagcctcagcctcccaaagtgctgggattacacctgagccactgcacctggccaacagccatattcctgattttaaaattgtgattgtgttttgtaattggtttatctatgcacatacacatacacaaatagattttgtttttgttctccta

SEQ ID NO: 238785 - DNA, 1991 bp, Homo sapiens
  misc_feature (246)..(246): n is a, c, g, or t
  misc_feature (1451)..(1451): n is a, c, g, or t
ttactttcttgcatcatacctcatttacctctttctcttctttatgtctgtctctgggatctcagggccccacactggcatgaaataaaggtgttttttatgcataactcatatgataataataacaacaacaagattttactgtctcctatccctttatgggagtacactatgcaatacctctatgaggtgccatcttaaattgtttagatgtaccatcttaaatggtttacccttagcaaaggncacctacacctttgattttatcttttcctgtgctaagagtgcacaaacttttcttatacagagtcaggaaaggctttggggtcctatatcttctctgtcacatttactcaaatgtgtctttctagggagaaggcatccaataaacaatatgtaaaccaaggagcatagttctgcttcaacaaaaccttctctgtacaaaagcaaaaggcagactagatttgctccatgggtcatagtttgctcttctccccaaactagtttatactttgagaatcccttatcatattgaaagacaagaactgaaggaaatacttttattttttaacccggtaagccctattttttaaattccattaaattatgatgataaaattagtaatttttgttgccattgttttgttttagctctctgtctctgcacattattatgagttattaaaataagtcagttaacactttcaacatcttgtctggaaaatatcctgccaatatccacaaatttattttgtgtgttttttaaattaatttgtcatgttatcgtaggcactttaccaattgttttgctactctatgactcagttgaccactttgccagtttgctatggcagttttgtcaccattatactacattatactaactaagaagctaatagtttccctgctgcttttccagcatttgctcaaagcttcctgacctcccaaagtcaatcttacatattttagactttaacccatctactcaccgaagattagttttctccagagaaaaacagataaaagcattctgcaaagtaatagaaatccactgttcttgttttgggagagggccttctacagactttcattaatattatttagcctgttatgacaggggaaatctcaaggaaaataagacctattctccttcaatgaaaacaaacaaatgaaaaaaaaaaaacccacaactctcttttagctggtgacatcaggacaaatctcaacacatacatacacacatacacagataaacacacatgcttttggtgtgtatgtgtgtagaaaagctccagcagtctcagcaaagtatatgcatactcttttcatactccctgaagagggaaattttaaaaaatagcaatataatagacatttttatacagctagatctgcaggaagaaatgcgtcaaactgcaataatgacgcgtagcaagagtgactaaaagaantatccagtggtcaggttcacaggcaaccacagacagaggtaaaaatctctgatgggagaatctttacaaaattggtcatcacgtttgcattagggcattgaaattcatgtcagcagagtgactctcataaaaacattgtattttttctctagatagataaactttcatcacaaattccctggttgtgtccccgttcatgccagttgttctagcattatggttggtaataatggcacttttattcccaaagtatttggatgataaattatatgggtacccaacccttaggctacatctgcttccttaacatagaaaatcactgactttctcacatattaataattttcaggtggataatgatgtatttcccctgcatatcacattattaatgtctaaataggaaaaaattcagcagctgtcaatgtctaataagttgatcacagtggccaggaaatgttgatggaatggttaaatacataaaagtcgtgcattattattactgctgttcagtgtattttcagtgtttgagccaagtactac

SEQ ID NO: 238786 - DNA, 375 bp, Homo sapiens
cgagtcagacttgagctcgggcgtagcggctagaccgggctgtggcgatagagtccaaaggtgaggctcccacccgcctctccatcttcctcccgcctcgcctcctctctgacagcccttttgtgattgccctgccgcagcttcgccctccacattcgccgggcgcggtactgactggtgcgccggcgggcggaagcgctgccagcaacgaggcggccgggaggagcgtccccagtccagcctgccctccgcctgcgtaaacgctagcgtttctctttttgtaattaaagtgaaattcacataacgtaatattgaccattttaaggtgaacaattcagtggcgtttagtaaatttacaatgttgtgcaagcacca

SEQ ID NO: 238787 - DNA, 349 bp, Homo sapiens
gagatattataaaactttgtgctcaataaaatgtttcactatacctgatgatttgaatacatacttggctgtatgtgctaagccatacaaatatttttggagtaaaaattataaaggaaagtcttaaaataatttcagcaagtctttgtcttcataggtataacataataagctaacaaccacaaggtattgaatgatttcagtatttagatggaatcacttactactgtccacttaaatcctgaagaatggatgctaaatgtaacaatatcatttaaatatgtaagctattctttgtgacaacagatagctaaataattaaccttattcttaaagccaagtctattca

SEQ ID NO: 238788 - DNA, 300 bp, Homo sapiens
aaaaaaagtctcagtgcttctcaaactgatttgcccatgggagcttttctccccccgaggagcaccagctacatcctgctgtgttagtggggccatacacaagtgggccctgtcgtgggcaccacggctgacacctgtataaactttacctcattttgagcttttatgtctgtgaataaaacacacgtcacagcttggatcacacacaggcgtaactctcaggtctgagctgttctctctcttggtcccaccgctgtggttcccagccccattcagcgaggaggtttccatctgtctgtg

SEQ ID NO: 238789 - DNA, 752 bp, Homo sapiens
gatcagtgtgtgtttatggttcctgatcacacacccgtctaggtgtgaccgtaaagtaacaagactggcttgactgtgtcctgtaaatggactcaggattgttcctaaaggggtgtctgtgtgtgggatggctggcagcagcctgcacacagccggggctcatttaggaacttcctaaaccatggtctgggctgaatcttgggagctgttggtggagtctagcgtcttctccaaaggcttgagaagtttcttactccctgtgccttagatccaggtggcgacctacttgctgccgtcctggctttcttgccctccctgctccatcttccttcctgtggtctggagtggtcttgccactccagtgctccgaaacccccatggcccccactgcctgcagagccccgagatcctgcccattcgtccagtcacacatgctcactcaagcagatacaggtgcaggacagcagacatagaccatgttcgccaacatgttgactgtgcatgtggtctctaagtgataggattactggtgagctttaggtttcctttttctaaattgtcttcagtgactgtgtatgtgctgcttttgaaatagaggggattctttttttttttttgagatagggtcttgctctgttgcacaggctggagtgcagtggcacgatcatagctcactacagcttccgcttccgggctcaagtggtcctccaacttaaacctctgggtagctgggaccataactcatgccacca

SEQ ID NO: 238790 - DNA, 699 bp, Homo sapiens
gatcagtgtgtgtttatggttcctgatcacacacccgtctaggtgtgaccgtaaagtaacaagactggcttgactgtgtcctgtaaatggactcaggattgttcctaaaggggtgtctgtgtgtgggatggctggcagcagcctgcacacagccggggctcatttaggaacttcctaaaccatggtctgggctgaatcttgggagctgttggtggagtctagcgtcttctccaaaggcttgagaagtttcttactccctgtgccttagatccaggtggcgacctacttgctgccgtcctggctttcttgccctccctgctccatcttccttcctgtggtctggagtggtcttgccactccagtgctccgaaacccccatggcccccactgcctgcagagccccgagatcctgcccattcgtccagtcacacatgctcactcaagcagatacaggtgcaggacagcagacatagaccatgttcgccaacatgttgactgtgcatgtggtctctaagtgataggattactggtgagctttaggtttcctttttctaaattgtcttcagtgactgtgtatgtgctgcttttgaggctggagtgcagtggcacgatcatagctcactacagcttccgcttccgggctcaagtggtcctccaacttaaacctctgggtagctgggaccataactcatgccacca

SEQ ID NO: 238791 - DNA, 543 bp, Homo sapiens
gaggtgggatgatcgcttgagcccaggagtttgagaacagcctgggcaagatggtgagagcccgtctctacaaaatgtttaaaaattagccagatgtggtggcctgcatctgtagtcccagccacttaggaggctgaggcaggacaatcacttgagcccaggaattcaagatggcaacgagctatgatcatgccactgcaactcagcctgagtgataaagagaaacctcaactcttaaaaaaaaagtttgtggctgggtacggtggctcacacctgtaatcccagcacttcgggaggccgaggcaggtggatcacctgaggtcagaagttcgagaccagcctgaccaatatggtgaaaccccgtctctactaaaaatacaaaaagtagcagggcgtggtggcgtgtgcctgtagtcccagctacttgggagtctgagacaggagaattgcctgaacctgggaggtggagattgcggtgagtcgagatcgcaccactgtcctccagtcctccagcttgagcaacagagcaagactccttctcaa

SEQ ID NO: 238792 - DNA, 654 bp, Homo sapiens
gaactgaagttctttagtttaatgaaatcaaatttatcaatattttcctttataagtaggactttttctgtcttgttaaagaaattcttccctaccctgagatcataaaattttttctatattatttttagtagtgttatattttgcctctcacatgtaggtatttaatctacctgcaagtaatttttatacataacacaaaacaggaaaacaattttctttttctccacatggatattctattgtttgaatttcattttttgaaaagagtttcctttccctgttgctctgcagtgtcatctacttcatgtgttaagtgtctgtgcttttctattcgtctacttggttatcctgtcaatactatgctgccttaattatttcacctttgaaaaatatgtcttgtcttggccctttgcaatcttacataatttttttttttttttttgagatggaatctctctctgtccccaggctggagtgcagtggcatgatctcagctcactgtcacctctgcctcccgggttcatgccattctcctgcctcagcctcccgaatagctgggactacaggcatgcaccaccacgcccagctaatttttgtattttcagtagagatggggtttcaccatgttggccagggtggtcttgatctcct

SEQ ID NO: 238793 - DNA, 206 bp, Homo sapiens
ttaggcaagaaataggaaatagaaggagaacgataagtcaaagaaaagggcttggccctacataaaaaagattattaaggctaggtgtagtggctcaggtctgtaattttagcacttggggagccaaggcgagaagatcacctgagctcaggagttccagacatacttgggcaacatagtgagaccttgtctctacaaaaaaatta

SEQ ID NO: 238794 - DNA, 1934 bp, Homo sapiens
  misc_feature (183)..(183): n is a, c, g, or t
  misc_feature (303)..(303): n is a, c, g, or t
  misc_feature (454)..(454): n is a, c, g, or t
  misc_feature (1349)..(1349): n is a, c, g, or t
aattttgtcagagccattctagccttctgagccataaacaggagttctgcattagaaacttgaaggccactacctgttctgttgaagctgatattagaacaagtggtctttattccaacacctgttcgtctctcaattctaagagccatgcacctgctaggattattgaagaagttggaaatncagaaaaatatacagtgaaatatttaaataattaggaagattataaaccaaagttaagtgcttctatttaattttttaaatgtacacatgcctatctatccatatgtagctatatatttnaatactttgaatcaaattcttagtcttattttacttaaattatacatgcacattttgcagttattaaaattacttaaatatacttttaattattataccgtatatactcttatttatgtaaatatttttactttttttttttttttttatngagacaagttttactatgttgcccaggctggcctcaaactcctgggctccaatgatcctcccacctcagcctcctgagtagctgggactacaggaatacacaaccatgcccagcttaattaatactttaaatgtttaacgtatataatttgatgataaaaaatacagacttagagtctacgaacatgtaacattattatagacctagtaggagttcctgtttgctatgctacattactttttgtaagatatgtaaaggcatataaatatattttacaaatggtagggccaaaactagggtgaggtaagcaaggtgtctcaggcacaaaatttcaggaggtcctcactctccattgcaaatgctgaccctgaccttccatgaacctgagagtgaatgtttcataaaaatttgcaccaggtgccttgtttgcctcaccctagtcctgaccctgacaaatgataatcctaagtttttgagtatcctaaaaatatactgtttaagatgtgttattatagtcaatatattctgttcctaaaatctaagcactaaattaacagtttgaaggcattctttgtaaataattatttcgcatttgaaaataatttaggatatttaaattatttttaagataatttaaaaattttaagatatttctgtgtatcttattttaacctgtaggggtagaacagtttcttctacattttggcactgattctaccaagtgtgttcttaattttaggtccttctgcttgcaccctcaatactgtaaccattagacaaatgtcttaggtagaatgatcaacactcattacctttacttcttaatctgccgctaatttctaaatgtgagtaatatccagttctcaaaaccaacataaaatgtgctgtcttgtcnttacctttcctctctgcaacactgggctgtttgatggtacctcttgcaatcccattcttcttgcctggcttctttctctaaggcagttccatcaagactgtctttgtatcgcgaagcccacatcctcttagttttttgtttgcttgtttgctttcctattttgtttattttgtgttcatttcttttgcttttcttgtagcagcaatagacatagagtgatatttgaaattgtgaagtggtatattgaaaggtttttttgtgtgtgtgtgggagaaatacttggtagtgaaaagtggaaaaagtaaagaaaaactagatgaactaagattacagaaaaatctttgggaggccgaggtgggcggattatgaggtcaggagatcaagaccatcctggctaacacggtgaatccccatctctactaaaaataaaaataaaaataaaaataaattagccaggtgtggtggcattcgcctgtagtcccagcaggagaatggtgtgaaccagggaggcggagtttgcagtgagccaagatcacaccactgcactccagcctgggcgacagagcgagactccatctcagaaag

SEQ ID NO: 238795 - DNA, 790 bp, Homo sapiens
  misc_feature (552)..(552): n is a, c, g, or t
  misc_feature (674)..(674): n is a, c, g, or t
  misc_feature (712)..(712): n is a, c, g, or t
taataatgaaagatttcaaaccacaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttcngaatcttcctctatttatattttaaataaagaaatacaatataaatgtaaaccaggatatgcaacagcagatggaaattcttcaggatcaattacatgtttgcctcacgctcagaaaaagtngtacatgtcgggggagaaatgagtgcttaattctgaanttctgctagcgtcaggagaatcagaccttaataatgttgatcaatgatgctactgaggtttccaatcacaaattttca

SEQ ID NO: 238796 - DNA, 765 bp, Homo sapiens
  misc_feature (552)..(552): n is a, c, g, or t
taataatgaaagatttcaaaccacaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttcngaatcttcctctatttatattttaaataaagaaatacaatataaatgtaaaccaggatatgcaacagcagatggaaattcttcaggatcaattacatgtttgcatttcttattaagttttgttcagatttttttgtcttttctcctgtttattgtgccttcatctctttctgttctgtacttttctttgtatataaggattttttgaaacgag

SEQ ID NO: 238797 - DNA, 848 bp, Homo sapiens
  misc_feature (552)..(552): n is a, c, g, or t
  misc_feature (659)..(659): n is a, c, g, or t
  misc_feature (668)..(669): n is a, c, g, or t
  misc_feature (682)..(682): n is a, c, g, or t
  misc_feature (688)..(688): n is a, c, g, or t
  misc_feature (732)..(732): n is a, c, g, or t
  misc_feature (770)..(770): n is a, c, g, or t
taataatgaaagatttcaaaccacaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttcngaatcttcctctatttatattttaaataaagaaatacaatataaatgtaaaccaggatatgcaacagcagatggaaattcttcaggatcaattacatgtttgccaanatggatggnncagcacaaccaantttgcnttactgcttgtattgcattccggtgctcacgctcagaaaaagtngtacatgtcgggggagaaatgagtgcttaattctgaanttctgctagcgtcaggagaatcagaccttaataatgttgatcaatgatgctactgaggtttccaatcacaaattttca

SEQ ID NO: 238798 - DNA, 421 bp, Homo sapiens
aatgaggtagatgaagcaatatttagtatagcatcacacaatgagcttatgacttatgggactctttcatgaacctcattaacctcacaaatgttcaaaaataaggaaagatttgtacacagagcagaaaaataacagacgcagtaaacaatcttttgaatcaatcttctgtacttccacactctattatacagaaaatagaagactgcctctaataaaaagtgagctgggtttatagacatgttttgttttgtctttaatatgagataaaatgtttatgctgataggaatgctccagtaaaaagaaaaggatttttgatcagtgagaagaatctctagagtcatattccttggggaaaaattggtgggaataaatatattagatgacagcacagggaagtcatctataaaagaaaaggta

SEQ ID NO: 238799 - DNA, 333 bp, Homo sapiens
aaagcttcatcttagataaaccacaaaatataagaacaatgagtttcctcaagaaataaagccatgaggccctttcctgtaagtttctgaccccatgggagaccaactttatctctgacatctaaagatatacagtaattcctgcagatatgataatcatgtgagggagaacatcctttcaccaccaaggagaaaaatgaacacactgtaacttcctgagcattttgtattgctttgaatattggctccttcctctattcaggaaactcagtttttctgaaggctgagctcccctgaaaacattacaaataaaaatattgttcttaatgatca

SEQ ID NO: 238800 - DNA, 2348 bp, Homo sapiens
  misc_feature (95)..(95): n is a, c, g, or t
  misc_feature (1224)..(1224): n is a, c, g, or t
  misc_feature (1245)..(1245): n is a, c, g, or t
  misc_feature (1890)..(1890): n is a, c, g, or t
aagcctcagtatgtgagagaggcagagagcctccctctgtgactcaccattctattggagatccaagcaacccaggcctagggatagcactttgnttctcccaagcccttgaggtaatttggggagagtcttggagatgctgtgagggaaagacaccgggaaaagctgcaggcattttcccagaactgggaccaagaacatcatgccagttttaatctgggtgcatataaagtcagtcattctttgatgacccagaagtgtggctctgcaggcattttattctcaagccaaagactagagggcttgctcttgaggagagtagggacctccaaagccataattgtggaaagcaccttagcagtatggctggaattgcacactctccctaattgcaagcctgggacaggaggagagctgctacagctgtggtttcttctggctgaggagacttgcagccggggccagcttgacaacctggcactgttctgcatgtgtcattgctgggtgccccagcctgctcccctgaaattgtggtgcaggggggcctctctgatccactcctaggcagaactccaggaatttagagtacatactttcctggaccagaagcctcagtcaccccaccctttctgtgaagagatcggggtaaagcaggccctctccactctatgcctaggcagaactcatgacattcagagcacctgctcacccagcaccagtcaccccacccttcctgtgcagacattggcatgtagggggcacctctcagctgcacacccaggcagatctccaggcagtaggagcacctgctctcctggttcagcagcctgagtcacccacccttcctgcacaacgaatatggtgcagcagggccctctccagtccacatgctggtagatctccagtcatttggagcacctgcttgcccagattggcatcctgactcactccagccttcttgtgcagtgatcagcatgcaaggagcccttctcaattgcacactcaggcagatctctgtatagtaggagcacccacttgcctggtccagcagcctaagtcacccctacttcctgcacaaagatcatggtgcagtagggccctctctgcgccacatccaggcagatctccaggcagtcagagcactgaataaccttgattagcagcctgggctgcaccacccttcctgtgtagagattgtggtgcagtgggtccctcgacaatccntgcccaggctgatctttaggnttctggagcacccactttcctagattaggagtttaggttgtacctccttcctgtgtggtgaacttggggccaaggagctttcccagctccatgccaaggcacacttctgggtgcttggtggctatgcactgaattctccctcagaactggtgtttgtgcctgccatcaagggacttgtaggtgggcctgcccagtctgtcctcagccatcttttcccctaccttcctggggctgagcagggagctcacactactgtgtactccacagttcagtccattgcctgaggcaacagagagcctctcctggtaaaccaagatcaagtatatacccagccacattgactgcagccagctgttacctgtaagaatcatctactggcttgtaggtcaaactgcacagctcaatataaaatctgctgaaagaaacacatagggctatagaagtgaaggcaaaagaccttgaccaacattttctacattcatatcccccagggagaggggaaaagggaaaaggaaagaagaaaaccctccacaataatataggaaagaaagaaaaagaaaatatcctacccacaagaaaataattacaacaattagaaatgccagcatctccagatgagaagaaatcagcataaaaattctggcnctatgaaatatatgaatatagttacaagaccaaaggattacactagctctccagcaatggtccctaaccaaaatagaaacttagaaatgacaaataaaaaattcaaaacatggattgcaaagaagctcaatgagacccgagacctgattgaaaatctacacaaagaaacttctaaatgaatccaggaaattaaggaagcaataaacaccttaaaaagaaaccaaccagagcttctggaattgaaaaacttgcataagaaattttaaagcaaaattaatagctttatcaatagactagagcaagcagaagaaaaaatttcactccttaaagactggtcttttgaactaaccaagtcagacaaaaataaaaagaaagaattaggaaaaatgaaaaacgtcttgagaaatgtgggattatgtaaagcaacaaaacctacaaattattgacattcctgagag

SEQ ID NO: 238801 - DNA, 450 bp, Homo sapiens
aagaataacgagagagagagagaggtcgagcatggcagctcgtgacagtaatctcagcactttgggaggctgaggtgggaggatcacttgagtccaggagtttgaggccagcctgggcaacaatgtgtgagaccctgtctctacaaattaaaaaattagccaggcgtgctgggattacaggcatgagccaccgcgcccggtcagctgaaagtctctcatttcagaactcagacaacataaagatgtccattttcaccacttctactcaacacagcactgaaaatcctagcttgagcaatcaggcaagaaaataaaaggcatctgaattggaagatgggaagtcaaattgtccctttttgcaggtgacaaaaatctcatatctagaaaaatctaaagactccaccaaaaaactcctagatttgacaaacaaatttggtaaggtttcatgat

SEQ ID NO: 238802 - DNA, 470 bp, Homo sapiens
aggcttcattggtgagacccaggaggaggatggcactgcctattcagggacggctttccaggtagagagaggggctcctgggctgccccagaaaagcctggagtctcttggttatagacaggactccaagagttcagagctccagctacaagaagatgtcaaatgcaagcaaacaggtgaacttgcacctgaaaaacacagtatttatttacttatttatctagctcttggcttaaactcaggggggacccaggaatattttctccaatccgatatctggttgcttgtgggtccatctgttatcacttctgctgaaggcctaaaaggagcattaagagtgatctgagggctgggctcggtggctcacgcctgtaatcccagcactttgggaggctgaggcgggcggattatgaggtcaggagtttgagaccagactggccaacatggtgaaactaaaataaaactaaact

SEQ ID NO: 238803 - DNA, 387 bp, Homo sapiens
cttccaatattgatcaattttatatttgcaattttagctattattcggggtacataaacattgaccaggatcttcaaggaacttacagttaaatagaaaatttttattaatattgaaattttttttgatctttgaagatgagatttattcagcataaaaccacttgatagttctcataaaattaatttctattattttaaaacagatgtcttcttatcaaaatagtctttcttgatgttattagcataactaggcgcatgggagacaaatactattttgcaatgatttgccttgcatttatctgccttctggaggaaaatatttcttaatggcactggcctggtattatcagtcatgagagaaaagccaaaatttcacataagctac

SEQ ID NO: 238804 - DNA, 446 bp, Homo sapiens
ttttgtatgtattctgttgtctgtgttgaaaatgtcatggattgcccaaaaccacaattgatactttagataagcaatttagattcattttagtaaaatttctttttttgctattagattttctcactagagaatgccatccagaattacagctttaaagacagattatactcaaaatgcactgttaagtttttgaaaagaaagtacagaagagtctgtatcatatatttatataaaatatttgtatttgcctttctaaagcataatttaaaagaatatcaactatttgcgtccttgtgcgtaaaatatctctgaacaaatgtaaaagaaactggtatgtgtgttgcctccagacaaagagataaaaagcagacttttcattgtaaactctttttgtagtttttgaattcaaggtttggcttattcaaataaataagaataatagt

SEQ ID NO: 238805 - DNA, 1925 bp, Homo sapiens
  misc_feature (530)..(530): n is a, c, g, or t
  misc_feature (537)..(537): n is a, c, g, or t
  misc_feature (682)..(682): n is a, c, g, or t
  misc_feature (758)..(758): n is a, c, g, or t
  misc_feature (935)..(935): n is a, c, g, or t
  misc_feature (1404)..(1404): n is a, c, g, or t
  misc_feature (1759)..(1759): n is a, c, g, or t
  misc_feature (1844)..(1844): n is a, c, g, or t
gaaaaaggaccaaaatatgacataagaatattttagaagttttctcttgagcttttcagtacatcttgatagaggggaagatatgatgataaagtatttggcacttgggtcaacaatctagtttattcagtagttcagcaaatattttaaatatatctacttagcacgtagtccaaggggatgtagtctggagcaagacagacatggtctttggcctcctgggtttacaatttataattgctggattacagagtatagaatagtaacaaaatgatagaaaacttaaatgtaaaagataaaagggcaacgggagtcgtgtgagtttgagtgtgaggacagatagcatggccatgctatctgctctgcctccttaaaaggtcactggaagttggttacttccattctgatagaggcctcacccttccctggcaacccagtccactaacagctgtattttgctgaagcataaaactttaagccagtgttctcttcagagcccagacagtcctctgcagtttggagagttcttnctggacngcactaacaaaggccaacctgtttcgggaaactctcgacactttcctctgtgtcagcacagtcacctggaatgcgttccagccggagctgtgactatttaatctcactttgtctcttagccctgtcatcttccacacccctgaantgtcagtctctgtaggcctctgtcctttctggcgaggctatttcagcaaggctttaggcctacaaccccttctcangcattctccagattaacagggatgctcatcctggctaaggattccacaggttcaaaaccaagctcatgagagttcgatgtattaattctcataattagtcatatgtaagtttactgctgctgggagtgaagctgagtccaagatgcgaggtgccagatgcagaggcaaaatgattanatatagatgggggagaagaccttgagaaaatctgctccgtgggaccggacactcaggaaacaatttttccttctcatggaaagcagatcagatgcctagagatgattgtgacctgcagtgcttatgtgatgcagatgtggtcctttgtgccgcttcccacagatgggaacatgagaaaatgtggaagttctactcatgtcctgctaaaagctcttacatttcataatcatgattatttgctttatatatgtttccttcagtagcccacgtaaggtaggacaaaattacaattaggtacacagttggaatcataacttcttggctgagtgaaacagctaaagggatggggacactctcctctccctactcctacttccacctctgtcctgcctgcataagaccgtctggtcacacatacagatgcttaattgtcaaggtcaagcactgtccctctatcactcacccaagnaactcactgctgagggagtgtcgctgcctctcaaatccagggacatgtagatggtggtagaatctcacctttcaggtggaagtgtaggaaatgtgcaggcaaaactactaggccctgcatttggtaggaaataaaaagagtcaagtctttggacaaatttgatcacttatatataatttctgtttcactggcagcaaaacaactgacacaaaattgtggccagagaaagaagatattccaggaccgggcacgatggctcatgcctgtaatcccaacactttgggaggccgaggtgggcgcatcacctgaggtcaggagttggagaccagcctgccaacatggtgaaaccccgccnctactaaaatacaaaagttaacagggtgtggtagcctgcacctgtagtcccagctactcgggaggttgaggcaggagaattgctngaacccgggaggtggaggctgccatgagccgagatcgtgccactgcactccagcctgggtggtagagcgagagtccatctc

SEQ ID NO: 238806 - DNA, 466 bp, Homo sapiens
aatgaacatgggagtataggtatctctgacatactagttttatttcctttgaatatacccagaaatgggatttctggattatatggtagttctatttttaattttttgagaaatttccatactgttttccatcatagctgcactaattaatattccctaaaataatagattttgaaatcatactaaactagattttaatcctggctctctcatgtatttgctgtgcccatgggtaagttatgcaacttctctaaacttcagctgtcccctctgtaaaatgaggacaaatactacatacctcttaaaacttccgtgaagactgaggtaataaatacattttgcactgtagctggcatggagttaaatgtttaatatgttatttctatgtcttgcccaagctcaaccagctagtgagtagaaaggcaaatattctgcctaaaaatttcacacttttccacagccataa

SEQ ID NO: 238807 - DNA, 111 bp, Homo sapiens
attaatcaataccctctttggcaatgttctttccagtcatcgaagaaagttgaggtggtcaatgcagaatatatgtctcccatgtttttcaccacaagtttcttttctttt

SEQ ID NO: 238808 - DNA, 261 bp, Homo sapiens
gccggctccagccttggccagcccagagaggggctcccacagtgtagcagtgggctgaagggctcctcaagcgtggccagagcggatgccaaggccgaggaggcgctgagagcgagtgagggccaccagcacgttgtcacctctcaaaaccatccctctgaagtcaagctgcttgtctctgacatcagaccacagtctccaacgtccagctgcttctcctcttctccccttctctgctctctgccagtacggtaaggggtt

SEQ ID NO: 238809 - DNA, 718 bp, Homo sapiens
caaggttgcagggagccgagatcgcaccactgcactccagcctggcgacagagtgagtctcagtctcaaaaacaaaacgaaacaaaacaaaacaaaaaagtatttaaaccccatgacaagttaccatatgagatgttaacattgaagagtggctgcagattcaaaataatatatttggtatttttaaggtatgctctttttcatagagtaaatctaaacaactgagatatttgctgaaaagttgatcgattcaagagatataacacatgaagacagttttctaaaatcctcaatgtaattaagtgtaaagagaaacaaagaactttattctgtcacatgcatctagcaataggacaaaataaagacatatcaactgcagtgtattttaaaaaacatattctttccccgtaaacacattttacatatgtgaatgcatcagtcctgatcattacagaatcctaaagaggactgataagtacagggaggcagagaaggaggatattaaattcttaatttaaaatagctgtatatgttctcaaatttctattaacctgaatcaccagagagaagtgtcaagagaaagattacttagctgaaacccacagagaactgttatctattagtaacaaattacatttgctgaattaaatggagtataattatatgtaagcctaaaataagaattttcaagtcacataatggaaaatttttataggtg

SEQ ID NO: 238810 - DNA, 746 bp, Homo sapiens
gcttgatttaaagctgttttccctcaaaatcataactggcaagagcagtaaaggttgtgtgcttctttgttcagtcaaattatatatagagagaagtacagacaagacagtatgacagaatgcgtttccaaaaaagagcaaggaacttcctttccattagcccccagaatatctccttttaaatttcactggtctgaattaggttacatgcctacagttaaactcatcactctggctaaaggaatgggattactctgattgatttataccaattaggccccatccctggagctaaggggtcaggttcactttccctaaaaaaatggctacttgcatgaaagagaggtagataggggtgtcctgggcaggattggccaactaaaccaaatgggacagatttaccaccaccgaaaggagttctcccaaagacgggacaaacaatgctggcaggtctgaggaacatcctctgcctaacctccccacaccatctgccaacctcataggcataccttttgtatcagctatttccccctgagccaacaggacacccccgcagaagtaactgcagagccacatgactgagatagcaatttttgacatagaataattagtttgacatatctacttggatgtctcataagcagttcagttcagagtgtttaggaacatcctctgcctaacctccccacaccatctgccaacctcataggcgtaccttttgtatcagctatttccccctgagtcaa

SEQ ID NO: 238811 - DNA, 800 bp, Homo sapiens
gcttgatttaaagctgttttccctcaaaatcataactggcaagagcagtaaaggttgtgtgcttctttgttcagtcaaattatatatagagagaagtacagacaagacagtatgacagaatgcgtttccaaaaaagagcaaggaacttcctttccattagcccccagaatatctccttttaaatttcactggtctgaattaggttacatgcctacagttaaactcatcactctggctaaaggaatgggattactctgattgatttataccaattaggccccatccctggagctaaggggtcaggttcactttccctaaaaaaatggctacttgcatgaaagagaggtagataaaaatctgatcatgttaagaaagtgagtcccatgcctattccttgccttgaattggggtgtcctgggcaggattggccaactaaaccaaatgggacagatttaccaccaccgaaaggagttctcccaaagacgggacaaacaatgctggcaggtctgaggaacatcctctgcctaacctccccacaccatctgccaacctcataggcataccttttgtatcagctatttccccctgagccaacaggacacccccgcagaagtaactgcagagccacatgactgagatagcaatttttgacatagaataattagtttgacatatctacttggatgtctcataagcagttcagttcagagtgtttaggaacatcctctgcctaacctccccacaccatctgccaacctcataggcgtaccttttgtatcagctatttccccctgagtcaa

SEQ ID NO: 238812 - DNA, 2157 bp, Homo sapiens
  misc_feature (404)..(404): n is a, c, g, or t
  misc_feature (679)..(679): n is a, c, g, or t
aaaaaatgaatgaagaaaatatggcaaaacttaataaattcacattaagcaggagaaagacctaactaaattagtaatctgaattgtagaatatttttaaaaaattaatagtaacttaattactgtcagattcatggagttccttggagaaattgctttggcaaatagatagggaaaatttacaaatagcacaaaacttggtaaataaagcaatttctaaagaatccgccatggactagtatttttaagttattttctccataaagtgcatgtatgttatcaatttgccttgcaaaatcatttttataagaaagagagctatttctgtttttaccaattatttgtggtatttgaaagtcattcatttacaaaaacataagaatgatatccatttactcattcantcattcattgagcaaatatatattggaggtcactgtgctgggtacatagtggtgagttcaataaagtccttgccttttctagcatgggggatgggagttaactaaaaaataaaataaatgaataaatattttgtaatacattatgataagagcataatcaaggtgctgaataatttctttgggaagatgacatttggctgagtactgaaggatgcaaagaagtcattcatgcagagaagggaggaaagagccacccaggcagaagggagctatgnggacaaagcaaaaggctgggagatgtttagcatgggccagaaactagaaggtagtcagtgtggctacagtgtgttgagtggtatgggaagaaatcagagaggtatgtggcagatgaacctaccgaggcaaagctaaaatatgaaattttattccggatgtcatagggagccatatagtgttctttagattgtgagcatagtctgattcataattttgaaacatcccaatggctttttatgagggaaactgattacaaagtagttgtatcagccaaagtagttatatcagtagttatatcacaaattgattacaaagtagttatgtatcagtagttatatcagaaattgattacaaagtagttacgtatcagtagttatatcagaaattgattacaaagtagttacatcagccaaagtagttttatcagtagttgtatcagaaattgattacaaagtagttctatatcagtagttatatcagaaattgcactaggtacttcaaacagatgagatttagtataggggcttggttacacaggtgttggaagtagaagaaaaaggcaacacagggtaactggagataataactgcagaaggcagctcccacatcacagtgcagagtgtaaagggccaccttggagctcagagacagacagtaggtgaatatccagcacagtgggcagccttgaggcagggaagcctgtgtgagggagctgctgctgctcctgggacagaatcatggaggcttgcactaggaggtgggatgggatagaaataaatagacgagagagcgattttaaacctagagcctataggacctgatgcttattgggtaggaaataaaaaatgactggcaagattctgacttgaacaactaaatatctggggcactgctttttgagatgcagaaagcaagagaaacaggcttagagcattgtaagtgttgagtttagaacatgctgagtttgagatgtcaagcaaatggttagatatgtgaatatggtggacagagaagacatgtagactggagttatggatgtggaaatcaacatgcagatggtatttaaaaccatggaaatggacgatatcatcgagggagagaatggaagagagagaagggctagttctgagcccttgggaatctcctgtgttgagagatcagtacagaagcgacaaggagcaaaggaaactgagatggggtagcaggaataatagaaatcaagagaatgcagtcctatagaaaccaagacaggaaggaggcagcagtccactgtttctagcggacctaagagatgcttaagatgtaacagaatgatgtccatggatttagctacatgaggatatctggctacacgcctgatggggtagtaggctgaagagtttacgggaggcaagggcactccattctgacacggagagtccaagggaatgtaaaggccaaattgtttcctcagttcagggcctacttggagctaggc

SEQ ID NO: 238813 - DNA, 613 bp, Homo sapiens
atgataaatcataaccaatatatattttctatatgacattatataaaatataatatcaatcttcaaaacttgcctagaacataggtaaaggtggttagtaattccatctatgcatatccaaatgtattcccatctgtttgcaaatgtatacttttcccactaggaaatcactcctggctgcccaaacggaggcccggtgcctctggtcatgtccacatctcgtccagcgcttctgctgcctcaccaagtctggaaagagctgctcttatctcaggctacccacttccactccgcgcccctgcctgtcccatctcttggaatgagcgccagcttcctgggagtggagtgtacctctttcccaaacaggccctctgtctggaacgcgcctcttctcgctccctgagtcatcaataaatctgtctcactttgtcctgactcaagctttgcagtcatagagttgggtctgcggagttgccattttcacaggatgagggatccaagacactgtgcaatattctcacaggatgagggatccaagacactgtgcaatattctcacagtatttcttaaaggtcatttcacttttcgggcttatttttaaaaaggttttatt

SEQ ID NO: 238814 - DNA, 571 bp, Homo sapiens
ttgcagaggaggaagctgagctctggcacatggaacttgtccaaggtcacacagctgcaggcacactggcacagggcctggccaaccgtctgtggagttgatccaaaccaatgctgtgctggaaatcactcctggctgcccaaacggaggcccggtgcctctggtcatgtccacatctcgtccagcgcttctgctgcctcaccaagtctggaaagagctgctcttatctcaggctacccacttccactccgcgcccctgcctgtcccatctcttggaatgagcgccagcttcctgggagtggagtgtacctctttcccaaacaggccctctgtctggaacgcgcctcttctcgctccctgagtcatcaataaatctgtctcactttgtcctgactcaagctttgcagtcatagagttgggtctgcggagttgccattttcacaggatgagggatccaagacactgtgcaatattctcacaggatgagggatccaagacactgtgcaatattctcacagtatttcttaaaggtcatttcacttttcgggcttatttttaaaaaggttttatt

SEQ ID NO: 238815 - DNA, 543 bp, Homo sapiens
cgccatttacaactatctccagcaaggccctcacagttgggaacagggaaagagcagggaaaaagaaatgagaagacttggggtagaattcatgtattctcttggtttcctagttggaatatttgcaaatttttttcattcaaggagaaattgagcagtcaatgggctatcaaacccacattcattatccagttcaatttaattcagaacacattgattagacagcttctctatgctgagcatatgactaaacagaagaatcatagttctggtgaaaaaaaatgtctttttatgaacaattccggccaagatgggtcctcaatatgtatgagaaatagccagaagttaaggaaaggagatatttagaaggtgtaagatgggcatttagaaatatgtttgtattcagtgtaaatagaaaacgggtactgggtgcagtggcttgcatctgtaatctcagcactttgggaggctgaggtgggagaatcacttgagcccatgagttcaagactagcctgggcaatatagcaagaccccatgtctaca

SEQ ID NO: 238816 - DNA, 302 bp, Homo sapiens
gttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagacc

SEQ ID NO: 238817 - DNA, 482 bp, Homo sapiens
gatgcctgtgtgtctcaagagagttgtccagttctccctaacacagctggcatagatgcctcagggtgacccaatgacaatgactaccaagttcaccactgagcagctccatccacctcagttgcaggtccatcttgagggcactctagatgcaaaaccaggcccatcttctttattagacctgttctcctcttgttgtttcgccagccctggttgccctcatttgactcccaggctatccagggtctccagtgtttctcccatggaggcacaacctccatagaagcacctcatgctctgaatggtacatcctgcccaaacttataaaaatttacctggcctgtgttgccactacccaagggggcaccagatcactgagactataacggccaactaatgcatacctaggcattaatcgctagaaaatcttaaatgcagataggtatttctgcaagatcctttaacatcttagccccctccca

SEQ ID NO: 238818 - DNA, 411 bp, Homo sapiens
tgagaggtgaagcttattgtttctccctctccaaccctgccatccttgttgaactaaatatcctccaacaatatgattttcattaatctgatagatgtactgtggggtcatgttgccatttaacttgggaatttctatggttatgagagatgttgaacttttctcctaagctatttaaatttcccattctatgactcccctacttatgtcctttgatgacagagttggctttcttacctttttcttgttggtttgcaggagtactttgtatattctaggtattaatcccattcaaaaattctcctatttttttcattagattgtagctgtatgtttcacattgaagtctctaattatctaaaagttcctcccttgaccagcctggaaaacagagtgagacatcatctctac

SEQ ID NO: 238819 - DNA, 525 bp, Homo sapiens
tgcaattatttgaatttcatattccttcatctagtaaaagtcatttaaggaatgctttaaaaagccagttatttagcaacaagttgttcacttgcttcatatgcttcattggaaaccaagtgttgagaggtccagcctagttggggagagggatttatgcatatgtgaaatgaatagacatgaatttatatggtgatatgctaagtgatttttttttttaagagacggagtctcgctctgttgcccaggctggagtgcactggcatgatcttcgctcactgcaacctccacctcccgtgttcaagcaattctcctgtctcagcctcccgagtagctgggactacaggcacacactgctatacccagctaattttttctattttagtatagatggggtttcaccatgttgctcagcctgggctcaaactcctgagctcaggcaatctgcccatctcggcctctcaaagtgctaggattataggcatgagccccagcacctggccctcataagtgatattaaaggca

SEQ ID NO: 238820 - DNA, 288 bp, Homo sapiens
gagatggggtcttgctctgtcacccaggctggagtgcagtggcacaatcatagctcactgcagccttgaactcttgggctcaagtgatcctcctgattctcccaagtagctgggattacaggcattcaccaccacactcagctaatttttttgtagagacaggggtcttgctgtattgtccaggctggtctagaactcttgttggccactttgcaagttagtctccttctcacttgcctttctttcatactttgtttgccacttgtccccttttctccattctttctc

SEQ ID NO: 238821 - DNA, 709 bp, Homo sapiens
agcatatatcgattaagtttaccatcttgtgtgggcatgcattctggtaccccaaaacaattacagtagtaacattaatgaccaccgatcacagattgccatagcagataaaataatcataaaaagtttgaaatattgggagaattaccaaaatgtgccacagagacatgaagttgagcacacgctggtggaaattggctctgatagacatgcttgattcagtgttgctacaaaccttcaattggttaaaacaacaaaaacacaccacagtatctgcaaaagagcagtagagcaaaagacaataaaatgagatctgtctgctaggacagtgggcttaaactggaatggtcctgggcagccaggtcacatggtcactttactactccagtatacctcattgttaaaatgtggttgtagaggtttggaatttggtataggattaaatgaaaagttttaaccttgtggatacaaggatgtaaggatctgattaggctttgcaacttgagtttgactgatgtcttctgtgtggtgtccgctaaatcccacagcatataggatcagtcgcattggttataaggtttgcttctggctgggtgcggtggctcatgcctgtaatcccaacattgggaggccaaggcaggcggaccacctgaagtcgggagtttgagaccagcctgaccaacatggagaaaccttgtctctactaaaa

SEQ ID NO: 238822 - DNA, 451 bp, Homo sapiens
cactctttagcattttatacctcatttatttactccttcctccactgaagaacatttaggttgtttcaatttttccatattacatgaaagtgctgaataggcatcccttgatttctgtacgtatgtgtgaatgtttgtagatggtagatgtgttaataccacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtaagttgtattttcctgattcatggaaaagttgagatactttcagacgtgtattagccatgagagtttttcttccttgtgactgtcctgttcataaatcctgatcattttttcattgagtttttgtcttttttc

SEQ ID NO: 238823 - DNA, 418 bp, Homo sapiens
gatttccctgacacctgacacacttgccaactggttccatttcattttttctacagaaacagaagtgaaaaggtcttgaaaattatctgacttttcacagcttctttcattctttctagtcctttcttcaaagataactgaaggtgactggtgattgttgaggactctggatgagaaagctgctttgtttttcctgagtgtgttctgtgggtatccctcccgctaagagactcagcgtaggaaagtctgcgtctcacaggaggccgatagaggcggaagcttccctgtttctctttgtcaaagaaacccctttagggtgtctttaaattaccatttccccaagtgcatttcagagtcagatttataataacataataatttatgtagatacagcttgttaagactacttctactgcca

SEQ ID NO: 238824 - DNA, 246 bp, Homo sapiens
tggagtaatctaccaccaataaaaacgtcctggagctactttctgagtcgtgggaatgagcttgttcacgtattcctaattgactggcacacatagcaaagcaggtgactcagattagtttcaaatactgagacaaatctctggtgtagtcattttaagtcttcatttttcatagatccagattttgtgcttttcaggttatcttgactaatgaatttttataaaataaaaatatgcaggtatttg

SEQ ID NO: 238825 - DNA, 716 bp, Homo sapiens
ggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggaaaaaaaaa

SEQ ID NO: 238826 - DNA, 283 bp, Homo sapiens
gaccaaatgctcaaaaactacaaagtgccaaaaactcaacctatagatatataacctgaatagtcttaaagcccttagagaaacttaatttgcagttaaaccctccccacttgatatcctggcagagatcatttgacttgagaaatttgccacacatttaaagaagaatttaaatcagttttacagggttttgtttattaaattaagagtaggaaacacttcccaattcatgttgtgaggccagtattattctgatacctggaacagccaaagacagcattta

SEQ ID NO: 238827 - DNA, 424 bp, Homo sapiens
taaaacaacctggggaaaataaaacaaaacaaaactcaggctggacctggacagataaacaaacaggatcccgcacaggagttctttattctttgtctaattagcaagctcccaggaaaaaattttctccctttttcagtcagatacatggtgagaacttgcacacggaggaggggggattacctaaaacaaactcacagtatacaaacaagagaagctgtgctttgtgcttacctaaaaacatacccacagctgcatgagataaggggcgtcgcacagacagccttactgataagagaagttactcaaactgctacagagatgagaggggtttctcagctgtaacctggcaatccactctgactcctctctctgctgcagagagctttatttctttcacttattaaactttccctccaacacc

SEQ ID NO: 238828 - DNA, 476 bp, Homo sapiens
tatcctgcacagtttttcttatagtgtttaccagttggtggtcagtgtgaagccagataaaaaccatttgctgagtttcctcatttgaccttgattttctgttagccttgccatgttgaatgatgtagaaatagacgtaggaaagtatctatagtagaagaagccaaatatgctgtctgtttttggaaaaaccacaaagaacctgtttgagatgagcaattgctaaacagaaacaactgcagggtcttattattattaaatctcacaataatttgtaaagacccgaactaggaatgaacttactgcctttgcgaaccagttcaaacttttggtaaatcagacattttacctacagcagttacttttgagaaatagaaaatttttgctacaacttcctgtccaataactttgttcctcacaaacttgaaacaattaaatagatgttttgcaaaaataaataatcatgaactaaaata

SEQ ID NO: 238829 - DNA, 2220 bp, Homo sapiens
  misc_feature (222)..(222): n is a, c, g, or t
  misc_feature (664)..(664): n is a, c, g, or t
  misc_feature (758)..(758): n is a, c, g, or t
  misc_feature (1947)..(1947): n is a, c, g, or t
  misc_feature (2157)..(2157): n is a, c, g, or t
cgatctcgattctcgagcatgttggcctatggaaacaaacaaacaaaaaacaaagttgggaagggccaagtaagaatattcagagaagctccttaacaccaacaggctttcctccactctaccttggccacagtctcaagtggacataccttatcttgtcagctctgatcacctcaagcctcccactctgaacatcacctcctgtacttccagctcaggtangtcctatgtcaccaccacaccatgccagcaattctctgagcccacccagccctctgaaccagcagtctttgcctgttggcagcgccatcaccatgtccttaaaccatccttacagtcactaccctgcatcctttaccccttttccccattcactgtgctcacccagagaaactccaaactccaaactccagttggatccaactatggctcaagaaccagcacccctgtgtgactagactcatttccaaatcaaaaccacacgtttcgcgcaggccctcggttcctccaatgtgctttcacagcttcacttccccgctcttgaaatgactcatttcaaatctcccacacccccaacctcaatttcagctggcaatgccaccacacgcttcagagaaagaaaggatgcacccacaccagcacacctacctccatgccccacacntgccacccagtatccacgcgtgcccccttcccccgccagagcacagtggaagctgcatcgtgctcctccagcctgcactgggccccagccctcntgctccttagggcctggccctgcagttgtctctgcagagcctttctccccttcccggatcattatcatccgcttataacatgcccacccttcctcctttagaaactctccctggaggcccccagcccttctggcatctgctgttccacctcccccctccccactttcattctgtgctgctccaagcagccgtttgtccccaccgttacaggagatgactctagtccagatcatcagtgacctacatgtcaccaaggccaaaggtcccttcccctgcctatctctcagtggcatttgacacgcttggccatggcctccttacctgttcttccaatgtctccgactccaccttcccctggtttccctcctccacatggccttctcctcaggagccttcacttccccctcctcctccgccctctctcagtgatggctgccccggaggtctgtcttggggtctccggtcttcatctttgttcattcccatagtggctgtcatcctgatctgcggcttcacagaccatctccggtctgatgaatctcaagacttaatctcccgccgagacttctccctgggactcagattcacatatttaactacctcacgcctcctcttggatgcctaatgagcatctcccagccaaaagcaggctcgaatttccctccaccaccccctcaaatccagtccttcccaaggtctcctatcataaatagatgtcgctccccattcgcccagctgtgtaggctaaaacactaagaaattattgtgatttctttttccctcactccatcatcctgacagcgctgcctgcaaaatagacctaggcccacttattcccatttcacggttacagccctcgaccaagccaccttcatccctagcccagcctatcctaatgaactacctgatttctgcctccaggcttgtctccatctcaccccctgcagtttatcccacacactgcacttagggagatctttctaaagcgcaaacaagacttgttattcccgtgcttaaaatcctccaatgaggcagaggttgcagtgagctgagatcgtgccactgcactccagcctgggtgacacagcgagactccgtctcaaaaaaaaaatcctccaatgggctgggcgccatgtctcactcctgtaataccagcactttgggaggccaaggtgggagggaagatcgnttgagcccaggagttcgagaccagcctgggcaacatagagagacctctgtctctacaaaaaaatacaaaaagtatgtttgtattttttggcttcactcatggtggtgtgagtctgtggtcccagctatccgatggcagggcggggtagtgcggaggtggggcagggggagactgaggtgggacgattgcttaagagatcaagaggttgangctgcagtgagctgtgatcgcaccactgtactccagcctgggtgacagagcgagaccctattc

SEQ ID NO: 238830 - DNA, 779 bp, Homo sapiens
agatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatgctggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgcagtgagtttgg

SEQ ID NO: 238831 - DNA, 456 bp, Homo sapiens
cagctttggaactaggtaatggacagaggttggaagagtttggagggctcaaaagaagacagatgagaaagtttggaccatcttagagactggttaaatggttgtgaccaaaatcctgacagaaacatggacagtgaaggctaggctgaggaggtctcagatagaaataagaagctttctggaaaatgtcttccttttggatatggaaagcttacacaatgcctgtaccacccctgtaccttagaagcagtgatcttgcattttatttcagaggcttataggcaaaagaggctgcagccttgactcagatgagactttggactttgtaacattgtgttaatgctgaaatgagttaagactcatgctgggaaggcatgattgtattttgcaatgtgaaaaggacaagagattcgtggggtcagggacagaataatatggtttgtctctatatcccta

SEQ ID NO: 238832 - DNA, 1932 bp, Homo sapiens
  misc_feature (7)..(7): n is a, c, g, or t
  misc_feature (200)..(200): n is a, c, g, or t
  misc_feature (1779)..(1779): n is a, c, g, or t
tattttncaacataggcacaaataactacacatctcttcatgcccactttcttcgtgtttaaggccaagtgatagaaatcaaatttgtcagtatgctaataaaacatttttgccaaggaattccctagcagcatttgcttgtatggtttgtcattctgtattctattggctcaattctgttcactctgtgcaatcttgtnagcctatcaagttaaattattcttcgagtagaaaacagcaaaagatacctgtgtcaaataaatttaacttgaacactagagcttggaaaaacaaccctgagctatctaacactctgcctactcagctagacctttgctgttatcatttatttttcttaattaaagttcttaagttcagtaatgaattaaagaagcttactttttggaattcctgtgcttagtattttgacttatactttttgtgtcttgttagctaaaatgtggtagactgaaaaatggaaatttaaatcgtttaatgagttaatttgcattcaggaataactgtccatgttaatttggccctaattattaactccattaaatatagtagtactgcatctgacctcaacctaattgtctctattgcttgtatgtttaaacatttcagtgaggattttatttaggccttttctgactcttacttctaccttctctctcttcacctttcttgacccgttgaagtagaataacaaaaagatggtaagtgaggttacacacatgctctgtttgttttccacttttgcttgatgggacagtagttgttgttttgtgtccctttagtattggggagggggggttatttccatatttttattttaagtactttgatttttaacctttttcattgcttcaatttgatagcaactaattaagtcctatactttcctgattgcgtacaatggaccaaacaagaactaattactaacatagttttgaattgttttccttgtttttcttgtagatgaatgttataattaaaatggaatgtgttgtgcataatattagaaaccagatggctttatataggatatgtgtgatccaaaaaattcaagtgaagttgttacatttgaataaattcactttattgaccagtattaaattgaacattgactgtcatagcctgtatatatatttgcatctagtgtggtatcatatgtgtacttaataaactgagtaaaattttaatatgtaaataaaccatagatagaaaaagagaattctttccatatcatccttactgatgagcagatttcacaacgttatctgaggataaataagaaaaaggtaaagcttttctataaacaacagatttcccccccaaacattgtacagtgtgtttttctttataactataagcttgctggtcttatctcagacatttaactcttcattgtatttttctgtgatagtctaagtgcttctgtagtagatacttttcaagtttgtttttaatattgtttgtaagaatctctgacaaaaatcaggcacttctaatatatattttaactagtaatagtaactttgtgaagttttcttttgaataaacaaaaacatttaaaagaggaaatttatcctaaataaaagatcataacatttgtgtttatattctaatgagattaagaaaagggtgtgcttgctgggcacggtggcttgtgcctgtactcccagcactttgggaggcccaggcgggtggatcacgaggtcacgagttcaagaccagcctgacgaacatggtgaagccccatctctactaaaaatngaaaaatcagccaggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctc

SEQ ID NO: 238833 - DNA, 319 bp, Homo sapiens
agaggtatgaatgggttccatcatctgttgaggcctggctacttcagggggattgctgttgattgattggtgctctgaggcgtgtttttcagaggacctctgatcctgatcagctggttttaagaagtgaaggctgacattgattatactgcaaaagttatgttcactcaagcaagttgtcctggatctattaatcaggtttaaatctctctctggtggctacagaacaatgcacgtgctctgtaaaagcaaataaaagtggaattttagaagtcagtctttggtaaaaaacagaaataaaaagcagaaactattatat

SEQ ID NO: 238834 - DNA, 468 bp, Homo sapiens
tattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagccttttatgggtagatgaggtgggagcatgggtacgtgttcctttgcccacctcggagagtcatccagcttctggaaaaatgatagcagccaacttgacagaagaacccagcatacacattcaagttcattagatta

SEQ ID NO: 238835 - DNA, 606 bp, Homo sapiens
agaacaatgtgtatagtgtaacaaggaaagacgtgtccacacaggagatcaccacacaagcaaggggacaagttatagcagaaaacttggaattgacttgctcctgatcattgtgaacttcctcctgctcctcagctggttaaaagctgtcagccaaagctggcatcccggggtgtcacaggtgtattgataattgactcagtctgttttgtttacaattttctgcccaacaaattgcatgtttctgcagatgtctaacaaattcaggacatttaattcctcagctgccaccatcctgctgtttccaccctcctcatccattggttacgatggtgtccaaagacacattcaccagcattagaaaaggtcattaaaaagctcttacaaccatctgtacccagatggacaggtctccagccaaaacaggagagtttttaattattgtttgtgggtcctgaattatttacatttgagctgtaaatcttaatgacccatgccgtgatcttcttggcttactgatgatgaacaaagccaaggctgtttcgttctcctgattcaatgctgctgtaggatgagggccaaagaaaagtgcatcttcctaaatcg

SEQ ID NO: 238836 - DNA, 228 bp, Homo sapiens
cataattccattttcagatgaaatcagaggcagcttgaattctttagcattttttattcctgtaacagtatctggaaagactaaacatttaatggaaacaagcttccattctggactgcaaggacttgagcgtgtttacaagaggctggcatccatgtctagttaaggctgtatgtacccaagggggcataattttattccaaacctctaaaaaggttggctaaagca

SEQ ID NO: 238837 - DNA, 1791 bp, Homo sapiens
  misc_feature (758)..(758): n is a, c, g, or t
  misc_feature (1379)..(1379): n is a, c, g, or t
  misc_feature (1791)..(1791): n is a, c, g, or t
ttttttttatcctatttgattatcttgagggcttgattttggtataaggtggattcaactgactagcttcatttctggaagattttagagggccaacattcagctcccaactcctgcactgtgtactctaactctgggggacttctattgggccccagctttgttctttggctccccaaggttaggaatccactgcggtgaaggggcctgaggtgtggcagctgtggcagagtgctagcaggtgtcggggtgcctgcctccatgtgggtgttcaccacagtggcagaaacaatgcagctgttgggggagctcctgctggcaactatatgtatggttgtgctggacatggtgttggcttgggggtggggtgctggcagatgcaggcctgggtgccttctctgtgccccataagcaggagtgattggtcagcatgggggaggactgttgttctctgcaaaaatgtttaaaaaagaaattgtttcaaaaatctatataaagctttggattctgtaaatccaaaattcattactggtttattactttactggccagggattatggcaccagaagagagatctgtggttctgacaataagccatgaatgtggtttgcccagtacatggtttagctttgtttctgtatcagacacgctagtttaatttacaaatggagttttgatatactcaggactgtgaataagtattggggggtggtgtctggtgaaaggcagacaaaccacagtagctcatttccttttnttgatccgagcacaaagcattgttgttgcatcttagaaattaaaatcctcatttacagaatagtgtggtgcaatctggaaagatgttgttgtggtctctcaggagtgaataatatgagtttttaaacattctccaagaaaaatttacatgatttcaaacattctaaagcataaggatgtacagtatttcttacagtagaggaaactgccaaatattttggaaaaatataagaaaggaactgtacattggtaagaatgcattttcaaagactatttattttgtttgtttttaactgaacagttattcattgagaggggtgtgtgtgtgtgtgtgtgtgctgaagatagtattatcccaaataatcatattatatagaggctacaactcagtcttgcaaactgctcttacttgcaactgacagctacctcccacaccctcttggcatttctctagtgaagctattgatgtaattattgcttttagggttctgtattaaatttaaaaaacaacttcttttaattttgtgcttaatacagaaatcctaaaaaatcatagaaaaacacaaaggaaaaaaatccagcattaaccactaactaagtggataactaagatcagagaagnaactaaaacaagtaactaataactaagatcagggaagaattgatggtgatagagacgtgaaaaatcctccaaaaaaatcaatgaatccaggagctgttttttttttgaaaaaattaacgaatagatagaccattagctagactaataaggaagaagagggagaagaatcaaatagacacaataaaaaatgataaaggggatatcaccactgaccccacagaaatacaaactgccatcagagaatactataaacaactcgatgcaaataaactagaaaatttagaagaaatggataaattcctggacacatacaccctaccaagactaaaccaggaaaaagccgaatccctgaatagaccaataacaagctctgaaattgaggcagtaattaatagcctaccaaaacaacaan

SEQ ID NO: 238838 - DNA, 869 bp, Homo sapiens
ctttgatattaggagagcttggcatgtaaggagttggggagttgggcttgtctcatttaaatctgaggcaggcctctctctgggcagtcttgaggagagacctcagcctccccaagctatggctgcctgtctgtacagtgattatggtgctctttccttccttgcagggtgtgctaagggctgaaaatagcaagtgggccatgcacagtggctcacacctgtaatgccagcactttgggaggctaaggcgggaggattgctggagcccaggagtttaagaccagcctgggcaacatagtgagacccccgtctatacaaaaaaaaaattagccaggcatagtgccatgtgcctgtagtcccagctactggggagtctgaggtgggagaatcccttgaacccaggaggtcaagactgctgtgaaccatcattgtgctactgcactccagcctgatgatagagcaagacctcatctcaaaaaaaaaaaaaaaaagaaaataacaaatgtagagtacctaacacatgtagtaaatgcacagcaaacaggagctgtggcatcagccactatgataaattagaggccatgcacatgatgaaaacaacatctgtgaattgagtgggaaaaagcagaggtaacacaacaaacatacattcagtgcctgttacatacaggacatcatacttatcactgtgagggtcacacagatgaaggccctttcctgtcttccaggagctcctcacttattaagaggtggcagatagattggctgggtgtggtggctcactcttacaatcccagcactttgggaggctgagacaagaggacagaagtttgagaccagcctgggcaacatagcaagaccctgtctca

SEQ ID NO: 238839 - DNA, 225 bp, Homo sapiens
cagacacagaagggacactgtgatccagagacagaatcagaaaccagccacactaagctcggtggccacactctgccaccctgagtgtcttcaggctcattctcaggaggagttaaactgcaggaatgggccagggcctgcttgttctcctcccaagtctctggttctatttggctttttcagctctgtgcatccattaccttggtgaaaataaacattagttta

SEQ ID NO: 238840 - DNA, 297 bp, Homo sapiens
caagaagagctgaactccaaacttctgtgtccggaattggtgggttcttggtctcactgacttcaagaatgaagcggcagaccctcgcgcatacctgccatgcaagaaatgtgaaaagttcttcggagagaaggaaaattatataggtcagaaactgagacctacataaggaaagaagagcattggatgaagaagaaataaataaaggtaatatgaaattctttatttttcatatttttattagtctttattttcatatcgttaatatttttctttttaattaaactagttagttta

SEQ ID NO: 238841 - DNA, 401 bp, Homo sapiens
acaaaaagatctagagaagtctatagtaaagaaacctgttcaaatttacttaacctagcattactcacgtgaccacagatcatttttccccttttggagtacgctgttaagtggggggctgggaatgggtggaaatggttaatgggtacacaaaatagaaagaatgaataagacaacgggtgaatatagtcaataacttaactgtacattttaaaataatgtatggagtgtaactgaattgtttgcactcaacggataaacgcttgaggggacggataacccagttgccatggtatgcttattttacattgcatgcctgtttcaaaacatctcatgtactccataaatatatacacctactatgtgcctacaataattttttaaaagaaataaaatttgca

SEQ ID NO: 238842 - DNA, 410 bp, Homo sapiens
agctgctgcctggcttttgccatctttgaaaacaaactccaaacagcccacaggccccatcctcactgctgcggtgtcagtgggaggctgtgtcacgccactcgccgtcgctctctggtcggctccgtgagggtaggggctctgcccattcaggtggtatctgtagatcctaggttctagggcccagagcattccctggcccagagtacatgctcagaaatgcatgttgaaaatatcaacgatttagttgtttaaatgtgaactgaaagtcacttagaaaatattcacaaggctgggctccgtggctcactcctgtaaccccagcactttgggaggctgagatggccagattgcttgagcccaggagttcgagaccagcctgggaaacatagcaagaacccatttgtaca

SEQ ID NO: 238843 - DNA, 401 bp, Homo sapiens
taatttcccctgcttttaaagaattggatgaaatcttaagcttagcacatctaatagaagtagaccatcaagagcaagaaacagaaaactgaaccccatttgaacttgcttctccttaagtcctgtccaagacacaaaaggaacaaaaatggcattgagatcctggctgcttatgtccaagatgaagctaggaccttcagaagcaagctcaagagatgatgaatgaaggaaggtggagctccgaagaccatgaagacaacagctcttcggtgttaaagccacaagaccaagagcagacacagcatccagaagaaaacctctattggcaagcacaagacagtgatcacagatgtggccccagacgacggaaggacaggagtgcagcacgctgaaatgtcgga

SEQ ID NO: 238844 - DNA, 372 bp, Homo sapiens
ttagagaggaaagtgtcgccctggacttagaaatcttttttcatagatggtgcgtcctgtgttaggtattacttggaagaaaattgaagtaaaaaacagctttaagtaactgagtaattaggattaattagtagctgttgaatctaaatcccttaagactaaatttcattgcagctctgtaccctcagcaggacttcctttcttgattgttttttccatttaatataaaatttaaaagatgcccatattgtcagttgtttttagtcgccagactgtctttaatagcctctgatgttataaaactggagtcatgaaattgttttgcaggaagtagtgataattccttcaataaacgtctgctattcttataaa

SEQ ID NO: 238845 - DNA, 291 bp, Homo sapiens
ggtttaaaattaatcttctcaatcaggtataactgtaatcacatatacttttaatttttccatgtgtaatttaatcttagaccatagtcatttgtatatattttgtacatctattgatctattttccataactttttgacttggacttttttttttctcttaaaaatttgtggccaggcgtggtggcttacgcctgtaattccagcactttgggaagccaaggcggaaggatcacttgagcccaggaatttgagaccagcctaggcaatgtagggagacttcgtctctacc

SEQ ID NO: 238846 - DNA, 354 bp, Homo sapiens
cccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggttcctcatggggagaaataagtttggattgattggactgacagatgttgaaacaatt

SEQ ID NO: 238847 - DNA, 370 bp, Homo sapiens
actctggaaactactcaggttttcatcaacagatgaataaacaaaaggaagtttatacatacaagagaatattactgagtcttacaaagtaaggaaatttacaaatatgctgcaagatgaaccttgacgtgctaagtgaaatgggccattcatgtaaagacaatacggtatgattctacttatatcaggtatctagagtagtcatattgatagaaaaagtacaataccatttgccaaaggttagggaaattgggtaatggatagttatttcatgggcatagagtttcaattttgcaagataaaaagggttccagaggtggatggtggtgatggttgcacactagtatgaatgttcttaatggcactgaac

SEQ ID NO: 238848 - DNA, 578 bp, Homo sapiens
actaagactgagctccccctgagcaagaagaaattctgccagcagggtgcctttggactcagactacaactatttcttgggtctccagacagcctaccctgttttggatctgtacctctactattgcatgagccacttacccacacttgattgaaagacgttatttagatgagatttgggacttaagagttgatgctggaatgggttatgtctttggggctgttaggataaggatgaatgtattttgcaagtgagaagggcatgattttgggaacaaaggacaaaatgttatggtctgacttatgtcctcttcaaattcatatgctgaagccctaacctccagtaatgcgactgtatttggatatagagccttttaagaggtgactaagttaaaatgtggcccttaagagagactttaatccaatctgactgttttctttatgaggaaatttggacacacagagaaagacaccagggatgtacgggcagaggaaagagcatgtgagggcaaagtgaggaaagaccatgtgagggcagctacctgcaagccaagaagaaaggcctcagaagaaaccaaa

SEQ ID NO: 238849 - DNA, 544 bp, Homo sapiens
tctaccatgacattagttacttaggtgatagttattttaaaacaaacatctatcatctttccactgttgataaagtccaaatatatttaattccaattttttaagagatctcaatcttataatggggaacggcagcaatgtaatacaagctgccaacagtaacaattacttcctagaatgatagtaaaactgctttagaaagggtgaggggaggccgggtgaggtgacccacgcctgtaatcccagcactttgggaggctgaggcaggagaactgcttgaatccaggaggcggaggctgcggtgagccaagatccgcgccattgcattccagcctaggtgacagagcctccgtctctactaaaactacaaacaatagctgggcatggtggtgcgcgcctgtaatcccagctatttgggaggctgaggcaggagaatcacttgaacctgggaggcagaggttgcagtgagccaagatcgtgccactgccctccagccagggcaacagagtgagactcagtctcaaaaaaaaaaaaaaagaaaaga

SEQ ID NO: 238850 - DNA, 2073 bp, Homo sapiens
  misc_feature (232)..(232): n is a, c, g, or t
  misc_feature (298)..(298): n is a, c, g, or t
  misc_feature (343)..(343): n is a, c, g, or t
  misc_feature (1141)..(1141): n is a, c, g, or t
  misc_feature (1246)..(1246): n is a, c, g, or t
acagccccagcttgctggcttccgacctgggaggctgcacctggaagcctgggggtcctgctcctatggtaccgaggcaagctgggagattctgggagggtctcttcccctgagtctcgacttcaaccatacaatgaggacttacaataccattaatctgctctcagagctggggcaaaaatcagagcaggcagcgagggaccgtgcccatcttactaacggataccccagnctctgcctggcccagtccctggcacatagttgttagaccacagaaactgagaggattgagacccanataggggatgggaatcccagacagtatccccatctgatggttacnatacccctgttcccagtggattaagtaacttgcccaaggccacatgctcccaagcgatggagttagtcctcgaacctaccagacccacaagcccgagtctcaatcactctgcaccggtctcaaccaacatgtatatacacgcagattcaaaataagagagctggattgtatgaaaggagagaaggttagcactccccttgacaaggatggaagaggcccttgggcctgacgacacgcatatagttaaggtactgccacctacatcgtggcatctaaacatcatttttttaatttaaaataataatttaaggcagggcgtggtatttcacacctataatcacaatactttgggaggccaaggttgggggatcacttgaggccaagagttcaagaccagcctggcaacatgttaaaaccccatctctactaaaaatacaaaaaattagctgggcatggtggtacacgcctgtaatcccactgaggcaggagaatcacttgaacccaagaggcagaggtttcagtgagcagagaccataccactgcactccacctggatgacagagtgagaatctgtctcaaaaaaaaaaaaaaaaagaaagaaagaaaaaagaaaaaaaaaaagaaagaaagaaaaaagaaaaaaaaaagaaaaataaacaagccgagcacagtggctcacacctgtaatcctagcactttgggaggctgaggcaggcagatcatttgaggtcaggagttcgagaccagcctggccaacatggtgaaaccccatctctattaaaaatacaaaagttagcnggctgtggtggtaggcacctgtaatcacagctactcgggaggctgaggcaggagaatcgcttgaacatgggaggtggagactgcagtgagctgagatcgtgccantgcactccaacatgggcaatagagtgagaatctgtcccagaaaaaaaaaagaaagaaaagaaaaagaaataaaataataatttgaaaatctttattaaaaaaaaaagagccaggggacaaagactaccagtcggagatctactggtttgtgccagacaccctgacatacatctttcgtaagcttcgccacacacttacaaggtaggtatcataaccctcatcccgcaagagaagaaactggggcacagagaagtcactgggccaaagccatgcagctggtgagccgcagttggaacccaagcacatctggacgcaaagtgcgcctccatggccttcacactgggctgcttcaagaaaaaaacccttcacggaaaccaaaatgatcccttgcttctgagacaactctctttcagggacttatcacagattaggagtgctgttcttttgtgtaaaaagaactgagactggccaaatatttaccagcccgcgcagagggctgtagactggcccagcagcggaattaactcctcctgcagtatcaagggccaagctgttgctagacaaagtggaggagagaatcctcaccattcagacagctcagctttgggcaaagaggaaccaaaggaaacccagggaagcagccaggggctcggcagggatggccaccaacaaaaccccggagggatttcttctgaggttcagaacttccagagttgctaggagtgaagatgagaggactggcttctcccaatacttcctttgtcattccgatcctgctggacaaaaactgatcttcaatctttcataggttgggatttttctttttc

SEQ ID NO: 238851 - DNA, 357 bp, Homo sapiens
tattctgtctgcacactaaactggatctgctttttctctcccgttctcaagggcggcaccatgtacttaaccaccttttcttcctgactgtgtgaaaacatgcatgaattcaaactaaccacctgacgtttggatgccttttgctaatctttctttcctgggatctcaaataatacatgagactcatttgctgtttgtttctgaataacctgagattctaaccagggaaaggtagcagggcatatttagtaagactcctgaaagaagtaattgttgaaaaagacagtattgttcattgttaaaatgtaaagataaaatgtaaagaagaaataaataaaatgtaaagaagaaatagtt

SEQ ID NO: 238852 - DNA, 473 bp, Homo sapiens
atggaggccagaaagtgggataacattttcaaagtgagaaaaagatttcaactaataattctgttatcagcaaaaccattccttacaaatgaaggcaaaattaggacattcccagataaacaaataaagagacttcatcactaataaacatgccctgtatgaaatactaagaggagtccttggggcggacatgaaaggacactagacaaatccacatgaagacgtaaagattgccagtgaagtaactacataggcaaatataaacgatagtataaatgtatttttgtttgtgactcttttttttgtgctgatttaaaagacagcttcatagaaaaaaattataaatctgtgttgatgggcacacagtgcacaaagatgtaatattaatacaataacagcacaggaatggagagggaacagaggaatacaaaatctaactagacttataacaagcaaatggattgatttaatta

SEQ ID NO: 238853 - DNA, 446 bp, Homo sapiens
ctgcactgcgctggctgcagtagcttcttgtcctccccctccacgtccttctccagcctgcagccggagtgagctttgtagaaaaaccaaatgagttcactatcactgtcttcccttaaaatccttgattttcttccctttgcccttaggctaaagtctgtaaactttggtacttcccaggaggccctgtttgtctgtttggcccctggctgcctctgactcagctcctgggttcaagggagtctcctgcctcatcctcccgagtgggtgggattgcaggcgtgcgccaccatgcctggctaattgtgtatttttagtagagatggggtttctccatgttggtcaggctgcttgcgaactcccgacctctggtaatccgcccacctcggcctgccaaagtgctgggattacaagtgtgacccactgcactgcgctggctgcagtag

SEQ ID NO: 238854 - DNA, 474 bp, Homo sapiens
ctcggaagcatgatctctatgaccttttccccgccctcctgtctctcacctctctttctcccctgaagtgaggcatagaaaccaaaatttctcttccccaaggcgggccatagaaactagaacccctatcccccaaagcaagccaaaaaacctagaaaggtcattctctccctttgcccttcttccttgaagaccctcattccagaggggtcctgtcccacacccaggaggaaagaatgctacacagagaggccaagaagactctgaacagacaggccttgctgggttttcccctgcagtctactatcattcaatcgtaccctttttgtccaacacatttctatatggctgtccattcttcatcaaacataagcatacaaatagatcatttttcctgggtctttggtcttcatttctgaggctcctatgtaatgtaaaactttaaataaatttgttacgctttaacctgcctct

SEQ ID NO: 238855 - DNA, 458 bp, Homo sapiens
aagtctctggcccaatgtacgtggattagattctgcaagcaggcagcagtaagtataagctaatttctgtctataaaaagaatgattaaaaaaaatcattttgttgatgtgtggaatagagattatcacacacatcattaagtggtaatgtgatgaatgatcacaaaacgaacagtcttatacccagcacacagatcagaacaaagtaactatcaagcaccttcaatgcccccctcatgcctcttcggattattattgcatccttcctatagagaggtaagcacctcttgattatcagcaccatgggagatgtttgtctgattttgaacttctgtaaatgaaatcatatagtatatactctttggaatctgttgtcttttgtagagggaactttttcattataaatcttatagtagtgttgttccttcttcccatcaacagtgttcttttacttaaaa

SEQ ID NO: 238856 - DNA, 2770 bp, Homo sapiens
  misc_feature (129)..(129): n is a, c, g, or t
  misc_feature (241)..(241): n is a, c, g, or t
  misc_feature (303)..(303): n is a, c, g, or t
  misc_feature (753)..(753): n is a, c, g, or t
  misc_feature (1081)..(1081): n is a, c, g, or t
ttcaggtataccaatcagacctagatttggtcttttcacatagtcccatatttcttggaggctttgttcatttctttttactcttttttctctaaacttctcttctcgcttcatttcattcatttaatnttcaatcactcataccctttcttccgcttgatcgaatcgctactggagcttgtgcattcatcatgtatttcttgtgccatggttttcagctccatcaggtcatttaaggacntctctacactggttattctagttagccatttgtctaatcttttttcagggattttagcttcnttgcgatgggttcaaacttcctcctttagcttggagaagtttggtcatctgaagccttcttctctcaactcatcaaagtcattctctgtccagctttgttgcattgctggcaagtagctgcgttcctttggaggtggggaggcgctctgctttttagaattttcagcttttctgctctgttttttccccatctttgtggttttgtctacctttggtctttgatgatggtgacgtacagatggggttttggtgtggatgtcctttctgtttgttagttttccttctaacagtcaggaccctcagctgcaggtctgttggagtgtgccagaggtccactccagatgctgtttgcctgagtatcagcagcagaggctgcagaacagcgaatattgctcaacagcaaatgttgctgcctgatcgtttctttggctttgtctcagaggactaccnggctgtgtgaggtgtcagtctgatcctactgaggggtgccaccctgttaggctattcgggggtcagggacccacttgaggaggcagtctgtccgttctcagatctcaaactcctgctgggagaacaactactctcttcaaagctgtcagacagggacatttaagtctgtagaggtttctgctgccttttgtttggctatgccctgcccccagagatggagtctacagaggcaggcaggcctccttgagctgcagtgggctccacccagttcgagcttccaggctgctttgcttacctactcaagcctcagcaatggcgggtacccctnccccagcctcactgcctccttgcagttcgatctcagactgctgtgctagccatgagcgaggctccgtgggcatgggaccctccgagtcaggtgcaggatataatctcctggtgtgccatttgctaagaccattggaaaagtgcagtattagggtgggagtgacctgattttccaggtgccatctgtcacagcttcactttgctaggaaagggaattccctgaccccttgtgcttcccaggtgaggcgatgcctcaccctgcttcagctcactctcggtgggctgcacccactgtcctgcacccactgtcctacaagccccagtgagatgaacccagtatctcagttggaaatgcagaaatcacccatcttctgcatcgctcaagctgggagctatagactggagctgttcttgttcagccatcttggaactgcccctgtggttgttttttctttttttcttgtaagttcagttgaacaattctgcagacgttgtacttattctttcaggaacatgcttttatactatcatttctattagatgtttctagattcaggttttccagtcaggagggacagtagtccagaaactggtcgtctataaaggagaaactttatcctatacaacagtatggtgtggctgaaaagcccagtagacaagagagagagagagctggactccaggtctaactctgccacttactgacaagctatgtggtcttggaagctaatttttcatattcagtcttcagaatccacattgatgagtgaagggattagactaatgctgaggctatttttcagcttagaaatgctctgtaactcttaattatttgtagttacttccctattacccaaatatattacagctctatctgtcactgtgtttaacctccatctctctccctctttcccttcctttcctccctccttctgtcctttttctcccccttctttcttcctttccactgatattctccttttcacaaagaaagaaatttggggcacagattaaaatggcccagatgcctgtagagccactggcagtatatggatagggacaaactaagtacggcaaggttggaaatggagaaattactgatgccactaattggagtcagacattgagatgctgtccatgaagaaatcaggatctttggcaatggatgcagctcttagattgaaatttgacactggcccttggattccaaattctttaaaagtcagcacatattccctgggtatgtactgcaccagcaatgtgtcaggcttcggcttacagaggtgaataagatgcagccactatacttatgggtccattaccagttggggaatataaatagctcttacaagcttgacttttagttcatttgcaactcactcttggggagtatagaaactgttaagacgggccgggtgtggtggttcacgcctgtaatcccagcactttgggaggctgaggtgggcagatcacttgaggccaggagttcgataccagcctggctaatgtggtgagaccccatctctactaaaactacaaaaattagccaggtatggtggcacacacctgtaatcccagctacttgggaggctgaggcaggggaatcacttgaacccgggaggtggaggttgcagtgagccgggatcacaccactgcacttcagcctgggtgacagagcgagaccccgtct

SEQ ID NO: 238857 - DNA, 359 bp, Homo sapiens
gtgaagggagagaatgagctggtatactttggaagtgtgacagataatatagagaacatatagcatatacagacaaatccatcaactagccaataaatttttaaaaatcagccaccaagctggctgcagtggctcatgcctgtaatcccagcactttaggaggttgaggaaggaggatcgcttgggcccaggcggtcgaggttgcagtgagccatgttggctccactgcacttcggcgtgggtcacagagcgagacctcgtctcaggaaatgatgttcctgaagggatcaaggacaacgcctggtctgggtagttttctctgtcactgttttcagcttccatgcggtgctacctcccta

SEQ ID NO: 238858 - DNA, 717 bp, Homo sapiens
tgagcaacaaattatatactttaaaattataagagtaaaatttttaaagaaagaaagaaaaatagaaaaaaattgtttaatcaaaaacactttggaaatcttaaaacacacagaaattattgaggtctaaccaaagggggagagactctatgtttgccaagttcaccaaaaagtgatagttctttctcatatccccaccagttacagtgctctaaggatgttaaagaaatggcatgagcctacagattcacatctggaaacagcagcatataaagagctggttgtcttcccccatcccccgtccatgcctcagatacagctgagaaagaaagaagatgcaaaaaatttaaattgtgccttacatgaaggatagggtatggatttatgccttatatttccattatagcaaataaaaggcatttgggttggccaggcagaggagcatttgtggtgtacatgaccactctacttatcaaaaagacttccctttataaacaaagtaagaaggaatggttgcatcttgcctactacacacacacattttttttttaatggccactcctaatagtttaggaatagtacaaagaaactggaaaaaggatgtgttaggattagatttagttgcatattacagaaaggtcaaataaagtggctttaacaagttagggtttttatttttctttaatgtaaaatagcccagaagagatgtccagagca

SEQ ID NO: 238859 - DNA, 478 bp, Homo sapiens
actagagaatgagagagtaggaaggcatgcaggacagaaagtggtagccaaaaactgctgtgatgagcccatgagagctgagacgggactttgcttcgggatctattcaacttcttattctattatgacgctggaaggagggatggagagtcttcccaccacagaggaggccagatcagagtttggccatgcaggaggagcagctgcaggtgtgtggacccccacaactccaccccagccaggtgcctgtggtagctcccaggaaacgccctggggccggcacccagcagccagtggcgggcaccatcagtgactaacatggatccattctgtggccatctaaaacaacaggctgcattttgctcttaaaagtcagcccctcccagctactggggaggctgaagcaggaggatcacttgaacccaggagctggaggccagcctgggcaacatagggagatttagactcaaaaaaaaaa

SEQ ID NO: 238860 - DNA, 377 bp, Homo sapiens
ctcttgtcgcccaggctggagtgcaatggcacgatctcagttcactgcaacctctgcctccctggttcaagtgattctcctgcctcagcctcctgagtagctgggattacaggtgcacgccaccatgcccagctaatgtttgtatttttagtagagacgaggtttcaccatgttggccaggctggtcttgaactcctgacctcagatgacccgcccgcctcagcctcccaaagtgctaggattacaggcatgaaccaccgtggaagaccaggagtttcttttccttactccctttattttccttaaaatcaatgaacctaatttttcctggcttcttaattgaatctgtgggctgcatcatggtcatcgttttcatt

SEQ ID NO: 238861 - DNA, 768 bp, Homo sapiens
taatacagatacttaaaaaaacagcatttaagaatttactgatgtgaatatctactagttgattgtctactcttgaagtttaaagcatttttaggaatttcacatagctttcttttttccataaggaatgcaactataacaatttctatcatttacatttactttaaaaatgtagaaatcgctgccaacctgaaactctttggttgttcaaatttaaactaaggaaatatgaattaaaaaaactaattaaataaacaatacaagccagcaagattctgtgtgacttacccagttttttccttccctccaccttctgttgaaccaaagataaatcttacatttgaaaaacacttaatacatagtgataaatatcaatatcattcactattttcagaccttacttgtaatagggtaataacttgatttttagtaaatcagagaccatcaagtactgaaagccaaagttgttcttatgtcaacacaggccaagggtaatgaattaatctgtcttactctttgtaaataatttgctgattaataaaccttaacatcacacaatttataacatactgagcttgatttattaatgctttacttgaagaaaagactaatctctgtgactacatgtgggttgagtaggggtaaggtatgcaaaaaatcccttctgaaacatgaaaaaaaacatggcatatttatgactacatttacactagagcaatcaactagataattgttctattgtgaaccaaccattataatgaaggttaa

SEQ ID NO: 238862 - DNA, 408 bp, Homo sapiens
gatggagtgggaagatgatcttcccctggagttccatcattctatggcctatctcctctctgacagtccccagtcaaactcctcttgatgttcagatgctccttatcttctccccttctctgctgtgccactctgctgctctgtgctcttctgctcgtggagcctgaggtttggggtttatatgggtacaggatagtggggtgtgatgggccaaaaggcaacattagggcacaaaaacaggaatgcctgttcccatttagggccatgggttttcaggcttgagggtggggcttttgccagggaacctccctcttctacccagtgtttcccagcctcctgtccatatcggtcttattaaccaaaaagtgactgaggcaagtgtctccattgatagaggatttttagcca

SEQ ID NO: 238863 - DNA, 287 bp, Homo sapiens
aatggcaataatgaggtaagccaggcagatacctttgggcatctccaagtccttgcaattggccaagacaacagctaacaacatttgaggctttaagaaggttaccctgtgatccactcatctgatttagtggctttggctgaagctctttggatatagttgaaggtatggaaagggtccttacatgaggactttagggtcaagtctcttgctaacatcctatgtgaccttgggtaaattctttgacccttatttttcttacctgtaaaataaaagaattgggctag

SEQ ID NO: 238864 - DNA, 429 bp, Homo sapiens
cagcaaaacgtgttacccacctacataaagggactcgctgacaggcgtgcgtgctgtcagtgagctgtagctctcccggacagaccctgaacggtggcaggtgagcactatgctgcaggccagaatttaaataaacaaatgaataaaatgtcctcttcactaacacatttacagggagttcagccacttacacacagagagaggcggaaacttgatcctgagggctccacaaaatcaagctcacctggcagcacaaattattgggttgatggtctccagtgggtgaaaagttggcatataaaacatttgggccgggcgcggtggctcacgcctgtaatcccaacactttgggaggccgaggtgggcggatcacctgaggccgggagtttgagaccagcctgaccaacatggagaaaccctgtctctact

SEQ ID NO: 238865 - DNA, 979 bp, Homo sapiens
gagatggtgtctcactctgtcccccaggctggagtgcaatggcgcaatctcggctcactgcaacctccacctcccgggttcaagaaattctcttgcctcagcttcccaagtaactgggattacaggcgcacaccgccagcccagctaattttttatttttatttttttttattttttagtagagatggggtttcactgtgttgcccaggctggtggtgtgtgcctgtagtaccagctacacaggagactgaggcaggagaattgcttgaacctgggaggtggagtttgcagagagccaagatcgtgacactgcactccagcctggatgacagactgagactccatctgaaaaaataaaaaagaaggggatactggtgtggtgacactggtgaagtgaagtattcttttcccaagggggaaacaatatgtaaaagggagagataacatagtacttagaaaatatggccaggcatggggctcacgcctatgggaggccaaggtgggcaaatctcttgagcccaggaacttgacaccaccctggacaacatggtgaaaccctgtctctacaaaaactacaaaaattggccagacatggtggcgcatgcctgtggtggcatatgcctgtggtaccagctatttgggaggctgaggtgggaggatcgcttgagcgcaggagggcaaggctgcagtgagccatgaccatgccactgtactcaggcatgggtgacagcaaaccgtgtcaaaaaaaaaattaaggaaggaaggaagatgaaattaagctagctatttggggaaaaataaatttagagctttgtggcacagtgtataccaaagctaattccaagtagattaaagggttaactattataataataataatgcaacaaaatactagagaaaaagattggcaagtgtttatctcatctttggatatggaaaatttttctaagcaaaaaagtaacagaagaaatcataatgg

SEQ ID NO: 238866 - DNA, 935 bp, Homo sapiens
gagatggtgtctcactctgtcccccaggctggagtgcaatggcgcaatctcggctcactgcaacctccacctcccgggttcaagaaattctcttgcctcagcttcccaagtaactgggattacaggcgcacaccgccagcccagctaattttttatttttatttttttttattttttagtagagatggggtttcactgtgttgcccaggctggtggtgtgtgcctgtagtaccagctacacaggagactgaggcaggagaattgcttgaacctgggaggtggagtttgcagagagccaagatcgtgacactgcactccagcctggatgacagactgagactccatctgaaaaaataaaaaagaaggggatggggaaacaatatgtaaaagggagagataacatagtacttagaaaatatggccaggcatggggctcacgcctatgggaggccaaggtgggcaaatctcttgagcccaggaacttgacaccaccctggacaacatggtgaaaccctgtctctacaaaaactacaaaaattggccagacatggtggcgcatgcctgtggtggcatatgcctgtggtaccagctatttgggaggctgaggtgggaggatcgcttgagcgcaggagggcaaggctgcagtgagccatgaccatgccactgtactcaggcatgggtgacagcaaaccgtgtcaaaaaaaaaattaaggaaggaaggaagatgaaattaagctagctatttggggaaaaataaatttagagctttgtggcacagtgtataccaaagctaattccaagtagattaaagggttaactattataataataataatgcaacaaaatactagagaaaaagattggcaagtgtttatctcatctttggatatggaaaatttttctaagcaaaaaagtaacagaagaaatcataatgg

SEQ ID NO: 238867 - DNA, 717 bp, Homo sapiens
gagaatccagctgtctgaagtcagacattaaagagatttacaaaaatataaactaatgccactattctcgctattttttttgctttgaaaataattatttttatataaatatattatttatgtttaagtttatgattaagtaaactagcacatatttttaaagtttctcagcttcttttccaatgtagtaaatattgatatatatagtccacataaatggaaagttctttggaattctcagtaacttttagagttcaaaggcattctaaaattaagaaggttgagaatttctgcattaagccaatgtccatttgtcatttgagttattggaacctgaactataaagttttccaaacacacgatttggctcaagacagtaaattacagtcaagggtcctttttcaggacatctatttttcacttttccttccttgaggtaaaaagtgtgctatattgggtaattatagcatataaaaagtggggatgttgactgtgttttatctctcttccaaggcccattttatttccacaccactgaaaatgctttaagtcttggagaggagcccatggctgcatgctgcccatttttaactgctgccctcgaaggccaatttcgcaggatggctggggactctggtgtacagcagacggtattaatatgtcacaaccattccctgggtcacaaatatttttaattaaagttgtcctataaatagc

SEQ ID NO: 238868 - DNA, 663 bp, Homo sapiens
gagaatccagctgtctgaagtcagacattaaagagatttacaaaaatataaactaatgccactattctcgctattttttttgctttgaaaataattatttttatataaatatattatttatgtttaagtttatgattaagtaaactagcacatatttttaaagtttctcagcttcttttccaatgtagtaaatattgatatatatagtccacataaatggaaagttctttggaattctcagtaacttttagagttcaaaggcattctaaaattaagaaggttgagaatttctgcattaagccaatgtccatttgtcatttgagttattggaacctgaactataaagttttccaaacacacgatttggctcaagacagtaaattacagtcaagggtcctttttcaggacatctatttttcacttttccttccttgaggtaaaaagtgtgctatattgggtaattatagcatataaaaagtggggatgttgactgtgttttatctctcttccaaggcccattttatttccacaccactgatgctgccctcgaaggccaatttcgcaggatggctggggactctggtgtacagcagacggtattaatatgtcacaaccattccctgggtcacaaatatttttaattaaagttgtcctataaatagc

SEQ ID NO: 238869 - DNA, 377 bp, Homo sapiens
ggagacaaggtctcactctgtcttccaagctagagtgctgtggcacagttatggctcactgcagcctcgacccccaggctcaagtgatcctcccacctcagcctcctaagttactgggactaccggaatgcaacaccaggcctggttaattttttattttttgtagagatggggtcttgccatgttgcccaggctggtctcaaactcctgagctcaaataatcctcccacctccacctctcaaagtgctgagattaaaagcatgagccactgcactcagccttagttttttgtttttgttttttttttattttagctatgtagcatatgtgacagtctttctaaagtctgccagtctccttctgtcagcactgctac

SEQ ID NO: 238870 - DNA, 436 bp, Homo sapiens
gttagatcatttggttcacttaagtatatacagtttgcctaaaaaataagatagaggatatgtcagaaactctgcatgaggtagcgacaagcattcatttgcatattttttaggataaatagataatacaagtggattgtggatttggattttggtgttataacaagtgtgaaacaatggtaaaacaatctgatttctgtgtcggaatctgaggaatgaatatagatcttcctatttgcttaaatgttatttgttcctggtgctacacagaggtataagaatgcacgtttatatgaattttgcattgctgaagaagtcaaagctgatctgagctagaataaccagggtaataataatgacaaataatcaccaggcttgtaaaggataatagtgcttacgtgttcctattagaaagatgaaattgcagcgtttcatg

SEQ ID NO: 238871 - DNA, 438 bp, Homo sapiens
aaactaaagtgttgggggaattactgtaccaggttttcttgagtttcaagatatatcagatgaaacatctacagaaatatcagatgagaaaatgatgcctcccaaagaagatagtgttctggctttccaattatctgaggggaaataaacagcaaaattaatatcctgaactcagtctgaaccaaaaacggagccaaaagaaaccttcccctagcattttaactaacacagcctttcagagtagagatgaatggaggagctggatcagaaataatgcaggatgaagagattagatgaggctggtaaaataattataggctggtaaattttttgtaccgtgctgttgatcaactttgtagatagcttatgtacaccaagcttctttcttgcctgagaacagaatagtgtggtatttgggagcaaaatgttagaatcaga

SEQ ID NO: 238872 - DNA, 513 bp, Homo sapiens
acaccaacattctagtagattttaaataaaggtttaacttctgcttctgcttatactgcttgtccaacaagtgtgagtagagacacagcctgatggagacttaatcttaacattctcaactatgattaccaaagcagaaaaataaaacacattaaatcacatgctggcttatgaaagcctccatctttaagtgacatgtgcactctcgttcatagttcattggccaaagaaagtcacctggcatgcctaatttcaaagtggtaaaaaaatgcaattcttccatgtgcctagatgaatgaactacagcacatatgtggtgaatagcatggtgagtgtcacagtgaatcagtgtaaaatatacaactcagtggtttttagcatatttgcagagctgtgccaccataatcacagtcaattttagaatatttttatcacccccaaaagaaacccatacccattaattgtcattctctacacttttgatttaatgaaaactaatcagataaaaaaaga

SEQ ID NO: 238873 - DNA, 1032 bp, Homo sapiens
aatattggccggggcggtggctcacacctgtaatcccaacacttcgggagggtgaggtgggcagattgcttgaactcaggagttcaaaaccagcctgggtaacatggcaaaacccctctctacacaaaatacaaaaattagccaagcgtgatggcatggcctgtagtcccagttactcaggaggctgaggtgggaggatcacttgagcctgggaggttgaggctgcagtgagccatgatctcgccactgcactcccacctgggagatagagtgagaccctgtctaaaaaaaaaacaaagaaatataaatattgtattagggtttaccaaagaaacagaaccaatacgatatatgtatgtatacgggtatatatataaggagattcatataaggaactgactcacaagatcactgaggctggcaagtctacaggatgagccagcaagctggagacccaggagaactgatggcatagttcctgtccagaggctagcaggcttgaaatccaggaagagtcagtgtttcaatctgagtctgaaggcaagaaacaagctgatgtcccagtcaaaagatcagaaggcaggagagattctttcttactcagggaggatcagtttttttgttttattcaggcctctaactgattggatgagactcactcatatgttagggaggtcaatttgctttactcaggctatccatttaaatgttaatctcatcccaaaacaccctcatacacacacccaggataatgtttcagcaagtatctgggcactctatggcccagtcaagttgacacataaaattaatcacaaatatgttccagtaacttagtttttaaacaactagattcttatgagaataaactcaggataggataggggaaatgctttctggctttccacttgcatattcttggaatgtcactttttcttaaatgttaaaaattgaaggccaggcatggtggctcatgcctgtaatcccagcactttgggaggctgaggtgggtggatcacgatgtcaggagttcca

SEQ ID NO: 238874 - DNA, 166 bp, Homo sapiens
ctgctcctatactgatgaatcaatcttgcaccccctccctcctgttacatatggtatctgttcatgttcctcactgaggcctctcttaagcactgggctccatcctcacttccctgttcacaaaggagatgggtttttgccatgttgcccaggctggtctcaaact

SEQ ID NO: 238875 - DNA, 566 bp, Homo sapiens
tcatgaccacactgtccgggagtgtccctcactgctcaaaatggctcctcaggctctcatcagttgtttcaaagctcaaccctccaatgaagagcttcctcagttgttctggctctttaggagactctgacttagataagacggccaggagaagagagactttaatgatgcttcttccgtggcatccatgggcagaaaggcataaataaattattaataagtttctagaacattcactgactcgcataaaaaataaagacctgagaaaaaagtttttacatgactctaaagaatgttaggaactttccatgcagaaggaaaaaaaatgacagaaaaatgatatagatccatttctgctttctagataagtcatctatacaggcaattagtcagttatttatttgtttctctgtggtgcatttatcaaagtccactgatgtctattggaacttgagttgcaacatggaacttgaagttctattttctcagccttttgtttttccattatccagaattcaaccagctgataattagttttctggaaatttctagtgcctttgatttaa

SEQ ID NO: 238876 - DNA, 516 bp, Homo sapiens
agctctacttcccccagtttggtagtaatccagctcacaaatccatccttacagcctactaatccatgttacatcctactagttaacgattgtcttctaaatgaggaatgccttccaattatttttatgtgcaaatacaatactgcaggtgcttaaacatcaataatggtaaaaacaacatggtaattgctctagactgaatgtttgtatttctctcaaattcatatgttgaagccctcaaccccaatgtggctgtattttgagatagagcatttacaggagtaattaaggttaaatgagtccacaagggtagggctctgatccaaaagaaatagtgtccttataacgggaggaaccagagagctctctctctctgccatgtaagaatacagtaagaaggttgctgtctacaaactaagaagagggccctcaccagaattcaatcatgctggcaccttatcttggactttcaacctccagaattgcaagaaaataaatttctgttctttaagccac

SEQ ID NO: 238877 - DNA, 406 bp, Homo sapiens
agagggcgtattgagattatttatgtcatcttttctaagaagacagttttattcctgccatgggataggaaaggtatcctttgatgtggtaaaccatggctggcattctcctcgatggctgctctaaagttgaaagaattggtggactcctggccaggcacagtggctcacacctataatcccagcactttgggaggctgaggcgggcggattgcttgaggtcaggagttcaagaccagcctggccaacatggcgaaaccctgtgtctactaaaaatataaaaattagctgggcatggtggtgggcacctgtaatcccagctactccagaggctgaggcgggagagttgcctgaaccactgcacactagcctgtgcaacagagccagagccagactccgtctccaa

SEQ ID NO: 238878 - DNA, 364 bp, Homo sapiens
ctacctcagcctaccaaagtgctgggattacaggcatgagccaacgcgcccagcctagaatacattttctaactttggatattcctggacacacatttgtgtggctagtgcatgtggttaagaaaaagggactgttcaggaaagatacttgggagtggggagaattatctactgggatgtacttagcatcatatcttattaaaattcttctggaagggcttttttgttacttagaatcttattttaacattaagctgatttgatttggtttggacatttctatattttttccctttagaagtgatttttaaatagctatcacaaaggttgagactaataaaaattgcttccactctaactcacc

SEQ ID NO: 238879 - DNA, 493 bp, Homo sapiens
taccttacacaaatactgtcatgaacctggcctcttatgtccccactcagtgcctcagattccttcactgctataaaataaggggttaaacagatgaccttcaggaccccctacctgtgccattttataatttctaagttgattccatgaggcagccgctgatacctgggccagagatatgggcttaggtcaaggacaagacccagtctttccagatttcatctctccaagctgacacccaattcaaaaaaaggagaaaaccaacagagaaggaggagacagggaatagcagaagaaatcagggcagccaaaaaagatattacaaattccatatattttatacgctgcgaagctttactcacgctacttactatttattttatatacaagcttagttatctggtatccaaatcatagaagataaaagctgcaaataagaacagagaggaaggagccagctagtacagaaacaccaaacaaagatgtgacagca

SEQ ID NO: 238880 - DNA, 421 bp, Homo sapiens
ataacaaggcccatacttgttatgtgtttgatagtagtgagcagcaggaaccagaggcagtacagagccctgagttatttggagacctcatgaaaagccttttgagcccagtctgacttcttaaaatcacaaccggccaggagcagtggctcacgcctgtaatcccagcactttgggaggccgaggcgggcggaggtcaggagtccaagaccagcctggccaacatggtgaaaccccatctcttctaaaaatacaaacattagccaggtgtggtggtgcatgcctgtaatctcagctgttcgggaggctgaggcacgagaatcgcttgaacccaggaggtagtggttccaatgagctgagatcgtgccattgcactccagcctgggcaacaaaatgagactctgtctcacaaataaaaact

SEQ ID NO: 238881 - DNA, 504 bp, Homo sapiens
tgttaagcgatgcgtgacggtacttgttgaatgaatgaatctgaacacatctgttgatgttctggtttgggactataatttgttgtctaagtttgagtagaatttgtgactccaaggaggtgggcttaaaaattgtttttggagatagttaattgttgtgctgatgagaagcagctttttctttcattttgatatttcatatgaggcgtattcttacgtcattaaaaagtcttcacacacaccctgcttggatatgcctcagatgcacacaccacaacatgctgagccagtcttccctcccctccagctccctcccctcaagccagctgctccccttgcccctgcccagttcgttttgatggttacagaaatgcctctcacccccagcagctttgaattcttgttatttttaattaatctttgctgcctttctatacaagacataagccaaacaatacaattaaatgacagtccctgcttaaaaaaacccaaagggcggccgct

SEQ ID NO: 238882 - DNA, 415 bp, Homo sapiens
catgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagacaggcaagcagaggggacaaaggtagctgggttatacatgaatattctcattac

SEQ ID NO: 238883 - DNA, 1645 bp, Homo sapiens
  misc_feature (1449)..(1449): n is a, c, g, or t
atatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgngcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttac

SEQ ID NO: 238884 - DNA, 577 bp, Homo sapiens
agactgatttttccatgatggtgtcggtaatcaagggtcctgtgtgaagttctttagtgtctcttaaacaagaactaaattcatttgtctcattgctgcaatttgccatctgttctgctacaacgaaggaattgcattcatgagaaatcttacattaccaaaaatcatgacatcaaaacaattgtttgactagaaaaaataattagggattggataatatcagactcataataacaatgttatttttcttatagaattttttctagtaaaagtttttcttaaaaatagctatgaaggtattagcaaaatttttcagtgaaaataatctagttttggactatatatagcatttgctctggaatagtagtctttgtttttctttacggcctacactatcattagcagagaaccttttacaccatcctatttccattgtcaccataatgaaacaccaagtctaccagacaaacccactgttacagacaacagcttctctcatgctaaggggctagttacagatctagtataatgtattcctaatactaattaaattccctaattttatccaaattgctcc

SEQ ID NO: 238885 - DNA, 476 bp, Homo sapiens
cactccagcctggtcaacagagtgagactccatctcaaaaaaaattattggctggtttaatagtagtaggttatcagaacttactaacattagtatcactaaagtaggtatacaacccctgctgctcaatttggctttagaaaaaacatttttaaaaactgctttatcataatccttttttccagtgcatttttgtgtttggtagattaaatgactgatttctttcttaaattacttggactgagttctagttactggacatgagaattaaccatgtccagtagtaagttcattttcctacagtgtgcctgtgagtggagaaggaaataggctgcaaaagagcccgatggaactttggggtgatggatatatttccatctagattggtgatggttctaggaccgtatgtattttcagagctcatctatttgtacttgtgtataaatacttcaataaacctaactttttaaaaagct

SEQ ID NO: 238886 - DNA, 643 bp, Homo sapiens
ggcaggcaagggggagtctctctgtgttgcccaggctggtcttgaactcctgggctcaggctgtcctccaaccttggcctcccaaagtgctagaattacaggcatgagctgctatacgtgggccacaggtaagattgtaaaagatccatttaggccttctttatcccttggtgatactcatatatctttttgaaaatcaaaaacgtagatataagtatatagattatatataaaagtccaccatttctgaggggaacggatcactcttacactacttttttttttttttttttttgagacagagtcttgctgtgtcgcccaggctggagtgcagtgtcgtgatctccgctcactgcaagctccgcctcctgggttcacgccattctcttacctcagcctcccaagtggctgggactacaggcacccgccaccatgcgtggctaatttttttttttttttgtatttttagtagagacggggtttcactgtgttagccaggatggtctcaatctcctgacctcatgatccgccctccttggcctcccaaagtgctgggattacaggcgtgagccactgcgcccggcctacttttgtttaaaaaatatatgtgtgtgtaaccacattcaggtaaaaaattattgcc

SEQ ID NO: 238887 - DNA, 310 bp, Homo sapiens
tcctttcacctgccccaaggcaggactctaatcttctatctttctgattgtgggttttaagacttttcccagaaagaatctgccctgtaccctgggggaaggaatgctgatgtcaggaagcctccataaaaacccaagggaactgggttcacagagcttccagatagctgaacacatggaggttcctggagagtggcgggcccagggagggcatggaggtttcacatccctccccctgtatcttgccctatgtgtctcttcatctgtatccttcgcaatatcctttataataaaccagtaaacacaggta

SEQ ID NO: 238888 - DNA, 478 bp, Homo sapiens
agtctatgtattatctatacctgctttcgtgctaccagagcagaattgagtcattacaacagagactgtgtggcacatcaagcctaaaatgtttgccctctggttccttatagaaaaacttgccaacccctgctctagataattcatactttactagctaattgttgaatgtgtgataatcttggcctaacaagattacaatatttttaatggcaaagaccatctctgtctctctatttttcagaccatctcttggaactcttctataccctacaatctctaacaaggtcctggaaagggagaggcttaaatgcatcagttggtttgctggttgcgatgaaagtttactagaccaggaaagaaactccttcatacctgtaaagagaggcagtcaagccctaggttcctggaatcagattgcatgggctcaaaccttggctctgctatttacttactgtggccttagcctcataatctt

SEQ ID NO: 238889 - DNA, 691 bp, Homo sapiens
cttagaaatcctctcctcccagctcctcacaccctctgacacgtgcacaccctgcatccacaaaagtggagcctgttgcttcccctggcattcaccgaatgtagggaaagaatgaaagcaatggcaaagcctcgctacatgggcagcagttacgtctatcatcctaacatgtatcgtgtctgtatcccctagagcacagtgcagtgcccccagagggtgtgggggactgaatggccagaaatgaggcactcagcagattcccctgagcaacccactcccaccagaacgcaccccgggcgaggaaaccctctgaaaacatctggagttttaattccacacctgcagcttgacaaggtccctccttggtgcagaggaaaagctgctgcaattttcctagtacaagaaaaagagcaagcaagccctaggttgcaaccggtagggttgtggagtacagtgggcacaccaaggtggggtgagaggaaaacttcagttctaagtcccctcccagtgccaccgttacctggagtgtggctggaggaagagaggaagagaacaggggttgggagagatgcacaccacatatgaatgacatgcagactggtttaaagtaatgatggccactccttgcctctttgaagttgcatgtctatcactatttgatttcatggcactcttgaaaaacctctcaagt

SEQ ID NO: 238890 - DNA, 422 bp, Homo sapiens
tcagactagccactcagggttaaaggaggcactgcctatggagtagaagccatttgttcctctgtgtaagtctagctgggccccataggaatcagacccatggtttgacctccttaaggccactgccaaccagctgagctatggcgtagggcctcaggaaacatgtgcagtacatcaggaggcagctgggtggttacaagactacgtcaggagtctctcaaactgtgtcttcacatcctagtcaggcctcaccagtcctctgcccaagccatgcacccagaacccagagcagttcatcaggataactggtgagtggctcccctggccagcatagctgccccagagcctctctgaaaaagtgagtgtgtgttgtgaacaggcacctcctacctgctgtgccctcctgctcgcttctcaattct

SEQ ID NO: 238891 - DNA, 475 bp, Homo sapiens
cctactccatctttgtgtccttgtttgtcctaagcagcatggtggcagccgtggcattcatcaggctaaagtgacaagatgccatttggcacttgggctagagatggcagggaagcagcatcatttgtctagggaaatgtcagaagtttgttgtctcacactatggaaattgaagatgtggacgcaaaaggagtgggtttaagagtggaagtttaataggcaaaagaatgaagagtttcctcgtgcattgaaagggtatctgagcaggtttccgggtttggggcgagttgcggttagttttatagatgagcttgaggaggcagtgtctgatttacatagggctcagaggattggttgtgccaggtgtgccatttaggtgatgcatgaagaggctggccattccaccccaaacttttattatgcagatggggtctctacctggcaggtgccatgtcgcctgcacaggtgaagacag

SEQ ID NO: 238892 - DNA, 412 bp, Homo sapiens
caggctcgtaaattaaacactggtttatattccagctcactgagtgaacttggtcaggttatttaacctctgtgagcctaagttcctttgtctgaaaatggaaataataatagtataagagtagcttatggctgggtgcggtggctcacgcctgtaatgccagcactttgggaggccgaggagggcagatcacgaggtcagaagatcgagaccagtctggctaacatggtgaaaccccgtctctactaaaaatacaaaaaattagccgggcatgctggtgggcacctgtagtcccagctactcaggaagctgaggcaggagaatggtgtgaacccaggaggcaaggcttgcagtgagccgagttcgcacactgcactccagcgtgggacacagagcgggactccatgtcaaa

SEQ ID NO: 238893 - DNA, 378 bp, Homo sapiens
agctggaaggtactatggagcagaactgccacagcctgagtacctacctctggaactttctgtgagaaatgaaatgggcccaacagttccataaacagttgttttgggataaacatagaaatggcccctagcttgaaatttgcatttgttttatctgagttccctcctcaggaaaggaccttcaggcctctcaaaaaagtatcaagagaactgacaccagatgcctccttgcccctccctagttcctgttttcttaaacattgttacatatcttccctgctatgtaagcccctagatttagtcagtcagggagatggatttgagactgagctctcataacttggctgcagcacccgattaaagccttcttccttggca

SEQ ID NO: 238894 - DNA, 499 bp, Homo sapiens
agccctccctgacccccaagcatgagccaagcatccactaggctctcccactccagccttgcccattctgggtcatcaccgtgggggacttgtttgtcatccccagtggactgtgagccccaagatagcagacctgaggctgtcactgtcatgactgtgtccccaggaccgcctaccactgggccgggcataaaagaggcactcgaggaagtgtttgctgagtgattcaatgtgtcagctccagagccagactgcctgtatctgggccctaaagctactgcttgattagtgatgtcaccataggcaaatagcttaagctgtatgactcagtttcctcatctgtaaaatggggtgatggtacctaataatacagtagagcacttaacacagtaggtggcacatggtaagccacatactgagtatgtatttgctatgattgttattgctattattactattattgttattattaacataaactgcacaagagcaggctttt

SEQ ID NO: 238895 - DNA, 454 bp, Homo sapiens
tcagaagcatttgcattttagcagggcacttttgaatagtgaaaagccattaagtcataaaggaacaaatttctaatggaattgcagtgggtaacataaaatatagtaagatggcgttcagatgtgtataaaatgaaaagaataaggtggggagggagttcagaagagttattgcaatacattcttccatgccacttttgaaggcttttagttctaatccactgacaaatttttgctctgccatttttgttgtagtaatacaaaacagatgtatgacttagaaaggggaaaggacctctccctactacacagtatattacgaacttggaaacagattaaatctcttcgacatgggcaagggtttacaagcaccccaataaagttacaggttcagaggattaaaatgaataaatgtgatgaacaagagcaaatctcagaaatgtctgaaactgag

SEQ ID NO: 238896 - DNA, 579 bp, Homo sapiens
ggttcaagcgattctcctgcctcagcctcccgagtagctgggattacaggcgtccatcaccacgcccagcctatttttgtatttttagtagaggcagggtttcaccatgttggccaggctggtctcgaactccttacctcaggtgacctgctctcctgggcctcccaaaatgctgggtttacaggcgtgagccactgcactcagcccaaaatctttaactttttaaagtaagtgatacgttaacatgattaaaagccaaaagtggccaggtgcagtgggtcacacctgtaatcccaacactttttgggagactgaggtgggagaatggcttgaggccaggagttcaagtctagcctggataacatagcaagattccatcttgacaaaaaacaattaggcgtggtggtatacatgtatagtcctaggtacttgggaggctgaagcaggaagatcgctttgtctgggagtttgaggctgcagtgagctgtgattacacgactgcactccagcctggacaggtaatgtctgtcaaaaaataaataaataaagtcaaaagtatgaaaaagttatacagtaaaa

SEQ ID NO: 238897 - DNA, 222 bp, Homo sapiens
cctttaaaacttaattcttttattgtttcctttttcttctaatgcttatgtaaagaaattttgatattatagaactgtagaattgtagaagtgcaaacttcctgtattctttcctttcccagaaactgttatttttgttgtatattctccagcctggacaggtaatgtctgtcaaaaaataaataaataaagtcaaaagtatgaaaaagttatacagtaaaa

SEQ ID NO: 238898 - DNA, 724 bp, Homo sapiens
ggcagaggccttgctgtgttgctcaggctggtctcaaactcctgagatcaagtgatcctccctcctgccttggccttgcaaggtcccaaagtgctgggattataggcgcactcagcttaaacttctttgttaaaatgtgtgtgctttagtagattccttatccatatcctttgcccgttatttcccttcagtggttgtcaccttcttattccttttcattgttcaggaatcacatttttacaaaggatttacaaacatatttgaccataccttacagttccttggctttcatactttattcctagcagtcttttcttacctttgaacctctttgtttccatcttttaatggcttctacttttttcctagcctttatgtattaccagaaatctataatgggaggtagcactgtgcaatttataacatattcccttctccagtttagggtaccccttttctgtcgaggaaatacctagggaaaagaagttagaacagaaggagataggcctttatagaaaaataatttcttatcagaaaataaatacactttttttttgtttttgtttttgtttttgagacggagtctcgctctttcgcccaggccgaagtgcagtggcgcgatcacggctaactgcaagctccgcctctccggttcacgccattctcctgcctcagcctcccgagtagctgggactacaggcgcccgccaccgcgcccggctaat

SEQ ID NO: 238899 - DNA, 350 bp, Homo sapiens
cctgctgaatgtgaatgaaaggggatcctccaacccacccacacctgccctctgtctctacctggccctaacagttacagggggtggaggaagacttgctctatcccaggggcaactcagcattggaatgagacagtgggaactggcaaacacatgacttggttcaggctcttggaacctcgcagatcttggtttgacttcctgggctgctacttgcttacttgttttgggccagaaggccctgggtttgaatctcaggttgacccttggacaaacatctacaggtgtggaagtgagcaccacgcctctggctggacaggcttctgaagctggcaggctatgtacttcct

SEQ ID NO: 238900 - DNA, 646 bp, Homo sapiens
cggaaatctggccactgggccaaggaatgcccgcagcccaggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctggaccatcacggatgccaagcttccgtaactctcacagtggaaggaaactgaagcatatgttacctgggcatccttgttcttagagcttccaagatggtggcaagcctcttgttctctgacctggggttcttggcctcacggatttcaaagaatggattcttgacccatgcggtgaggtgttatccctctattcagctcgattaggacgaactcggggcacttagccctcgcaggaacaatggcgagcctctagcccgattgggagcggcagtgggcgctgcctcactgggtcagaagtgcagcagacaccctgccggatctagaggggtgaagtcagccgcgggtctgcgacagcggcaaacagcagtggtggacagcgagcaaaagctcagctcgagcagtaataaatatgggccaga

SEQ ID NO: 238901 - DNA, 87 bp, Homo sapiens
caaggaatccccagtaagtgttttggcagattcctcagccgaagtttgaagaccacaaggcagtgggatgatatatttaaagtgtta

SEQ ID NO: 238902 - DNA, 572 bp, Homo sapiens
caaactgatgggattacaggcatgagccattgtgcccaccctaaatttagactttaaaaataaatgtatattttactcatttcaacagcatctacatattgttgaaaacatcttcatttagacttgcttatttaagcattcaacaaacacttattgaacatcaacaatgtactgtcagataggtttctgatttcatggagtttaccttgtagtgaaggaggggcaaagaaaaggtaagataatctcagataatgacaagtactctgaagaaattaaaataggatatgatagaaaacattacttaagatgggtgttcagggaagacctctctgaggggattgcctttaagctgagacttgagtgacaaggagtaagtgaaagtatcatctgcctacagtcaaggagtgacacatatacacataaatttaagtccccagattaagaaccactgtcagccaggagcagtgactcatgcctgtagtctcagcactttgggaggctaaggtgggaggattgcttgaacccaggagtttgagaccagcctgcataagagggtgagactccatctctac

SEQ ID NO: 238903 - DNA, 687 bp, Homo sapiens
atgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaa

SEQ ID NO: 238904 - DNA, 549 bp, Homo sapiens
catagtgtaggagatagcaggcatgaaccatcactcctgagcctcatttaaaaattttctaaccttgattgagcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaa

SEQ ID NO: 238905 - DNA, 506 bp, Homo sapiens
acctctatgttctcagtctgctcagcctgtgttagtggagaagagggaaggaaactggctggaggccgctggacccacagaggacaatagacaatctcctgctgatgcccactggatccaaagagagaaactctatagaattatgatctaggtttgactgactcctggcaagaagccctacccgccagccaatttggatgaggtcacaggggtcatccatctttccttctatgtgactggtttgctcttgcatatcatgttttccgctcttatgctccagatccatcatgagaagacatgccctggattcctgctatccctttagccatggctccagaattaacacacacaaggaagacctgaggtcaatccacagcctggattcaagtcacctattacgtaggagaatcagagctacccagccaaactcaatctacgttaactgaacctcagctgacctgcagatttatgagtatgagaataaaggcttgttaatgtatatcatt

SEQ ID NO: 238906 - DNA, 390 bp, Homo sapiens
ataggattgtacattcatacctttgtctggtaactttgctgtgccctcctgctgggtttgtttcctcaccccatgtgacttgctttggcaatgaaatatgagtagatgttgcaagagcaaaggtcttacctgtgtttttttatgatttggctcagctcttatgctccagatccatcatgagaagacatgccctggattcctgctatccctttagccatggctccagaattaacacacacaaggaagacctgaggtcaatccacagcctggattcaagtcacctattacgtaggagaatcagagctacccagccaaactcaatctacgttaactgaacctcagctgacctgcagatttatgagtatgagaataaaggcttgttaatgtata

SEQ ID NO: 238907 - DNA, 272 bp, Homo sapiens
taaaaggttaagaaagagggaatcctccctaactcattctatgaagccaatatcaccccaataatgaagctaggaaagaccataaccaaaaaagaaagaaagaaagaaagagagagagagagaaaaaaagaaaaggaaggaaggaaggaaggaagaaagaaagaaagaaagaaagaaagaaagaaagaaaactacagatcattatcattgatgaacatagatgcaaaaatcctcaacaaaatgctggcaaactgaatccaacagcacatttt

SEQ ID NO: 238908 - DNA, 674 bp, Homo sapiens
tctctactgaaacgccaggtacgaagggacaggccctccacagtcaccttgtcacattcctttggggagcgaagagttcagacccaacatgtcacccaaattaccctggccagccaccacgtaaagatgctgcggctgtgcatggtggctcacgcctgtaatcccaacacgttgggaggccaaggcgggcggatcacctgaggtcaggagttcgagaccagcctggccaacatggcgaaatcctgtctctattaaaaatacaaaaattagccgggtgtggtggcacacacctgtggtaccagctactcctactggggaagctgaggcaggagaatcgcttgaccccaggaggctggagtgcagtgagtcgagatcacgccattgcactccagccggggtgacagagcaagatgccatctcaaaaataaataaataaagatgcttaacatcactcagatagtagtggggtgattctaagaacatgtcctattgtctacagggctcatgggtgcacagaaggatagacggggtagccactgcaacagggctttgtagaaaagtcagacaggaaccaacattgatgcccatatgtgaaacatcatgatgcagccataaaatggaataaagatggaatcccgtctgcatagacgggcatggtccaaaatccaagtgaa

SEQ ID NO: 238909 - DNA, 357 bp, Homo sapiens
agagcatggtcctcagcagttttaatttattatataaagaaaataaatgtgtagtttactgagcacaaggtatgtgccaagtaccattttaggggctcattatgtctaggaatactgattgtcatcaagtactctctaatactggtgagagaggttgctgtttgcctcctaatccagtttctcctcctctctgctaaaaatacaaaaattagctgggcgtggtggtgggtgcctgtaatcccagctactccagaggctgaggcaggagaatcgcttgatcccaggaggtggaggttgcagtgagctgagatcatgccactgcaccctagcctgggggacagagtgagactccgactc

SEQ ID NO: 238910 - DNA, 164 bp, Homo sapiens
ggacggcctcatttgtgtgggtggtggtttgtgaggtgggaaagctaaaatgaagaaatgcgtgctcatactgacgttcttgaaaatgcgtagtgacatttttttaaagctttattgagatataattcacataccataaaattcacctgttttaagtgtgcacc

SEQ ID NO: 238911 - DNA, 648 bp, Homo sapiens
actgaaggctgcactgtcagcttccctacttttgaggtttttggacttggactgacttccctgctcctcagcttgcagacagcctactgtgggacttcaacttgtgatcgcatgagtcaatacttgttaataaactccccttcatatatacatctatcctattagtcctgtccctctagtgaaccctgtgcccaaatggatgatgacaccatcccctgttgatatggacaggaaacagggaaacactaggtagaagagggtggttccctggcaaaggcccctatctcaagcctgaagtcctgtggtcctaaatggggacaggcatttctgttttcatgtgaagaagttgccttttggcccaccatgccctctatcctgtattcatataagccccaggctccagaagcagatgagaagatgaggagacaagcagatggattgcaaaatggtgcaatagagaaagagaaaagaagaggaatgtctgaacactgagagatttccagctggggtggtcagagaagggttcagccacaagatggccaaaatccagggaagatcttcttcccactccattccctgcttcttgttccccatccatcccactgagagccacctctaccactcaataaaacctctcattcatccttc

SEQ ID NO: 238912 - DNA, 395 bp, Homo sapiens
tgaaaagcagctctgtcctcattagcagtcactccccacttgttactcccccagcccctggtaaccactaaccccctctatcttgcatttgcattcattcattcatttattcattgtgagacagggtcttgttctgtcacccaggctggagtgcagtggtgcagtcacagctcactgcattccttgacctcctgggctcaagcgatcctgcctcctaagcctccagcatagctgggactacaggcatgtgccaccatgcccagctaattttttatgttcattattatttatttattttgagaatcacttgaacctgggaggtggaggttgcagagagccaagatcgagccacttcactccagcctgggcgacagagggggaatccatctcaaaaa

SEQ ID NO: 238913 - DNA, 410 bp, Homo sapiens
ttttggctctatcaaaacttaggtctcaattataacattactaaagtgcttgtaaaaattatcccagatttctggctacagcttgtataaaggcctatttttttttttttacagttttattttggttgaagatttttctccaaaatagctattccagatggcttaacagtcccagaagtgaaaaatcttaagatatttcatttataaccattagagtcttaataaaaccctagtaaatactctcccttctggatggtttaaaggtcccttcaggcaagctggctgcgtaaacaccagagccctcttcataagataagtttgctcaaaaggtcaacttttacagagaaattcctacctcattagtgtaagggaaaattaacatgacctgttttcattacttaaaatgcaaa

SEQ ID NO: 238914 - DNA, 448 bp, Homo sapiens
ccttaactctctgtgttggtgtctgagatttagacaaagcaggtacctctcccaatcttcatggaccggtcctgtacaggaggagactctcaccaatcagccacagattctggtgctttaccaaccctttctctcctgagggaaaagcaggcagctgttatttttgtctgttcattctgtgctgggaagggggtgagtagggggaagttatggtatctatcaccccagactaccacctctgttctctcctggccagactgtacaagacctatcaagagatccaggggagagatagaggcttgttcttcaggcagccccataaaagttggggcagtggtcacactgactctttctctccccagagagaagcttagagctgagattcttcatcagttcactctatgctgagcaggggaaagggtcagtgatgtctgccagctctagctgt

SEQ ID NO: 238915 - DNA, 396 bp, Homo sapiens
gagacagagtttcgttcttggtgtccatgatggagtgcagtggtgcgatctcggctcactacaacctccacctcccaggttcaagccattctcctgcctcagcctcctgagtagctgggattacaggcgcccaccaccacgcccggctaatttttttgtatttttagtagagacggggtttcaccatgttggtcaggctagtctcgaatacctgacctcaagtgatcccacccacttctgcctcccaaagtgctgggattacaggcgtaagctaccacgcccggcctgtattttgctatttttttatttttatttttaagaaataaaacagtatagatacaattaaagttcattgtttatctgtcctcaatcccgttcccttctgtcgtcttctct

SEQ ID NO: 238916 - DNA, 419 bp, Homo sapiens
aaagtccggggttacactggagttttgttatagttgccactgtgagcccagacaaagtgttttatttttttcgagacagagttttcttcttgtcactccagcctgagtgacagagcgagacttcgtctcaaaaaaaaaaaaaaggccaggcgtgatgggtcacacctctaaacccagcaatttgggaggcagagacaggatgatcacttgaacccaggagctcaggttcagcctgggcaacatggtgaaaccccatctctacaaaaaaatacaaaagttggcatggtggcacatacccgtagtcccagctactcaggagactggggtgggagccttgcttgagtccaggaggttgaggctgtagtgggctgtgatcacaccactgcactccagcctgggcaacagtgagaccctgtctt

SEQ ID NO: 238917 - DNA, 495 bp, Homo sapiens
gtaaatgctttggtttttatgactgtagcaactattttttaagaaaaacacctttagcaatttttaaataactttaatactcacagttgcaatttattaaatatctaaactgttcttagtgccgggatgaataactataaataagcatttttctataccacactctttgaaattccctaaacatgttctgctgttttacaaaaatgcacaccatataaaaacacctataattatttcttccttgtatgaaatgcctacacttccatccacatctccactttgctcccttggtgattgtccacacagtactcaaaccttattttattatttatttatttatttgagacagaatctcactctgttacccaggctggaatgcatgagccaagattgcaccactgcactctagcctgggggacagaacaagactccatttaaaaaaacaaacaaacaacaaaagtatccattcctctgagtcaataaaagatgtatgtt

SEQ ID NO: 238918 - DNA, 720 bp, Homo sapiens
ccgcttggtctgcctctgcttttctaaacttttcatcacgccatcagcaagactgtgagcctagaaggtggccaggtaaacatgaacatcacttcccttcacaggatctgcttattcacattctttgtctcttaagagagtggcccagtgaccttacccctaccagaagacaactgacaaaaaggggctgtggcagtccccagacgctgagatcaacacagaactcaaattctacacgtggagaacagcttggagaaaaaaacaatatgtgtaatcctgttatttaaacagtgctcaacagaagacacgattaattttatcgagctgtaatacagaatgtaagaagcctgagggaaattccttgttcttcaaatacagcctgttgttacctaagaccgggtgttcagggaggatgagagattcagcacgacacagaaactttccttcttgctataggagggcttcatatttagagggaagaaaaagataaaccatggtcattttctgtttgtgaagacttattccccaaaaggtagacatggaaaaaaatatggttatcaaaacaagtaagtgaaaatacgcaatataaatgaacccgaggttttaagtgagattctggacctactgggtgatctttggccaagtcagctaacatctgcctgtgacccagttctctttatcaatactgataatctctttattagtgctaatttctttcaa

SEQ ID NO: 238919 - DNA, 539 bp, Homo sapiens
atggctaagagaatatggacatttcatttttcagagctttcacagaaataggcagtttgtattggaaaattagagcaattcttccttccatattagaaatgttccattgctctctctgtaatgtttctctcacagaaggctcaggcacattaagtagcttgccaggatcagccagttcaccactgcccttttcctaatgtgaaatcgtatgaagtaaaggaaatcagcttaaattaaatgtttttgtatttatgctgcaaagatgacgactatgaaagcagtcttcagtctttgttgctcttgtgtctttcactgcaggtgtcacttgctcccactccccctttctgggtagatttctttttctctcacctttacaataagctatttttattaaaagagaaaaaaggaaataatgatatctatagggtcgatcattaagtttttgtcatctttcttggtcacacccctgaggggtgcagttctttgagggtcatggagtgtcttttctcagtgtattaccaggaatagttcatcttttt

SEQ ID NO: 238920 - DNA, 450 bp, Homo sapiens
aagacccaagtttttgcagttgagtgtggttgggatctggaggatgagaatgccgggcgttccctagacaaacaacagggacagactcacatagacactcacgcaggcactcaacacacataagtgcattctccctcttacagaagtatccagatgttagatgtgcatttgtgagcacacatacataagccacagaagaggccgaggtaggaggatcacttaagcccaggagtttgaaccagcctaagcaacaaagcaacaccctgtatctaccaaaaaaaaaaaaaagaaattattaataaattacctgggtgtggtggcatacacctgtattctcatctacttgggaggctgaggctggaaggttgaagctgcagtgagctgtgatttgtacactccagcctggacaacagagcaagaccctatcttaaaaaacaacaaccaccacca

SEQ ID NO: 238921 - DNA, 369 bp, Homo sapiens
tgccagtgcaccaggtagggccccagggaggagactgggcttggttctgatttaactcatgagaaataccaggaagttctgaggaagatgaaagaggaaaaggagacgctgcttcttgaaaaacaaatatccaaagcccaggatgactcctctcaaacagtgaaaccgggatcaattttggcagacaccacccaaagaaacatggagaggaccaccattaagaaacaggagagaaggtgttggtacaagtaagcggaagaatcttgcttttacctagcctagaccacatttcactctacacattacctgataagggccaaaagaacaagaataaacacatcatccactgatcagaatacataaggcagc

SEQ ID NO: 238922 - DNA, 457 bp, Homo sapiens
attcaataagtgattttggttacatagtccttgtaattcccttatcccttggttttgtttagtcataaaaggagacaactttctctcctgatgcaaattgtgatataaacttaaactgacacaattccactcacccactcaaaggtgtgtgtacaacatttaacttctgaaaatgtactttgtgttttaaacttttgagtgttcagtctcacctagaaattgatgaatctggtttcttgattctactcaaatctttctagaaactcttaactccttttttgaagaagttcatctcaaaagagcaccaatgaaggtttaaattcttcataatgacccccattaatgtaagcagcattggcccccaacactgcaacttatatgtgattatctgattatttttcctaatttatgatgtgtggcgataggaacagtaactgctgatcttctagtttattgg

SEQ ID NO: 238923 - DNA, 419 bp, Homo sapiens
gaaacatcatacttgcaatataatgaagatattttaagacagtttagattataatttgactaatttagattcataaccaaacactatcattttcttacaagaagacaactggagtacaaatggccacagattttcctattaaccgagtaaattggttaaaaggaaaatgaaattggcaaatttagtttggacttggcttccttgcgcttcgctttttgccttttactaaataaagattggtcatctaaactaatgagttttctcgattgtctgatgaatccaggatggagcagagtgattgacgctacacacctaaaaggatacggtaagaagagttgccaccagcagaagggaaaactcatctgcactctctttagtatgcctgtgagatttctttccaagtatagccaacaaatgac

SEQ ID NO: 238924 - DNA, 470 bp, Homo sapiens
gaggaagaaaagagttggatcacatatttaacgtttcaatttttccagggattgcctgaggaactggcttctgtctcacttgtcttagaatgcagatgagtcccagcatattctagacatctgggagctactaagaacatagctgatggttttgcctagcatacagatttgagaagcccccagaatctctggtcaggctgataggtgaaggtcttcttttgtttgaggccagtccatgaaggctggaagaggtagctgttttgtttaacatccagatatactaaaatgaagaaccaagggaaaaacaaccaggtaaatatgtccaaaacaaagtacaagattaatctccagaaatcaaacttaatgcaatggagatatattatgtctctgatggaaaattcaaaataaccatcagaaagatgctcaatgaggtcaatagaacatgcatgaacaaagtgagaatttcaaca

SEQ ID NO: 238925 - DNA, 333 bp, Homo sapiens
ataaacaaacaaacagacaaacaggcaaaatacccattacaaaatctaaaacccttctttcttgaaaacgatactcctgctattgctgttcaaggaccacctgcgtgccccttggggcccactgagcacctgccttcattctctccttcatttacggactcggtccacccacacagctcacaaacccaggtcatctagggccctggatgatggagtccacagaataaaccccacattctcctagttgccaccactcaccacaccctcccgtccttatctttattcgactcaagagaccagcagttatcgggcaaggtgcagaggttggtaccg

SEQ ID NO: 238926 - DNA, 638 bp, Homo sapiens
gtagggccaacataaccatggcaaccctcagtagtatgtgaatggttgcaggccccttgctggtctgtgagaagtctaatttcaagtacaacaagaaatgaagccagcatctaatggagaagtaatgtcgcctacactaacatacgatacaaatattgataaaactgttgccctcctaccaaatgggaaattaattactggatacatacagctatgaaaaaactggacatcaagattgtccatctctacctctgtgccaaactctagactttcattaataagaatgtatcaatattatttcagtcattgtaacatttaccacactcatgtaagatgtgattacaaaaaggatgctgaggtgggggaagggtgtatgagaactttctgtactacttcatcagtttttatgttaattcaaaacagtttcatataatgtccattaatttaaaaaatatggcagcattgttcaggaagtgtttcattttagttaatgtttaacaagcagctaaatatctaaatactacattgagatattctatgctattaaaactgaaacaattttgaagttgtaaatgtatcttctgtagttgtagcactagtgattgacttaataaacttaaatttgcacacatgaaata

SEQ ID NO: 238927 - DNA, 199 bp, Homo sapiens
tgtatatactctgacttagttctggctgctataacaaaataccatagacgtagtaacttatatacaaacaacataaatttatttctcaaagttctagggtctgggaatttcaagatcaagtctttggcagatttgatgtctggtaaggttatgcttccttgtatgtagatggccaagttctcccttctgtcgtcttctc

SEQ ID NO: 238928 - DNA, 405 bp, Homo sapiens
gccagaccccacatgatacgtggggcaagtagctctgagatgttctgattaatgtttccagaagtgtcacgaagaaagaacagtgtgctccctactcccaagcctttcaatggagagcaataaaggcaagggttacagaaatacggaaatctgacgacggtttagggagacatcaagcctctcccctgacgaatacaatcagaatccttcaccgggacccttactgagattaacaactcctgttcccatgtgcactgcttctaggatgaattaagggaaatggaaaatgcttcctttgctttctttcccatcaagcccagtttgtcaggctcacttgccatggcctctaaaacactccagaccagacaggtattgagtattccaatccaacagctggctcaccat

SEQ ID NO: 238929 - DNA, 693 bp, Homo sapiens
cccggatatcccggcgacgcgctgcagcctttcccgggcggctcgggttggcgaggtccgggagccctcggtgccgcgatgggaagtgcttgcccacggccggcctggggacacactcccgcgccctccaggcccctgagctgttcctgggaaagggcgtgaacgaagctcccgcacaacccctttctttctcttggcacttcccagtaaaccctccaggtgtccaggtggggcactttccactgccgggctcagccctgggtctgggtctgcggcccgtcccttcgctgcagagcgcggtgcaatcgcggtggggttggaaggggtcagggctcctgccgagccaagtctcctcctctgcctgggcagctacacgactggacctcagtgcccactacatggacaagccttgaaactcatccatccaaacatcagataaacctaaactgagagacatttcacaaaactacacaaagatgaagaagggctgaggaactgcaccagaccgaaggaaaggaaagagacagaacaactagatgcagtgcgtgatcccagcttgcatcttggatgggggggaaattgctgttaaggacataattggcaaaatttgcatgtggattatataacagtaatattgtatcaatgttaaatttcctgaattggatcattgaaacgtggttatgaaaaagaatg

SEQ ID NO: 238930 - DNA, 496 bp, Homo sapiens
aattataaattacttaataaggatatattcttaacaagactacattttgatgttaaaaagtatgtttacatgtgttttactaatacagggaattaattctcagtatgtggatagctataatgtctccaaagtgttcattatgccaggtttgtcagatttatatcattgagggcaaagctcaagagagtatatatttgcttttaactgcccctcactgttcatggccagtgtagtacatcctagtgaaaggaagaccatgcatcagaatgtttgttttgagcatttatttttagcagcagatctagaaattatattttcattttagggtatatattttttatttattatgaacattccaagactaaataattttagacatgcgtatgtgagtgcatgtgtacattgcatgcacgtgtgtatgtgtatgtgagagagtgagagactgagtctgagactgtgtgtgagagagaaggagagggagagagagggagagaaa

SEQ ID NO: 238931 - DNA, 477 bp, Homo sapiens
atgacccgcaccatggcagggacagaaggcattgccaggtggagtggtgagcagcgggcgaacttgcggagttgggaagggcccatcccagcatcaacactgagcatgtatcaatgtgggacaacgcaggaggagatgctacagatgctgctctgcctgccaagcacgccttccccttccccttcccttttcatgtagaaaagtgattctaagcaagctaactacagttcatcccagggcttccccagacaccactagaacagggtgcctgcttcagtccgcaagtgctaggtagtgcccatgccgcctcccagagaggagccgggagtgggggcgcagagctggaggcagcagcatccctggctctccacatttcagtcaggataccaaaatgtaccctatttttgtttcagccaaattgacctttgtttctgtttcttgcaacccaaagttccaactaacataatccccgaaaga

SEQ ID NO: 238932 - DNA, 423 bp, Homo sapiens
atgacccgcaccatggcagggacagaaggcattgccaggtggagtggtgagcagcgggcgaacttgcggagttgggaagggcccatcccagcatcaacactgagcatgtatcaatgtgggacaacgcaggaggagatcatgtagaaaagtgattctaagcaagctaactacagttcatcccagggcttccccagacaccactagaacagggtgcctgcttcagtccgcaagtgctaggtagtgcccatgccgcctcccagagaggagccgggagtgggggcgcagagctggaggcagcagcatccctggctctccacatttcagtcaggataccaaaatgtaccctatttttgtttcagccaaattgacctttgtttctgtttcttgcaacccaaagttccaactaacataatccccgaaaga

SEQ ID NO: 238933 - DNA, 280 bp, Homo sapiens
caaaaaaacccctgagttattattcacatagtataaaatacacagattttaagtgtacaattttgatgagtttatttatttatttatttttttgagactccatctcaaaaaaaaaaaaaagaaaaggaaagaaaagaaaatagctgggcgtggagcacacgcctgtgggtcccagctactcaggaggctgcggtagtaggattacttgggcccaggaagtggagactcagtaagccatgatcataccacagcctgggcgacagagtgagactccatctca

SEQ ID NO: 238934 - DNA, 451 bp, Homo sapiens
ttcatttttagtttagttctggctctgtcgagccaattattctcatattttttcagctgtaacatgcatgtgtgtgcacacacaaacacatagcatggctacttccacactcacttcatacccctaggttatattcagggatacctacaattcccagcattccagttacaacttcatctcccttctcattccactcaagaaaatacatggaataagaatgagtaagagtggcattatcatgagggttattttgaatgggcatatttacattcataaatatatatgcatgtatatatagaaaatcattcccatacttgctactaaaacacttattaatggcagttattaatgagacttctcttagaccaagggtttatgacctgtaactcccaccagccaaatctggcctgctgcctgttttgcaaataaagtttcattgaaactcagccat

SEQ ID NO: 238935 - DNA, 386 bp, Homo sapiens
gtaaagttcaagaccctttattttaagaaacactatagatttgtgcataaaataatttctctctaggttcacagatgtgttttcatgaactctgattgccacgtgccttcagaatgttcactctctgaactgacgtttgattacaaaattttacttttgttttgcatccaatttgaattctcaaaacaattttaatcatgctttgaattttggaaagatagcttcacttaaacatgaaaatcagatcactatagtagaatctacaactcagttctttagggaagaacttcagaaggggcaaacacttgagttatgacagcagtagagctgagccgatatgaggatcaatacaagaagcaagactaaattgtgctgaaagttatact

SEQ ID NO: 238936 - DNA, 375 bp, Homo sapiens
gcagtaaacaaattcctcacaaaatctgactttcttaaaactcacgactaaaaatagtattgcttcatattaaaagaaacctgagttactgtgaagaaatgctctctataaatcccacatacttaagcttcccagttggtttcctttccaaagagccaataaatatgtcctaggtgttcttggcaagtgagagcaccaaggcccattccacagaggaacagctcagagcagaaacccaggaaatatgcaaatcatattaagaacaaagggcaatgctgatcactaggaagttagtgttttacatgactaattatgccaagttgacgatagatcaactgaagagaacctccaaaaagaagagggctcaaatctaaa

SEQ ID NO: 238937 - DNA, 158 bp, Homo sapiens
ggccgtgtgattatcccatacaatttacagtgacaacatagccaagattcattttcttttaaaagtaaaattattaaagtaaatgtcaattccaaagccagtcaaatttggcaaagtttttaattaataggattattaaagatcatagtgaagtgttt

SEQ ID NO: 238938 - DNA, 455 bp, Homo sapiens
tgagcatggaactctaatcctcattctgccacactcatttctcctttgttcttatccatacctagaatcgacatgcagatagaattcatttaggtggtttcttatattctaggcttcatgcaatcatggagatggtaagtacaggtatatgaaataaaagaaatgtggcaggcacagtggttcatgcctgtatttcagcactttgagagactgaggcatgtggatcgcttgagcccaggagtttgagaccagctggggcaacacggtgaaaccccatctctacgaaaaatacaaaatacaaaaattagctgggcatggtggcacacagctgtgatcccagccgtgcagagggctgaggtggaaggattgcttgagcccaggagtttgaggccgcagtgagctatgatcactccgctgtgctccagcctgggtggcagagggagaccctctctcaa

SEQ ID NO: 238939 - DNA, 788 bp, Homo sapiens
gtgtttcaaaccttttatgaggagttaaatctgccagcaccagaacttctgaaaaagataaaaaatttgtttctccaattagcagaaaatgtagctcattcccttaatgttacttcttgttatatatgcgggggaaccactatcagagaccgatggccttgggaagcctgagagttggtgcccactgatccagctcctgatataatgggggcttgtccaggatctcatcaggactggatggctctcgctggactatactggatatgtgggcagagagcctacattcagttacctaatgaatgggcagacagttgtgttattggcactattaagccatcctttttcttattaccgataaaaactactggtactatctgtaaattccagacattgtatgagaaagcactgtaaaactttttgttctgttagctgatatatgtagcctccagtcacattcctcatgcttacttgatctatcatgaccctttcacgtggaccccttagagttgtaagcccttaaaagggctaggaatttctttttgggggagcttggctcttaagacatgagtctgccaatgctaccggccaaataaaaacctcttccttctttaatccagtgtctcaagagttttgtctgcagctcatcctgctacattctcttcatcaataaggatgtatggtagtgtagatgttcattggcttgatttagccattccacagtgcagacagacatacttgcaaaacttcatgctatacaccatatgtgttcaatatgtatttgtcaatta

SEQ ID NO: 238940 - DNA, 415 bp, Homo sapiens
agtacaatcttcctgggaatgtgatgtgtttttcactggttctaattctgtcttcctaacaattgaagacaccaaattatgattaaaaaatccctctggagaccaggtcttaccacaagccagcaatcagacctgggaaggttatgcactctctttggatctttcctgtaaaatgaaagggccatgattaggagacgtctaagacctatccaagtcctgatgtgctgtgatatacacacacatatatttgtgtaatatacatatgatatacacacatatgtgtgtatgtatatatcacagcatattacacgtgtgtgtgtgtatcacagcatatcaagacttttttttcagatgaggtcttgctgtcacccaggctagagccctgtgacaagatctaagctcactgcagcattga

SEQ ID NO: 238941 - DNA, 311 bp, Homo sapiens
cactctctattcaacactttggttttccacacttcctaccagttaaatttcttcttcagccatcacctgcttggtcttccttcctccagcgttccttctcctctctgaaccctttcttagaatgtgtgtggtctgcagatgtttaatgtagttagtatttcacgcatgttaataaggtcaaattggttggtagtgctgttcaaatcttctatagcctttctgatttttcattgtctaccagttttatctagaagtgttaaatctccaactatgactgtgattaatcaatttctgcctttacggatgattgg

SEQ ID NO: 238942 - DNA, 288 bp, Homo sapiens
ctaatgcctacacccaatagatcaagcaataacaatataagcatgttatttagaaaaaccaaagtaattgccaaaggaatcagctcaaagagttgaaggtgattgcacatgaagacgtagggggaggtggactacggcttgctctttttcttaacacatgttacacgactatttgttaaactctgggcatagagttttgttacaaaaataatttataaattttaaaatcaatcaataccttttttaataaataaaagggctggatgacatgatggccaaagttccctc

SEQ ID NO: 238943 - DNA, 409 bp, Homo sapiens
cccagatgagaaagaattagcacaagaactctggcaatccaaaaagtcagagtgtaccctcacttccaaatgatccactagctccccagcaatggtttctaaccagtctgaaatgactgacataacagacacagaatgcagaatctgtggccaggaaacccattgagattcaggagaaagtgaaattcagtgcaaggaattcaaataatttagtaaagcaatccaagagctgaatgataaaatagccattttcagaaataaccaaacttaaattctagagctgaaaaactcactatcagaattttatcaaataatcagtagtattagcagcagaatagaccaagctgaggaaataatctcaaaacttgaagacttgttctttaagtcaactcagacaaaaataaggaaa

SEQ ID NO: 238944 - DNA, 232 bp, Homo sapiens
tttgaggaaatgatgacttgtaaattcaggctccaagtaatacaggcaagctggggaaacctgatgaagtaggttaccaaggggaaaattgtaaagatactttggacttttgggaaagtgtaggaaatatgcaattcagattagggcaattttatgggcacaacccagaggatttgaagacaatagaaaaagagaagttttgacccagctcctatggggtcctagcccagac

SEQ ID NO: 238945 - DNA, 1556 bp, Homo sapiens
ctttcaatagaaatgtcttcttgccttaggaaaataaagggctaggaaaggtcactgcgttgataaaaaccaatagacgacagggacaaaagtgagatcagataggaggagaacaaccagactgaagactcaacataagctgttattggtaagtgactcaaaggggagttttgaaaattaccaggatgtttaatagtcaggtctcaaagactgagtatgttgtatgggctaaaggaagcctaaagaatcatttcgttgtatggaagagatgaatgaacctggacagtagggataagtaagacaggagcctaatcttttggagatgaaagctcctgcttctgcaaaaatcccttctgaagtgtggaaacgcatctaggaccagggttctcaacacctagaccatgacttctaggtcactgatgccatggtaacaaaaccaagtaaatctaagctcatttgagaattttagatcctcttatgttaacaatgtgactttgaaaaataaaagcagaccatgggaatgagtccagatgggcagctttgcaggagtgtagacatgtggtattctgttgaagaaagagagggtcgttgagggagagttgaatgtcttgcaaaggcagagttccacacaatggatttagggtttctcagtgagtcctttctaaatgcttgttatatcctggtcataatgcatatgggttcactgagtcctctggtcactttccactggggatttttatctgagctcccgagtcagagctgggcatagactctggttcttcatgaggagtgctgtatttgctctgtaacctgggagacatttgttccctagtcgtgcagcacatggtattgtgtttcctgacctaggcaagtgcccatgctcagtacagaaccataagttggtagcagcttctcctttctggccaaatgatgggccctgtccctctgatgagtgcatttcatgttgtgtttccaattttcatcagcaatgttcgtcattccctggtcctttgaaagactgtgtagcccgcggttatggagccgggatgaatctgatgatcatcatcttctccaataaccagatgccatttttaacttcaatatgctgtctggacatagtgagaactaatggcaataaacgtccagctgcatggtgcacctcttttttataggggtgctctgctgtctttgtaaaccctctctggcctctgagcatctattataattgtgtagaaagtacatctctatattgtaaataagagtgtcgagtgttgcgtgtcatgcctcatttgaaaaggtcttttttatgtctctttctattgaaatatagatatcgaatatataaatatatatacataaaatatatataaatatatattatgtaaaacagggacattctattattgattgtaaaaattataaacaaaatgcctgccaagataatggtcttgtatgtcttcattctctgcgtaatttttgtttttgtttttatgatttgttgtttcccaaaatgagttagaaataaaaatgcccaatattgagattaattggaattt

SEQ ID NO: 238946 - DNA, 2605 bp, Homo sapiens
  misc_feature (939)..(939): n is a, c, g, or t
  misc_feature (965)..(965): n is a, c, g, or t
tgagacggagtctcactctgtcacccaggctggagtgcagtggtgcgatgtcggctcactgcaagctccgcctcctgagttcacaccattctcccgcctcagcctcccaagtagctgggactacagaagtatgccaccatgcctggcttggttttttttgttttgttttgttttgtttttgtttttgttttgtgtgtgtgtgtgtgtgtgtttgagatggggtcttgctgtgttgcccaggctggtctctaactcctgacctcaagcgatcctcccttctcagcctccctagtctctgggattgcaggcatgagctcctaagcccagcttcacatttattttcaaaagctctttgctggagggtctgcagagccccaccttggggtatcattgcctgcacttaggagactgtaatgtaaatggtgccttctttatttgccttccaggggcacttccttgatggacacataatcaggtcaactttgacctcttgtccctggttgagtggggaaatcccagagagaggatcacgtggttgtaggaagacaaacttccagataactctttaatagctttaagcttaattcacttaccatcttttttgtgggggtggatggcagatcttgttcattaaatgagtatttattgactttatattaattaagcacctactatatgctaggcactgttttgaactcagatagcccccatgtgtctgggcgtgggggagatagatataatcacatgaatgcataattcttcagacaaggaatgttattggattttaaaattattggggaataaaataacacacaggacccagtgttggtgaggatatggagcaattagaatcctcacattgccgaagggagtgtaaaagggcagagtcactttggaaaactctttggcagtttattaaaaagttaaatagatcctttnatagttcataagtgtgatgatggggngtacagggaaaaactccaaccccatttttcctctagcctcacaccaccacaacaatcaccaacacagaagacttatgtgaccaaatgtgtggggtgctttccccacacaccaggcaccagacaccagctgggtgtcctccggttcaattccaaaaccgtctacctagagatagtgtcagatcctgcaggttgggggctcagcacccaagactgccctccacatccccagacaccagttgcaagtgcaggcctctggaacttctgactgaccggcttcaagctggggttcccatgaccccctctttgggttcagttaatttctggagcagttcacagaacttagggaaacacttgcttatatttactggtttattataaagaatattacatgggatacagatgaagagatgtgggtagggcgaggtacaggggaaggtcgtgcagcttccatgccctccctgggcaccaggaacctccagtgttcagttatctggaagctctctgaaccctgtcctcttgggttttatggaagttttatgacatcagcattccttcccccagggtatagggtgggaccctcgcaggggagggtcttaagactcacagttggaaggtgggggaagattagagtcctgccttgtggcaggtgaaaggaggacaggagagagattgtgtttcccgatacctgcccttggggcctaacacacccaacattataacaaaaaactataacaagggctgtgggagttaggaaacaagaactgtagacaaaaacctatgtatcatatcacattgggttttcatgctcatgtgtgagaagtgcctctttcaaaccttgttctgacacattatcttacatgcaaggaaaaaaagctaaacatacacttaccatcccacttctaggtatttgcccaagaaaaatgaaaacatacgttcacactaagacttgtactcagctgtttctagcagctttgttcatgacagccccaaactaggagccacccagatgtccaccaccaggtgaatagaccagtaggtccatccatctgatggaatacttctcattcattaaagggaataagtacgctgtgtgtaacaacagtgggatctcaaaattatgcttctgagagtgatggaagccagacacacaagaccatgaaccgcggttccctttctagaaagttctggaaaatgcacactaacctactaatgtgaagccaaccagtggtagcctggaagctgggatggcaagaagaatcgattgcaaagagacaatagaaaacttttgtgggtggtggaagtattccatattttaattgtgatcatttcactcatgtattacatatttcaaaattatcgggccaggcgcggtggctcacgcctgtaatcccaaaactttgggaggccgaggcaggtggatcacaaggtcaggagatcaagaccatcctggctaacacagtgaaaccccgtccttactaaaaatacaaaaaattagccaggagtggtggcgggcgcttgtagtcccagctactcgggaggctgaggtagaagaatggcgtgaacccgggaggcggagcttgtagccagccaagatcgtgccactgcactccagcctgggcaacagagcaagactgcgtctc

SEQ ID NO: 238947 - DNA, 425 bp, Homo sapiens
gagaaagaggccacttgtgtatattgtcatagtgaccattcatgggacactcttcctggcaccagtacagtgctttttcttgccgttttgtgtctcttcataacaatcctaggaaagacctgtgactagcctgacttataaatgaaggcacaaaggcctcaggagagaaacgacctggccagagtcacatagctggtaattggcagagcaaagactggaacccaatgctgtttgaccccaaaatctgtgcttttagtgccatgatatactagttttaaagaggaacctttgagtattgataactgatgaatctatgattacatggaggttttattatttctctgaaaaagtaacttttaagacttggtgatacaaagatctataaatatatacagaaataaattcttaaaaaagtgttaggagtg

SEQ ID NO: 238948 - DNA, 622 bp, Homo sapiens
tagaggatcccccccaaatgatccctctactacttttttttgtttagagaaaatttaggaaaagtgaatgtacatcttgaattttagttaagtaattacagttatatagtcaattataaaggctggttacatagcttattatagactgaacacattttatacaacagccctatttgaatattttccctagttattaaaataatgaaaacattaataaaaactaaaggcaatatgatattaaaagcattaataaaaatggaaggcaagttaggctaaagttactatcagagactggcttctgaaggaacaggttttggctttccaagtggcagggccttaagaatcacatccccagctctggcttagggttccagcattgctcatggcatattcagctgttgccttgcatctccaaatctatcttcagagtccttttacctcttccttttaggtcatagtggagagttggcgttccgctttgtatttatgtttttttaagtagtatttgtatttctttctttcctttctccctaacaactacaggatcacatggacctaatttgttttattgtcacaagagtcccttttcttgacaggatatgcctaattaaaaccagggtgt

SEQ ID NO: 238949 - DNA, 859 bp, Homo sapiens
gtgaaaaaagttacacataaaatgaattacagaaatgtgggattaagctaattgaaaactagaatcttttatatgcatatgtattgtataaatattaggagaggaatataacattcagtgttttccatacttatttgataacagaacccttttgggtgcaggggtgagggggattatcttctaggactgatgttttatagaacatcattgaggttaccttgccccatagctgtgtctcctcacagtctggttgaacctgaaagcatttgttaccggagaagtagattttaggtggaaataccagatgcagttggcagaatcagaagtgtctctccctttgctgaattcacaatgactttgtattcactaattctttctcctaccccctcccgcaatgtttctcacatttggcaacatatgataacatttgtacattttcccgcacttttgtattaatatatttattacgggtctgagtatttaaacatgaacttttttctcaagtcatttaaaatgactacaattcctaacccagaatgaaatgtttcttctaatataactatttttaatttcagaatacattgcaaaaatgttttttgtgtaaatgttttaaaacataagatattatcatgaaaaggtaatttcttagaaaaattggaatttatctctactacttttttttgtttagagaaaatttaggaaaagtgaatgtacatcttgaattttagttaagtaattacagttatatagtcaattataaaggctggttacatagcttattatagactgaacacattttatacaacagccctatttgaatattttccctagttattaaaataatgaaaacattaataaa

SEQ ID NO: 238950 - DNA, 309 bp, Homo sapiens
ctccctcattgctcctcaggtccagctcaactttggatgttgtgaaactcataaagctgcaatagcccacaacatgactgacagcataatgtagtataaagaacatcagatggggagtcagaagagctgggttccagccctaacatctggtggaatcctggccaagtgtcttccctctctgaacctaagcgtcttcctgtcaacaaagaagacctcaagttgcatgttgttcaaaagccctttctgattccgaatgtctgtatgtctctgtagcaatgttctcatattgaaatttctctgtgcctatgg

SEQ ID NO: 238951 - DNA, 567 bp, Homo sapiens
caaggaattagtggaccaatgccaatgttaattttgaaaacctcaagaagaagaaaattaagatatggttgataggttctctacaatatagcaagaaaactctgcccaaattctaaaggatacaaagtctactcaatttaaaaacaaatggcacgtttctgtttcttaaaagacatacgcataatctgtgagtgcattttctactttagagaccatttgaattaaaatccttaagttcttatgaatgttttcaaaatatgtacagtaaatgaataaagcccacagttatttaaggataacatttaaaattatttactaaatctttaatattaaaataatagtacatgccatccagtcataatcaaaaaagccaaggtgattatggagtattgaggctgaaaagagcaagatctaaaccaacctattctggacttcactgtcaaggaaaaaaattgagaggaaaattttcaaaaaatacttatacttgtgagattggtgatgagaaacaatctgtgaaatattgccatttctctggagtaaaaattttaaatgattggttatcacgat

SEQ ID NO: 238952 - DNA, 300 bp, Homo sapiens
cccacaaacagcactagaaaaagacatctgattatacctaggtggtacaggttttaaggattggacctttgactttgtgctcatccttctgtgtggaccagctttgctctttgattccagttattttaattccagttgtaatgatgggttttggacactctcagtctgtattatgaccaacagcatgtatccgtaagatagctaggtcactaatagtctgtggcatggaaaaaaatttgttttgttttaatatggtgctaactaagcatatagagattgactctgtaactttaactccag

SEQ ID NO: 238953 - DNA, 397 bp, Homo sapiens
gactcaggagaagagctctctgtaaatccacaatactcaccagctggccagagaatagcagaaacgaaggctagcccagtgcccaaacacaggaacatgaggggaactatctcagcccaaggcagttcctatgaacagccctagggtagggaagcaatatgaaaaagaagacagatcccactctgcaaggaactaagaggttctactcaggaaaagaaaggtccatatatgctactgaaggttgccaactttggggaattcttaagactgataagtggcggggcacagtggctcacacctgtaatcctaggagaccgaggctggaggactgcttgagctcaggaggttgaaaccagcctgagaaacatagtgagaccccatctatacaataaatttt

SEQ ID NO: 238954 - DNA, 468 bp, Homo sapiens
ctgagaaactgcagccctctagcctttaccaggttcacccctaccaagtgtttcctggtatccagagagtacctggccaaaagaacctggagcttcacacatgtgtggttgtgtgtgtgtgtgtgcacgtgtggatgcatgtgtgtgtagagcccagggtctttggtattaagaactcaggctctggccgggcatggtagctcatgcctgtaatcccagcactttgggagcccgaggcaggtggatcacctgaggtcaggagttcaagaccagcctgggcaacatggagaaatctcgtctctactacaaagacaaaaattaggtggttgtggtggcacacgcctgtaatcccagcttcttgggaggctgaggcatgggaatcatttgaacccagaaggcggaggctgcagtgagctgagatctcaccactgcactccagcctgggcaacagagcaagactctgtctca

SEQ ID NO: 238955 - DNA, 1759 bp, Homo sapiens
aattttatatgatggtactgtgatctggagagggaatattcatacactaactttctgctattactttaggaatatctctgaagtaaagaagtatggaataaagagataatattatgacttattattttccaagctggatagataagatgaaaagggaaacaaagaatactccaaatgcttctataatgcactttcaaaaatatacatctccagctaaaatttaatgtaaatgcttaatttgcttgattataggtattatgcagttatttacactatactgcgtaagctatagtgctctatagttttagctcatctataatgcattgataatgtaaatgtattcatacttttatcaccacaattatttgaaaaaatcttgcttttgtaaaatgaactgtttagatagaagtatccattacacttggcattgtaagaatgtattgactgcttagaaagggccaaaataaatatccctagatatgcataatttatatatgagattaagttatatgtattatgcgtctataaaacatgtatgtttttgctgtcgcagatttaatgtaagtatagattggtattggtctgtgcctacatgtatgtgctccatgagtacagaatcagggagttgtatataaaggcctcattgatgatagtgggaacaaagctgaaaagagagcaattgagagagaaagagggagaaggaaagagaatagtagtgattaagctagcattgttctatacagatcgctagctgcctgctattgttttccagcatttgaagatgaaacatattcatttagctttcagaacgaatggctttaataagggcagagcgggagaggtggggtaacactgatgactagagagacccatcaaggctccccctaaggccattccgtcagtgctgaggaccacatgaccattaactctgcaatcaggacaagttttcaacattccggggtatccttcaatggcagaaagagtcatttggagtcaagagaagatgtatatcagcagtaattggattctggccaaggctcttaagacagtattatctatggtgagggaacagggaggggctggacaaagcatgaggcatgtgattcaagccatagctgagagagcagtagccactacaggccacaggctgccggcacaaagagcaagcagtttgtttgctcaggagtcattgtggcttgtctatggatgtgagcaatcctccatctccagcagaaactggcttctgaatatcctgcaagtcaaaacgttgggctcaaaagatgaggccatcctggttgcacttgactagacaaagctattgaaggcctgaaagtgccccatccagcctcttcccactgcagcccctctcccctcccttcaccctgactacttcattacaatctgccttcaggccggaattgccctgcttaagcctcaaatcattataattaccattattagaaatagctgcgggggaggcattggaacaccaagtaaaaatgtgtgagtgtgtccgctggccctggaatcactctttttgagctcgggggaaccacaaggcatgagggttccaccaaagccagctaatgcgacggctgtcagctccactcaccccacctgtcaagagggggatgcagtggggttcatttttttaattgacaccttcctctctcattccacgctctctcgtctcaacctaattcctcctttcatcttccttcttttctctgagaaaaattcattcctctgttatttgaat

SEQ ID NO: 238956 - DNA, 660 bp, Homo sapiens
ggtgggcaggataaagcatttgccaggtcaatagtggcccaggtgccagggactgtgtggatttgctccagtaaaaataccgtctctgcaattctggttgtgattcacctcaccactggattagtccgtgatgatctgtggtcattttctatgacctacttgatttgtacactgatcaaacaagtgagttaattgtggatttggtaggaatcactaccttgtatctttcaagtctttggtggtggcattaagctcatgtgaggagcagaaaaaaagtttgtgagaaggctggcacactgtaggagcttgataaatgatagctatcatcattgttgttgtcatgtgttattgtcttagccaagtcagggtcaaaatttacattatcttttttctttttgaaatatcatatttcattgctcctaagaagcatactgttgtgtactttaacatctctgaagtcaggatatgataatagttgatggtatgttgtgattgctgttgtttcgattaaaattgtgttcatttgtagaggatttttctttgcttctgcctgtcacttggggcacaggctgagttaccaatgagagtaaagcttcaggacacctcatttgcatggcccttccaaggtcctgaaagggttccacctcacagcttcatggg

SEQ ID NO: 238957 - DNA, 562 bp, Homo sapiens
agtagtttgtaagctgtaaagcaccagttcatgtaagaacttattatagcatttccatgatattcatcatctggaaatatgttgttcactgtaaattgaagcaaggataaagaggcatcatattcaaatcagctgtttcaaaattagtatttatgctagaaaaagaaatgttttaatttaaaagatgcttaaatgttccgtattttaaattattggacggctacttctggataagaaaaatttgttttggtttctcacgactggctgttgttcatcatgtgacttgtttaggcacacgattacaacactctgtctagaggtttgctgccagaaacctatagctgactcttcctgggaatcaatttttgatttccctgttattgatctgataacactctccccaaaatataaagtaaaacaaaatgtattctgaagcataatatgtgtttagtttagtattgttttaattttagatgctatttactttgttgttatttgaagatatgcaagccttctaattgaaatcagcaattgatataattgaataaaaatgttaccaaat

SEQ ID NO: 238958 - DNA, 422 bp, Homo sapiens
aatgtgaactagagggagaataagaggaagactttgtggacagagagtactttacacaaaggtggagagtgcaaggaggggtcacaggacattagtgctaggtagtgtttacggtttgtttttagagacgtttctactctgttgcccaggctagaatgcagtggccattaacagctatgatgatggcctgctgcacccttgaactcctgggctcaagtgatcctcctgcttcgccctcccaaggtgctgggattacagacatgagccaccatgcctgcacaagaacagcaggtttaaaaaactaggcaagctcacgcctgtaatcccagcacttttgggagggcgaggtgggcggatcacaaggtcaggagatcgagaccatcctggctgacacggtgaaaccccgtctctactaaaaatac

SEQ ID NO: 238959 - DNA, 431 bp, Homo sapiens
cactataatttaaatgctaccagtgctgcatctgtgtctcaataaatgtatgaaagctttttctgtcttaaatgtgaaaatattatattatgtagatttgaggatcctggctttgacttgtcaaattctggggtagcaagaaactttacctttggcatatgcccgtaacactgaatatctattaaaataggtacaatatttcactcacttaagtacacattatttgaggtttctgtgatgaaagcaaagcaccctttagtgcaaagagcacagacttggagccagaagaccagaatgtgagtcctgcctttgctagcccagtgactttgaggtaatctttttgagcctctgaactagtttccatatcgtaaattgtaagtatcatcactcatatattatacacctagtttaataaaacatatggaaaagta

SEQ ID NO: 238960 - DNA, 415 bp, Homo sapiens
aaatattccagattatctaataattcacttcacttgtttcatcaactttatttttttcatattctgaatttttagatcccatctttttgtgtattatttttcttttccccacttagacatttaatttactctgcaaataggatttttgtgacttttttatataatacatagttttatagttttattttagcaatgcttgtgtggattattttcaaaccgtatactttaattaatgaccacattcttttgaatattggaaagcaaatttggcctcagattttaaataaattattatgttttgtcaaattaattatccttcaatctgagttactgttggtgttgtagtagtagtagtagtagtacgtgaatgtttttagtgttttgatgtgcacattttcccttctgtctaaatgta

SEQ ID NO: 238961 - DNA, 342 bp, Homo sapiens
cagaacccacattcttccgtcatatcctgcccactccatgagactaaggattcaataactcactatacattatctgttgctactggttgtatgttgtgtgcagtgctgtattaagccgtgtggagaccccaaaagaaccagaaaataggttcctaccagcaaggaattggaagtctaagtgaggagacagaatgacacccactacccaattatagtccattacactagactgtagggacccatgcagtcaggggccattactcttcgttcattactgccccaccaggccccacacataataagacctagataaatacatgctaatggaggaatggatcaatt

SEQ ID NO: 238962 - DNA, 492 bp, Homo sapiens
tgtgactttgttagtggtcagtggtagatgggtaaatgtaccatcatgtatcacgcagttgtatgatactggagctgtgggtggttttccagttttttattatgataaagaatgctgtgataaacatctttgcatggtccatttttgcacacttggccatttatgtccagttgcaggaaatgctgggggaaagagaacatgtatataaaaatgtgatgagccaggcatggtggcacgcgcctgtaattccagctgctctggagcgagaggagatcctgaccagggttccggctttcctggttcacaagttggcactagtgcttcctggagcaggagaccaccaggttacctaaggagaggtgaactggcctaggttggaaacagaacaggtcaaaactcctgtgctgatcagtagtgggattgcgcctatgaatagccattgcaccattgcactccagccttggcaacctagcaagacccaatctcttttaa

SEQ ID NO: 238963 - DNA, 605 bp, Homo sapiens
tcaagtgctgaaagaaaaggactgtcaactgcaaatcctgtatctagcaaaacaatcttttaggaatgaaggggaaatgaagccattctcgaatgaagaaaaactaagataatttgttgcctgcagaccaaccctaaaataatagctaaaggaaattctataaacagaaataaagtgacttaaaaaggaatcttgggacattgggaagaaagaaagagcaacaggaagagaaaatactggtaaatacaagatattcttcttctctgtagcggtgaacattgtgtttcaacttgactaggtcatgatacccagctactccatcaaacattattatgtttctgtaaagctatctttatatgagattaacatctaaattagtagactttgagtaaagcatattacactccataaggagggtgggcctcgtctcgtcagctgagggccttaagaaaacaagattgaccttcctggaggaacagggaattctgtcacctgatagatggcctgtggacttgaactgcagctttgcctcttcttgggtctccaacctgccagcctacactgcagatttgggacacaccagcctccataaccatgtgcgtcaa

SEQ ID NO: 238964 - DNA, 467 bp, Homo sapiens
caaatgaagtacaggacttttgggtaaactgctaccactgtttataagatcttccaaaagtttcatttagagtttagtagttggtaacttgatgggatataaggaagtggcaaattttccttattgaggttggtagcagagtttcgtttgtcctaggaacagaatattcccagtctgttcacatgtgttcagaatgatcatttaaaaataagcaaatttcactttgggaggccgaggcgggcggatcacgaggtcaggagatcgagaccaccccggctagaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctca

SEQ ID NO: 238965 - DNA, 303 bp, Homo sapiens
ctccatttcctgctccataaactcagaagctaatctataccatttctttttgtttgtttgtttttgtttttgtttttgagactccctctctcaaaaaataataatgaggctgatattgttgtttgagtcattaattgagtttgaggaaatgtatttatccagctcacattcatgcagtcccaccatgggtcagaccccgggctcactgctgggtacaatgatgagggacaaggttcccacccttggggaacatctgcagtggtggcactgccaacatgcatttctagaggagctgttctttaa

SEQ ID NO: 238966 - DNA, 3342 bp, Homo sapiens
  misc_feature (43)..(43): n is a, c, g, or t
  misc_feature (390)..(390): n is a, c, g, or t
  misc_feature (498)..(498): n is a, c, g, or t
  misc_feature (579)..(579): n is a, c, g, or t
  misc_feature (778)..(778): n is a, c, g, or t
  misc_feature (1043)..(1043): n is a, c, g, or t
  misc_feature (1366)..(1366): n is a, c, g, or t
  misc_feature (1395)..(1395): n is a, c, g, or t
  misc_feature (1484)..(1484): n is a, c, g, or t
  misc_feature (1516)..(1516): n is a, c, g, or t
  misc_feature (2312)..(2312): n is a, c, g, or t
  misc_feature (2329)..(2329): n is a, c, g, or t
  misc_feature (2393)..(2393): n is a, c, g, or t
  misc_feature (2726)..(2726): n is a, c, g, or t
  misc_feature (3045)..(3045): n is a, c, g, or t
  misc_feature (3080)..(3080): n is a, c, g, or t
  misc_feature (3147)..(3147): n is a, c, g, or t
  misc_feature (3152)..(3152): n is a, c, g, or t
  misc_feature (3206)..(3206): n is a, c, g, or t
ggaatctttttttctgagcagtaggtctcattagtgagcttanaatactccataaaccatgctgtaaacagatgcactgtcatccaggctttgttattccatttccaacacaggcagagtggatttagcatcattcttaagggtcctagaatttttggaatgggaaatgaccattggcttcacgtcaccagctgcattcgcccctaacgagagtcagcctgtccttttcaatctttgaagccaggcattgacttctctctagctgcgaaagtcctagatgccatcttcttccaatagaaagcggttttatccacactgaaaatctttttagagtagccaccttagtcaaccatcttagctagatctggagaacttgcttcagtttctccngtaaagcttgcagcttcaccttgcacttctatgtgtggaagtgacttctttccttaaacctcatgaaccaacctctgctggttttctgcttttcttccgcagcttccntcacccgtctcggccttcatagaattgaggacggttaggaccttgctgtggattcagctttggttgccagtcacaccagcngtcgggcaaagttgttgttttaatctctccagaccactcagacttcttccacatcagcaataaggctgtcttgctatcctgtcatttgtgtgttcactggagcagctcgtttaatttccttctggggcttttcctttgcattgccgctcagccgtttgatgcaagaggcccggctttctgactgagttttagacatgcnttcctcacaaagcttaatcatttctagcttttggtttaaagtgagagatgtgggattcctcctttcacgtgagaggccatggtaaggttactaattagcctaatctcaatattgttatatccagggaagggggaggctggaggaaagggagagatggggaacagccggttggtggggatgtaggaaacacacattgataattcagcttcttatatgggtgcggttcatggtgccccaaacagtgacagtagttttagattcctgntacctgccgggcacctggcatgggtgtggagggcagagttctgaggtggtctcttagattcctggcccctaatgtacacaccccttcttccagttactcattcagacactcatctggtactgtcatgaagagacttgcagatgtcgggaggtcccaggtcagtgaggtgagaagggaggtcgtctgggagagcctgacctaatcacacagaccctgggaagcagaggttcctccatctggttggagaacagaggctgagattagatgcgtgagaaaaatgtgatgtgctgtgcctgccttgagattcaggtggcccctagggncggctcctgctcacagccagtaagcacanagggttcttagtcctacagttgcagggaactggattctgccacgaaatctgaatgagtttggaaaccagttttccccagggcctccagntgagagctcagcccgatgacatacagttgcanctttgcgtgaccctgcgtggagatcccagctggcctggcctggatgtgtgacctgcagaactgtagggtaacaaatgcatgctgctttaagctgctgagtttgtgtaaattgtttttggagcagtggataactgggagagggcttggcactgggcgggtggagtccccttcttggaagcagttcccagagtgaggattcccagactgcaggctggcattgccctccacagcggggttggatagagcatcccagtgcctgcgtgaggtcgcataattccgggtccagtcagcttttccaaagtgagcacctgtgtgactcagggcaccaccatgtgcccctgccagtgacagtgtctcctgaacaccattgcagcttacatccttccaccagggattggctctctgttttctagctttatgtaaatggagtcgtacaatatgagctcttttgtgcctggctgcttttgctcagcacttcgtctgttgtgaggtccacctgtgcttttatgtgtggcagttttttttctgtgcattattgtttgtgtgagtcttctgttgctagatatttagggtgttagaatgttgctaagaacactctagctacagacttctgcagggtaggcttgcagtttctccagcaacctaattcccttgaaaatatcctcactgttggggctgcttgctgccagtgcatcccacgtcacagctctggttttggtttttgttttttattttttgagatggagtctcactttgtcacccaagctggagtacggtgttgtgatctctgcttacngcaacctctgcctcccnggttcaagtgattctcctgtctcagcctcccgagtagctgggattacaggtgcatgccaccacncctggataatttttgtatttttagtagagatgaggtttcaccatagccaggctggtctcgaactcctgacctcaagtgatccacccaccttagcctcccaaagtgttgggattacaggcatgagccgctgtacctggtgcagctctggtttttaaacgagcagaacctccagttttatttactggcttctgggctgggctgatcccccctccctcattatattggcagtggccttgaggtattgaagacagtagtagtggatgggaaggcaacattactgatcttcgcagtggcccggctcccactgcccagcaagaaccccaaagagaaggntcttgaggcgagacagtcagccttctcatcctgagagccacattaatgggtcctcagtgcataagcagaatatatatggaaattaagcaaatacatggctgggtgtggtggctcactcctgtaaccccagcactttgggaggccaaggtggctggactgcttgaggccaggagtttgagaccagcctggccaatatggagaagccccatctctactaaaaatacacaagaattgcttgaacccaggaggcggaggttgcagtgagctgagatcacgccaccatgcaatcagcctgtgcgagagagcaagactatctttnaaaaaaaaaaaaaaagcccgggcgcagttgctcangcctgtaatcccagcactttgggaggccaaggtgggctgatcacctgagtttgggagttcgagaccngcctnaccaacacggagaaaccccatctctactaaaaatacaaaattagctgggtgtgntggcgcaagcctataatcccagctacttgggaggctgaggcaggagaatcgctggaacccgggagctggagattttgatgagccgagatcgtgccattgcactccagcctgggcaataagagcaaaactccatctc

SEQ ID NO: 238967 - DNA, 2995 bp, Homo sapiens
  misc_feature (459)..(459): n is a, c, g, or t
  misc_feature (1165)..(1165): n is a, c, g, or t
  misc_feature (1668)..(1668): n is a, c, g, or t
  misc_feature (1671)..(1671): n is a, c, g, or t
  misc_feature (1680)..(1680): n is a, c, g, or t
  misc_feature (1687)..(1687): n is a, c, g, or t
tgccaaccctcagagcagacaatctatctataaagtcagatttgagtggagaattaaaggaattatctgaataattaaaacaagaacactaatatctttgaaaaggctatttaagacttaatgatgcctacaaccatttacttgttaaagtctacttaaatatttattctacattgctagcgctccagacatacatgcatatcttattagtggattcattcaaaatattcacacacatggaataaactcaagaacataataactcctaaataggctttgatcagaaaaaataccattttcaaggaacagaaaaccagtttgaatataacaatcataaatttggttcctacctgacacatactctgtgaggagcttctgcaacagtggtacattttcaagataaagttctaagttctagttctaagaggcagtgtccatccactcaggtctacaggctcntatataaatgacgtagacctaaactccaaagtttacatacacaggagaagtgcccaaaataattggtgcagataataaattggaagaagggatgtaaatgtgggttggagttaggaaggttttgtgaaggaactgtgagtcttgtgttagactttaaagaacagataggtttggcaggggtgatgacaaagcagtgggcaataagcaaatcatgtgaaaggttattgagagttccaaacactgaaacagaaggctttgttggcccataggctaaaccattagagaaatgttgggatgcaccatagcaagggatttcacacccagtaggctcacagcaggcaaaagagaatccctggccatttctgtaaggctttgagattttctgagcactttcacttttcttccttgagtattactgtggatggaggcagacaagataggctgtattgtcgctaatttacagatgaagaaatggagatgagagaagataaatgactttctcaacttcccagagccaggatgagaagccacatctagtgaataactgactctctccactacgtcttcttctctgctacatattcaatgtcaggggtctcagcccctacccccaagagagacaaggtaaaagaacaaggtgaggcaccatcagggtccttgcttttgagcatgaaagcctcacactcctacactcaatatccacaanacaaaacatgagcctggtggcctggggacaaatctccttgaggtgacttgctttattcttccccttgcttctcaacaaagtgacacagaggctagaggagcctcttctcttctctttggagaatcaaagacctttattgtagagaagcaccagactgtgttattacatatttattcttgtaattgaaaaatattcattctcattttctgaacgattttgtttcttagtcgaatatgagctgtttaggaggtattaaacatttgttcatttctttatatacttacttattcccttatccagagggagaaggcaaagtatgtattgtgttaccccatttttcttgtttctgaaatcaaattagttgcttcctaaattttcattaggaataatccttggccggatggggtggcacatgcctgtaatcctagcactttgggagactgaggtgggaggatcacctgaggtcaggagttcgagaccagcctggccaacatggcgaaacnccntctctactnaaaatanaaaaacttagctgggcatggtaacgggtgcctgtagtcccagctactcgggaggctgaagcaagagaatcacttgaacccagaaggtggagtttgcagtgaaatgaaatcgcgccactgcactccagcctccaccctgggcgacagagcaagactctgtctcaaaaaaagaaaagaaaagaaaagaaaattgatggcttgaatcactggcttatagcaaacatagttaagatatggcaaggcaaggatttgaaacctggtgtgcttagttgccaaagtctcactcttttctgttgtacctcccgattaatttaggtttgacttccttcttcagcatcttgggcaatgtagtaatagaattgatgaaaaatagtagtaacaattattgcccacctcagcctttgaccccttctgagctctcttaatcaacctcagtgctgagacccctcccctccattcaccactccagccctctcccattctgatgccatcatctccctgcttctatccagcctcacgctaaccagaatgtggagctttttgtgagcttgatttctgattcctctggctgccgatggagatccctctgaaggtgctcactggagcaattattctgcttgttcccccatctctcacccactcccccaagtatagttatcaggacgctgctgtatttcccattgtccaaggactaattcatgaaatagggctggcttacctctggttttgcactgactggctcagagatattttgagatccatgaggtgagttgtgttttcagcagatttcaggcacagtgtggcattttcagtgatgtctctatcgaaggccttcctcagcttgaacagctataaaggggtgatgctgctaggagctgccttgtccaagagtggaggcatctaatgtgactgcggaggggctgggaagtgttctgcacccttgcttgtctgctggtttcaaatgaccgctaattaaaggcaaatcctagcaccgctcatcagcatcttggttcaaattagttgtttcccagcaaaaagggcagacctctgaaagactaaaacacagaatagataaacactgagtggaaaggtcagggccaaaagacacttctcagcagagcggggcaggcagagtggaggttctcgtaactggaggccagtctgcaggttggaaatgggtggaacttgaagtggtggggaggtatgtacatgacaatccctagaaatatcaaaaagttattaatacatgggaatagttaaactgagaaactgaacttcagaaattaatcccaggattaaatttctgctc

SEQ ID NO: 238968 - DNA, 353 bp, Homo sapiens
gattgcttgaacccaggaggttgaggctacagtaagctgtgatggagccactgcaattcagcctggcaacagagcaagaccctgtctcccaggctggagtgcagtggcacatacctgtaatctcacctgttcgggaggctgaggtagggtgatcgcttgggcccaggagtttgagatcagtctgggcaacgtagtgagaccttgtgtcttaaaaaaaaaaaaaaaaaaaaagattacaggtgcttaaaatatttatgaagattttatataaggcattttttaatcattttattttgcactatatttaaatgtgatcagtttgtatgtatgttataccgatgaagaatacaggc

SEQ ID NO: 238969 - DNA, 441 bp, Homo sapiens
gtctatttacctctcatctgggtttttcattcttatgtggaagaacaacagaataatatagccctagaccttctcctatccataccacacccttcggaatgttgcgattcttgcctgttgatgggatccttctgttttccagtaatagtttaaatttttatttttatatttatgtgattattttaattaacaggagtgttcagtgcagcattgctcttttatagtgaacagtcgaaaactagcaaaaagttaaatagtttgtatccactaaatacgagaccattcaaattaatgtaaatccacacttgtttctaagtgaagaaaaagttacaacatttattggatagcatgataaccattttataaaattaaattacatgtaagcagagaaagaaagatcttgccgtccgttgaagtcattctagcatttaggatttgaaa

SEQ ID NO: 238970 - DNA, 503 bp, Homo sapiens
gctgcttccaatttttacaattaataagaatgctgccattaacatcttgcacttctgcacaagtatgcaagttcctttgttggacatatagcaagaaatggagctgccagatcataggatatgtgcacactaatcattgttttatattattcttcagaattgttgcagtgtttaatcactattcctcagtatttctcaagattaagaattgatttctggctgggctcagtggctcacacatgtaatcacagcactttgggaggccaaggcaggtgaatcctctcaggtcgggagttcgagactagcctgcccaacatggtaaaaccaagtctctaccaaaattacaaaaattagccaggcgtggtggcgcatgcctgtaatcccagctacttgggaggctgaggcaggagaattgcttgaacctaggaggaggaggttgcagtgagccgagatcgcacgactgcactccagcctgggcgacaagagcaagactccatctcaaa

SEQ ID NO: 238971 - DNA, 427 bp, Homo sapiens
atgtgtatgcacaaaacaacagagcttcaaaatatacaaagccaaaactgataaagacaaagactaaacaacccacaattaacagctggagacttcattctcattaatcaataaaacaaatagaaaaccagtaagtcatgatgaactcttgccgtgatggaaaaaagaaaagaaaaccagtaaggatatagaagacctcaacaacattattaatcaacatcattaaaacatacaccaagatggatcatactctgggccatgtaattcactgcaccaatttaaaagaattgaaaccacacaaagtatattctcatatcacaacaaaattaaatgagaatcaataacaaaacaatctcaggaaaatcccccactacccttagaaattaaataacccatgggtcaaaaaaaaccccatgagttagaagag

SEQ ID NO: 238972 - DNA, 475 bp, Homo sapiens
agcagttttcacttgcattcaatgctttgtaaaatagattccaactagtcagtttctataaggcgaacccttcaaatatactccttgaaaagaacagttcaccggacattatgaagttagcactaatgtttgtggggcaggaaaagctgttgtagtgtggaacaatgaattaagaatcagaaagcctgatgtcgggttctagctgtagcataaatgcacttgaccttgatcgctgctctctaatctctggtccttagtttactttagaatgcgtgagttggaggatctccagtatctcttccaggatgaaaaagtaaaggattctggtgaggcctcatggttgcaaaacatgagagtgaatatacttagatatatagagaagttcatagtggatagatatacttggatttttaaattctattgccttactcaatgtcttacctttttcattcaataaatattgaatatatctact

SEQ ID NO: 238973 - DNA, 256 bp, Homo sapiens
caaaatggagatggagactaaagcaaatgttatgtgttacttttcccctggcccttttatttcaactttctctcaagagttgagtggatgaaatcaattgcagaaaattcataattttcaaaggaaagcgcaacataaaacattgtaaataatacctatctcagtacagttgactagaaataacctaatgccgacgtaaggagctgtttaaatcatgttgctgcatccaaatgaagtaaaatcaattttgttttca

SEQ ID NO: 238974 - DNA, 1806 bp, Homo sapiens
  misc_feature (1049)..(1049): n is a, c, g, or t
  misc_feature (1059)..(1059): n is a, c, g, or t
  misc_feature (1069)..(1069): n is a, c, g, or t
  misc_feature (1092)..(1092): n is a, c, g, or t
agtgaaagggaagattgggagggaaggggtaggagataagaatatctaagcaaggctgacattgtggggaccatcaaatactatacttagttcagttacagatagctatggaattgaaagtttctcagggaaaagggaaaaagatgtaccaaaggaaataaccaaagtatagaaaagaatgttctttgaaatgaggagaaaaaagatgagtttttgagagtgtatagaaagaaaagtagcaaggttttaggcaaggttaaatactagaagttagaaataaatcaaaatctaaaaaggcatatataaagtataagtgtaatgagaaaattgagcagtttcatttttgttgtttattagtgtcaacagaatttgaaataattttcaagctgattttattcattgtttacctccttaattatataatagaaataagtagcttgtgtttcttatgaaaatttacctgctacttgatgtatcttttttcagtgcacggtagtaaaatcagttgtatatatcctgtctaacatcagtatgcatattatactatactgtacatttaattaggagtttattagctgttggcttaaatgagtttaaaactactttatgatcacatttggctcaatgaatttggatttgagactaatctttacatacccaagatgataatgttacttgtctgtcttagaagtaaagacaccaatattcttcttaccttccttttttatatcctatttccttatctaacatctctaatatgtaccctagtacaattttcaagtattttgtttttttttaatgttcagtgtacttactttttcgtaaatactgctttctttctattaaatatagtccttatctgacaaaaagtccgtcagaagtagagcttatctttaggccaggcacggtagctcacaactgtaatcccagcacattgggaggctaaggcgggcggatggctttgagcccaagagttcgagactagcctgagcaacatggcgaaaacccatctctactaaaaatacaaaaactagctgggcatggtggcncgtgtctgtngtctcagctnctcgggaggctgaggtaggagtntggcttgagcccaggagacggaggttacagtgagttgagatcacgccattgcactccagcctgggtgacagagccagaccttgtctcaaaaaaaaaaaaaaaaaaaaaaaaacagtagagctcatcttttcttgaagagtcatttaaaatcagtaagtaaaaacttgctagatttgatgattgtgtgccatgagttacacacagactcctaaatcagtttcacctgtggtgtcctcattctgtttactttgagcattttgcattctatatctgcttagttatatggatttattcgtcccatataatatgtgtggccacatggacacatgttctaaaaggttttaaattctgcaagatagtgacgatgatgtaaacacaagaaaagggcaaatggatacattttcctactctgtgctcatcaaacatattacaggataaaattattggctatctaataaaaacacagactaataagacctgataagttggacaaaatgtttaaaaattaacatgaagatgataggaagtatgaatctatattcactgtcattaatgtcaaacctttaccttatggtatattgtactttgagaaattatggccaggcatggtggctcacacctataatcctagcactttgggaggctgagacaggaggatctcttgagcccaggagttcgagaccagcctgggcaacacagggagacactgtcttt

SEQ ID NO: 238975 - DNA, 526 bp, Homo sapiens
aggtaaatggtgcaagattatgggtcagttttaaatgcttaagtaaattttctttgtaagacattttaggatgccatgttaagaatctctttataactgtcatttaaaaaaaaaccacatattttcttagcataatttcccatagtaacattactatgtcaaaggctatgaacatttgaatgactttagataaatactgtaattgctttccaaaaatattgtgcttattatgtcaccagaaatgtttgaattctgtctacaattcagtcttgccagtatagtacatttcatttagaaaaattttttactatgtagatggaaaaaataatattttagctgggagtggggggactatggggaataactttccttcatttaatattttattgtgagttagtttaagttactttattttatcgtagtttcctaaggctacaaattagtaaccttggtaacttatgtacctaatttaaaagtttacttttttgaaaggctggaaatactaattaaaaacgtaacaccttca

SEQ ID NO: 238976 - DNA, 423 bp, Homo sapiens
ctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagg

SEQ ID NO: 238977 - DNA, 424 bp, Homo sapiens
ttctgacaattgtcattaagccagtgggtggcttcaaaaacaaccctcaatcttaaagctatcttccccaaaaagctttcctctccccttctttttttctgtataagctctagtaacttttcgtgttctgccatcaagctgatgaggtatttccagaggaaaaaaattaaaacacttgcaatactcttcgagagaggtaccttgctttaatccactatctcctaaggtgaggtctcctcctcagctcatatagcttcttatatctttttacctctcatattgaaactgacccaatagtcccatagatgttgttttttttttttgatagacatagaaatccacccttctgttcttaaagcttgaaacttaatgtttgatttatctgagttccttcctcaggaaatggtcttcagtcctctcaaaa

SEQ ID NO: 238978 - DNA, 707 bp, Homo sapiens
agcggagcttgcagtgtgccgagatcgcaccactgcactccagcctgggtgacagagtgagactctatctcaaaaagaaaaaaaagaagatattcattagccccatgagagaatgaaaagtacgtaggaacagctccagacacaaggctcggaggcagctacccaccgcaggcctgtgggtcctgggacctcaaggaagagagcagccaggcctgccctgagcacccaggtctgccagctgctttctgagtgacagcaatgacagcagtacccaggcagacaaggaacttatgtttcttgcagactcttatagaggcctgagccagcgttcctgagctacctcaaggttgcaagcaactcagctggacgctcgatgactctggagggtccagtggcttcctggagaaggaacaggatgtggaggggtcctctgcagacccttcgcaaaaagaggttcaggaatcagggcacttgctcaagctgtcatcaggagactcagaccattaatctgcttaatcttttatttctagtcatcagaatcaaggctgggcatggtggctcacacctgtaatcccaggactttgggaggccgaggcgagtggaccacctgaggtcaatagttcgagatcagcctggccaacatggtgaaacctcatctctacaaaacatacaaaaattagccaggcatggtggcggacacctgtaat

SEQ ID NO: 238979 - DNA, 760 bp, Homo sapiens
agcggagcttgcagtgtgccgagatcgcaccactgcactccagcctgggtgacagagtgagactctatctcaaaaagaaaaaaaagaagatattcattagccccatgagagaatgaaaagtacgtaggaacagctccagacacaaggctcggaggcagctacccaccgcaggcctgtgggtcctgggacctcaaggaagagagcagccaggcctgccctgagcacccaggtctgccagctgctttctgagtgacagcaatgacagcagtacccaggcagacaaggaacctggcaggcgtcccagccaggcatgcttctgctaaaatgactgggaacttttattatgtttcttgcagactcttatagaggcctgagccagcgttcctgagctacctcaaggttgcaagcaactcagctggacgctcgatgactctggagggtccagtggcttcctggagaaggaacaggatgtggaggggtcctctgcagacccttcgcaaaaagaggttcaggaatcagggcacttgctcaagctgtcatcaggagactcagaccattaatctgcttaatcttttatttctagtcatcagaatcaaggctgggcatggtggctcacacctgtaatcccaggactttgggaggccgaggcgagtggaccacctgaggtcaatagttcgagatcagcctggccaacatggtgaaacctcatctctacaaaacatacaaaaattagccaggcatggtggcggacacctgtaat

SEQ ID NO: 238980 - DNA, 1118 bp, Homo sapiens
cttactccaggtttgttttccactttggatgccggacattgagaatgtcacgcatgctgtgctcttccacattctgcaggctcctcctcagctctcttctgggatgaggttgggttccatggatctgttcagtctggcgtttgtgcttatgctcccagcagtgcagggggcagccagggcgccctctcacggctccttcccgccctcaggcacagctgtcactggctggcacggctgtcagtcattggccgggcccagtgttgtggaaaccaccctgtgatgtgtgagggtgtgtgttttgttctttcccttagttacttaaggtgtgagggcgaatcaggcccctattactgtttttgttagaagtagaagtaactttaacactttaaaaaaaaacaatagcatctctttttgacgctgagggcagaaactatttttttaatgtaagatactgaaagcactcataaagcaaaagattaaggcattcatattcatgaaaagtcttttcatcaagaaactccagaagaaaataaaaaacatgccattaactgagagatacttgcctcacaaaaaacctgcagtggtttagtatctagaagttataaagaactactatgaataggaaaaagataccatgatagaaaaacttagccaaaagcatggtggcgcccacctgtagtcctacctactcaggaggctgaggcaggagaattgcttgaatccaggaggcggaggttgccgtgagccgagatggtgccactgcactccagcctgggtgacagcgagacctcgtctcaaaacaataaaataatgaaacaattttttaaatgaattgaatttccctagtggtaccaaaacttgctttaagactaaactaaaaatctgtcttgccatggaaggacataaaaggtttatccaggccgttcacaagccgtatgtgtgtagagccatgtgtatagttgcggatccagtgctgtgaaaacataccgaagagacatgttcttgtggatatgagaaaaaaaaataggaccaaaggacgtattttgggggtggcattttgagaaacccacctgttgctgcagcatttgaatttgactgtggcgtgaggctgcggtgca

SEQ ID NO: 238981 - DNA, 1175 bp, Homo sapiens
cttactccaggtttgttttccactttggatgccggacattgagaatgtcacgcatgctgtgctcttccacattctgcaggctcctcctcagctctcttctgggatgaggttgggttccatggatctgttcagtctggcgtttgtgcttatgctcccagcagtgcagggggcagccagggcgccctctcacggctccttcccgccctcaggcacagctgtcactggctggcacggctgtcagtcattggccgggcccagtgttgtggaaaccaccctgtgatgtgtgagggtgtgtgttttgttctttcccttagttacttaaggtgtgagggcgaatcaggcccctattactgtttttgttagaagtagaagtaactttaacactttaaaaaaaaacaatagcatctctttttgacgctgagggcagaaactatttttttaatgtaagatactgaaagcactcataaagcaaaagattaaggcattcatattcatgaaaagtcttttcatcaagaaactccagaagaaaataaaaaacatgccattaactgagagatacttgcctcacaaaaaacctgcagtggtttagtatctagaagttataaagaactactatgaataggaaaaagataccatgatagaaaaacttagccaaaaaaaaaaatacatgccttcagaggagaggcgatacatgtggccagtaaaatgagctgggcatggtggcgcccacctgtagtcctacctactcaggaggctgaggcaggagaattgcttgaatccaggaggcggaggttgccgtgagccgagatggtgccactgcactccagcctgggtgacagcgagacctcgtctcaaaacaataaaataatgaaacaattttttaaatgaattgaatttccctagtggtaccaaaacttgctttaagactaaactaaaaatctgtcttgccatggaaggacataaaaggtttatccaggccgttcacaagccgtatgtgtgtagagccatgtgtatagttgcggatccagtgctgtgaaaacataccgaagagacatgttcttgtggatatgagaaaaaaaaataggaccaaaggacgtattttgggggtggcattttgagaaacccacctgttgctgcagcatttgaatttgactgtggcgtgaggctgcggtgca

SEQ ID NO: 238982 - DNA, 588 bp, Homo sapiens
actatttaatcattcagttatgacaaactaattttaatatctggggccgggcgtggtggctcatgcctgtgattcctcacactttgggagactgaggtgggcagatcacttgagcccaggaggtcaaaaccagctgggcaacatggcaaaaccccatctttacaaaaagtagctgggcctggtggtgtgtgcctgtagtcccagctactctggaggttgaggtgggaggatcacctgagcccaggaggtcgaggctacagtgagccatgattgcatcactgccctccagcctgggcagcagagtgagaccctgtctcaaaacaaatcccaaaaaatataaaaaaaaattttaatatttggatgaccaggctagcattacaccatttgtttgtgtgacattaggcatgacatctgtgcaaagtacagcagccagaaggggaaatattttctgttttataggaaaaaccacttagcaaaagtaaataaaggcagacatcagagcatatgggaaaatgcacaaagtgggtcagtgcatttctttcctttcggagtgcccaaccagcttcctgggcatctactaccaaaaaa

SEQ ID NO: 238983 - DNA, 478 bp, Homo sapiens
aaattaattttgtggatttggttgaggtgggaaattgtactgctggcgtggatgtctgggaagcacataccaggttggcagctgcagcttagcttcgagatcatcccgtgctgtgatagcacctgagtgaagatgtggcaggtggagaaggcactttggaactcctgagtgacagccagaagccagagtgttactttggcaagtgtgctaccaggtgctgagtcttgggcctgagcattcctcacgataacaggtagatcataactgtttatttcctactttgatagcaaatgaatgtgcattttactagattggatacttacttgatggtatacacctaatgtgagcaggacagttaaacatggatttacatatgatcaaaatcctgaaataatttataaacctacatacagtgtatagaattctcatatccttcaatatgtgatagattcttactcaactttttttgttatctcaa

SEQ ID NO: 238984 - DNA, 665 bp, Homo sapiens
gaccagtaaaaggaggaaaaatgcttttgaaatcagtatgattttatttcatttaatcaaaggctaatcattacaaaagcaaatgatttgattgtttggttgttcagaaaataattgtaaatggtgtccatttcattaagcttttaaaaataaaggcaactacaataaatagttacagcctgtttatgtccactttcctaagttttaatacactacaaaattcagctgacttactgttcatataaccagcttaagagtgtaagtggtaacttggaagatgacatttggaaaaatagactgctctctcagccccatgaggctcactgagcatgaaacgaccactggcaccatggtggccttgtattatcaagtaactggagtgaagttgatataccagcagtggctggagtcaggttctgactcataaaatagaccttttcatgctctgctacgttctcgttcaggaaagctaccatatgtagagaactgtgtacataaaatttggaatatgatttcttgtagcttttggataactgttatgaaactcacacggcaaaaaatattcttagtatttcaacaaaattatttttattttattttgaaaaatgcaatttaaaaaaaatctcagttgtttataaatatcatttcaatcagtcttttatatc

SEQ ID NO: 238985 - DNA, 674 bp, Homo sapiens
atttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattgaggtttagagacgtaaagtaaagtaactcacctaaagttacatagctcatgagcaatgtggcagat

SEQ ID NO: 238986 - DNA, 1929 bp, Homo sapiens
aagtaaaatggactaaaattttgcctagatttacctaaaggcaaaatataaaaattaatttctaaatacataagatgcacactgaaagaagagtaagtcagtccagatttagactataaattcaaatgtgaaaattcaagcatctgaaatgagagagggagcacagccttttgaagaaaaataaagcactaaatttaaaaagtattatttttatttcaggaaagaagaagcctgagcttccaaaataactttttcagactgtttattaacccagtcaaaccaagaaaacaaatgtacaattagcttattaaaaatagggactccaatatgggcaacaaagcaagaccctgtctctacaaaaaattaaataagtagctgggcatggtcgtgggcgccaataattctagctactcaggaagctgaggtgggaggaccgcttgagcctgggagattgaggctgcagtgagctatgattgagtgcacttcagcctgggcaacagagtgagaccccgagtcaaaaaaaaaaagggggggggaggggactactattaattaaaatctggaaggagaaaggatacaaaaaaattaacttttgctgaacacttacatgccaagtgttttcgaatatgatatgtgacttaatcctgaacaaactagagtaatacaaactattattgctttttaagaattcagtatttatttatttattaaacagataaggaaatagggttttaaaactgcagaagtgttagaacaagatagaaactttcatttttcctttgttaaaagattttttttttttttttgagacggggtctcactctgtcatccaggctgaagtgcagcggtgcgatctcagctcactgtaaccttcacctcctgggttcaagcaattctcatgcctcagcctccccagttgctggggctacagacatgcaccaccatgcccagctaatttttgtatttttagtacagacagggtttcgtcatggtggccaggctcgtcttggactcctgacctcaggtgatccacctgcctcggcctctcagagtgctaggattacaggcgtgagcgacctcacccagccctaaacaactttttagaagtagaatcaacatacaataatttaaaggcacatttgataaattttcgtgtgtgtgtgtgtgtgtgtgtgtgtgtttatacccccttgaaataatcacataatcaacatactgaatgtattcatcacctcagaaatttccttatgcccattatttttggaatgtttatcaagagtgaatggataaacaaacttgtatatccatgcaagggaatacgactaaacctaaaaatgtgcatgaactattgatacatacaatacgtgtgaatctcaagataattatgctgaaagaatgcacacaaaaaatgttattccatttgcataaaattctagaatgcgcaaattaatctattactgttttttaagatgagaaaaacaaggctcagaaaggaaacatagcttgtattagcaatgctgttaataaatggtgatgcaggatattaatccagttctgctacatcctaaaacccaggtctatacaagacctcaataccaactgcattcgccatagcaagattagaacaaatattcatttggagtcaggggcggtggctcaagcctgtaatcccagcagtttgggaggcctaggcgagcagatcacttgaggtcaggagttcaagaccagcctgaccaaaatggtgaaatcccatttctattaaaaatacaaaaattagtcaggcttagtggcgggcacctgtaatcccagctactcaggaggctgaggcacaagaatcacttgaactcagcaggcagaagttgcagtgagacaagatcatgatcgcaccactgcactccagccctgggtgacagagcaagaccttgtctc

SEQ ID NO: 238987 - DNA, 2600 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacaagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacgggattcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggcaatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 238988 - DNA, 1754 bp, Homo sapiens
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacaagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacgggattcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagc

SEQ ID NO: 238989 - DNA, 2829 bp, Homo sapiens
ccacgcctggagctcccctctctggagcccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacacactctctctctctctctctctctctctctctctctctctctctctcacacacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagtcgtggcattcctggtggctttccatcagaacaagcagctcatcggtgacagggggctgcttccctgcagagtgttcctgaagaacttccagcagtacttccaggacaggacaagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacgggattcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggcaatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 238990 - DNA, 482 bp, Homo sapiens
cagtcatcactgtactttttctaattctgagattcaatgtctaaatgaaggggagtttagattagataaagtattgttaaaaatctaactactgtcaagtatgtgtactgataagggctatgcagaaatcacgtggaagtgaaaggcagaagtgtgaaatttcagttcacttttttccccatttggtaatgctaataatactgggtgcgattgaataaaatgatactttgcaccacatttaggttctcttcacactacatttgcaacttttgaaattgtgtcagtacaattatctgattttacaaaagaaacctaaagagaagatgctgtaagtaaggtaacctgtaattagaatatgagcatctgttaaactaaagctaaagtcttcttgagtgttgcagtgggaaagtttattttcacattagttttgatgaaataaacacttataaaatattaagttttatggtttagtttataccccc

SEQ ID NO: 238991 - DNA, 271 bp, Homo sapiens
ctctacttctgtgactaatggtcctatgacatgggatcattatgaatgcaaactaaactgcagatggcttggttaagcgttctaaaatgcatatttcaggtaattcagaagcttaaaatatttaaaacaatatgccaattacaaataaatcaaatgtgttcattaaaattgattctggaatacttttattttcttagtacaggccagaaatcctttacatctgtaagagtaattgagttgtatgaattcacatcacctttcccccaattaa

SEQ ID NO: 238992 - DNA, 437 bp, Homo sapiens
  misc_feature (1)..(1): n is a, c, g, or t
ngtgtatactgactgggagacacctcccagttggggctgacagacacctcatacagaagagctctggctggcatctggcaggttccctgctgggtcgaagcttccagaggaaagaacaagcagcaatctttgctgctttgcagcctccactggtgatacccaggaaaacagggtcaggaggggacctccagcaaacaccagcagactggcagcagaggggccccaggcacatgcagcagaagtcaggaaatggctgtgtggcagagttcacaagggaggcagggtagtctcaaccctggggcacagctgcagagtcctgttcttcccaggcacttccttggcacacccggtgaagctggggaacagatgactctgcccagccagctctcctaggaccctctcaggtacggatggcaggaatcaaagctcgtgcagta

SEQ ID NO: 238993 - DNA, 485 bp, Homo sapiens
gggcatccttccactttaatgaaaataattccctatagattgagttttaattatacgaataatacatcaatccataaagatgtatgtaatcctgctctcctctacggaagtaacttttgctcaaagtttgatatggaaatccacaagccatttttttatgcatttgaaaatacctttttgacatcaaaatattccttctcaaaagagttttgtgtatgatctaaaacaaactttcaatacatttacaaaaatttaaaatgaaaaagggacacaatagaagttgttttatatataggtatttattaaaacttattcaattttttaaaaaagtaagcatttctttgggatataggaaattcaaagtgacatgaattaaaatgacaggaaataaaaacaaatgtattttagcacaaagtatcttcattggtgaaaagtaagcaaaccaaatcaagtcttaagcttaaataaacttatttatattttca

SEQ ID NO: 238994 - DNA, 580 bp, Homo sapiens
ctgctcagaagaccgaggcaaagaatcccttgaacccaggaggtggagattgcagtgaggcaagatcgtgccactgcactccagcctgggtaacagagcaagattctgtctcaaaaaaaaaaaaggaacaaactagttcagctctcaactcactgcttttcctcatgacactgatccctggtacacagcagaagtgttttatacatacttcccatttcatcatacagattaaagttgtgtagtcacaggttgaaattcaataaatattttttactccctcatcaacaacactcttcaatgaaactgtctttaactctaagtgtgtaacagtgaagaatacagtacacttttgtgccacagccttgatttctattaaggcaccagcagttttaccatccattgcttttgtaccatcattgtaaaatttacagtgaaaaaggcaagttatgtcttagtatgttatggggccatagggttcccagattaaacattatatttctgggtttctctgtgagggtgtttctggataagattagcatttgaatcagaggacagtatcctgccatccccaatgtgagtg

SEQ ID NO: 238995 - DNA, 448 bp, Homo sapiens
taggtttgctggagtttggatttactactgagtcatatttggagcatgctggaatcttacaactgagattaccgagtcagaaacttgcaaacatgagtaacatggccctgctctggagactactgggaacacaaacacagccatttaagacatctacctgcttctcctttgccttccatcatgactgaaagttgtctgaggtctcccagccacgtgtcctgtacagcctgtggaactatgtagaaaggaaaaagggagagaaatggagacatttattgaatccaggcaccatgctgtggattgctaaatacagcttcgtaatttgcatctagttatctggtcttccaagctagctttttcaagtatttttacctttacacataaagttctattggagatgtacttcacccttttctgcactaaagagtttaatttttcaagactcagt

SEQ ID NO: 238996 - DNA, 774 bp, Homo sapiens
agacaaggtaataatatcagatctctgtctatatatatgtggagttgattgaaggactcaaagttttatacagaccaagtaaaggcactggacccctggaagacacactctgatgccagcagaacaggcttgcactcatatccagagtttgaagaccacttccatggaccactgctggcagaaatgcccccagagtggtcgaccaactgtgcacccatgctcctagccagagtaatagcttcatagccccacccccagccagccagaccccaagttggctgatccaccatgtgcatgcatgtgcctctgaactgaaaaacagcctgtgcaaacatgagtaacatggccctgctctggagactactgggaacacaaacacagccatttaagacatctacctgcttctcctttgccttccatcatgactgaaagttgtctgaggtctcccagccacgtgtcctgtacagcctgtggaactggagtatacagccatatgagaatcactgttataggtgatgaggctccatgagagggcattaacttctaaaagcatgagaaaccatcatcttcttctgcaatgagagaatcaatgtgcctcatgaagttacataccatgatgaaataaaccataatccatccaaagtttaccagcctcttatccctgcagcgccacatttaacttgactctgaagttacagttaaattaaaagggtttgcatattttattctctctagtgattttattgctcactagagatttgctgtattaaaaag

SEQ ID NO: 238997 - DNA, 458 bp, Homo sapiens
aatctgcgaatagggaaaccgcaggcgccatttaagacatctacctgcttctcctttgccttccatcatgactgaaagttgtctgaggtctcccagccacgtgtcctgtacagcctgtggaactactttaaagaagaatcagaaaatggagactgggattggaagcagagatccgatggccaaattacagtctgccactgaagctaacacacctatggataacccaacctgtaaactcaatgtggaacacagtttgagaaaagaagtgagaagattcaattttgaagttggatcactctcctacaggcaatgaagaccacatcactgatgaactctgactaatacatcatgaacttgcagaattttggatatttgacaaatctgaggaattgaagagacgggcacctcaccttttctgagcagaagagttcatttgatgaaacctgaagtagagagca

SEQ ID NO: 238998 - DNA, 796 bp, Homo sapiens
taggtttgctggagtttggatttactactgagtcatatttggagcatgctggaatcttacaactgagattaccgagtcagaaacttgcaaacatgagtaacatggccctgctctggagactactgggaacacaaacacagccatttaagacatctacctgcttctcctttgccttccatcatgactgaaagttgtctgaggtctcccagccacgtgtcctgtacagcctgtggaactgtggtacagttgaagaaagagctcaactctggcaaagggagaccaagagtaacctctggtgtggaagttggctgagcactcagtgcctgactgtgctatactcctgttggacatgagctgtctctcagaacaccaattcagacaaggttactccaagactatgatacaataaagcaaagcaaggatacttcgtaattttgtggaagcacagacaaaatcaatatcagtatgccacctacaaaagaccaaacagcccttctcttggccaaaatgagtgatgtctacttctttactaatgaagttttatttttgttctagtcagctctccatccagatgagatttttttgagatacccaatcttataattgcctccagctttctgacagcatctaattttggcaaactctcccctccttctgtcctctcccaaatgacctaacctaaaccccaaatctacagaaagttatttctattaccattttactgagacaccccatgattcctcatgatatgtgttatttgtctgtgcaacaggtaataaattgaacttgttcacta

SEQ ID NO: 238999 - DNA, 569 bp, Homo sapiens
taggtttgctggagtttggatttactactgagtcatatttggagcatgctggaatcttacaactgagattaccgagtcagaaacttgcaaacatgagtaacatggccctgctctggagactactgggaacacaaacacagccatttaagacatctacctgcttctcctttgccttccatcatgactgaaagttgtctgaggtctcccagccacgtgtcctgtacagcctgtggaactgtcacactgaatttggacactggagaagagaaaggagaaggccattctggctaccctaggactcagagacgactttaaagaagaatcagaaaatggagactgggattggaagcagagatccgatggccaaattacagtctgccactgaagctaacacacctatggtttcagagtattctttagtctcttccaccatgtgagggcacagtgaaaggaaggacttctatggagcagaatgtgggcccttaccaacactgagtcttccattgccttgacctttaacttcccggccttcacaacagtgagaaataaatttctgtagtttataagcc

SEQ ID NO: 239000 - DNA, 175 bp, Homo sapiens
tcctcccattccaggcctatttcacctccctgatttcttaaccctcagacttcaagaggccacgcgagccttcatacactgcgcatctttctgcagcaggactctatgggggccagagaagcctggggagaggtggctccacgtgctttacccagaacagcattccttcaggttg

SEQ ID NO: 239001 - DNA, 1424 bp, Homo sapiens
  misc_feature (491)..(491): n is a, c, g, or t
  misc_feature (562)..(562): n is a, c, g, or t
  misc_feature (888)..(888): n is a, c, g, or t
tcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagnatgtatatgctttcctacaaactaaagttccacaaagaagccagaaagcttcagttactccatgaggaganatgtgtgaactattaatagtaagatgggcaaacctctagtccttgcatttagaagctgcttatcctaagacttctagtatgtatgaattctttgaaaattatattacttttatttctacatgattaataaggatactaaggatgtgccaaatgatacggatactaagatgcatcgtttgaaatcatctagatgtgttgtatgcaagttatcatcaaaaacattcatggagtctgaacgtttaacacatctgttagagcacattacacagagcattgggagctcaacaaaactaaggggtccgctcacctacaggggctgaacacangtacaccaactacgccgggcaaggtcccacacgcgtcaccatgccacgggaagaaaacacggaaccgcacatcggccccgactggatccgcaaaaacaaacaccatggggcacgggcgcgtcaggcacacacggcacccacccgaagcaacaagaagacggacaaaaaatacagcaggcaccaaggaggagtacacaagccagagagacggcgaaacaccagggacaacaagagaaacaaagacagacaaacaagaacagcgagacaagcgcgaaggagagagagagaggggcagagaagaacagttagagctggcaccgtactgtgcatggggcgcggggaggaggaaggggcgagcggcggcagacggacacagacagcgggaggaagcgcgaggcggcgaaaggcagggtacacgagcgagaggaagggagcgaaagaagcacgaggcatgaaggaaggaagaggcaaggcaggccagacgaggcaggggggcagacaaagaacgagagcacagaggacgacggacagtggac

SEQ ID NO: 239002 - DNA, 1478 bp, Homo sapiens
  misc_feature (545)..(545): n is a, c, g, or t
  misc_feature (616)..(616): n is a, c, g, or t
  misc_feature (942)..(942): n is a, c, g, or t
tcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagattaggcccnatgtatatgctttcctacaaactaaagttccacaaagaagccagaaagcttcagttactccatgaggaganatgtgtgaactattaatagtaagatgggcaaacctctagtccttgcatttagaagctgcttatcctaagacttctagtatgtatgaattctttgaaaattatattacttttatttctacatgattaataaggatactaaggatgtgccaaatgatacggatactaagatgcatcgtttgaaatcatctagatgtgttgtatgcaagttatcatcaaaaacattcatggagtctgaacgtttaacacatctgttagagcacattacacagagcattgggagctcaacaaaactaaggggtccgctcacctacaggggctgaacacangtacaccaactacgccgggcaaggtcccacacgcgtcaccatgccacgggaagaaaacacggaaccgcacatcggccccgactggatccgcaaaaacaaacaccatggggcacgggcgcgtcaggcacacacggcacccacccgaagcaacaagaagacggacaaaaaatacagcaggcaccaaggaggagtacacaagccagagagacggcgaaacaccagggacaacaagagaaacaaagacagacaaacaagaacagcgagacaagcgcgaaggagagagagagaggggcagagaagaacagttagagctggcaccgtactgtgcatggggcgcggggaggaggaaggggcgagcggcggcagacggacacagacagcgggaggaagcgcgaggcggcgaaaggcagggtacacgagcgagaggaagggagcgaaagaagcacgaggcatgaaggaaggaagaggcaaggcaggccagacgaggcaggggggcagacaaagaacgagagcacagaggacgacggacagtggac

SEQ ID NO: 239003 - DNA, 302 bp, Homo sapiens
gtcattttctatttgtggactcttctaggaaatcttcattcccatttagctggagcggtgatggaaagctattccttctctgatggacttaacaatgctatttctgtatctcatttgtgaggctgggcagccattcatttgtggttaatactgtaattcttaaaatgtatttttaagaagtggatagaaatatctgatgctccattttagtttgaatgctatcactgctgaagcacacacaaaactgtcagcaaaatgctgtttgtattggacaactcctgtgaattgaaagtagctaagct

SEQ ID NO: 239004 - DNA, 213 bp, Homo sapiens
ctttaattatattttatcctcacaaattccctttgaagtaaatactattattttacagataagcaaactgaagctcagagaggttatgtcacttgatcaacatcacacagtggcagagcaaggattcagactcaggcagcatggctccacttcattatattttaaatataaacatgtttatgttataaatataaatgtaaacataaaaatata

SEQ ID NO: 239005 - DNA, 615 bp, Homo sapiens
agtcatcttaagtaaatttaagccagaacagggacattttgagtggaacaacttctgaacacaaatgaaagggtaatatgaccaaatctcacatttcaataaaattctggtaatttatttggattaatcaaaatatagaaacaccagcattgtctctttgccctggggttgcaatcatttctaaggaataaagaaatggataaacagggacacagctctcacccctgaaggcatttagaatgcaaagtgtcctcttaccctctctttattcatcttctcttccctctctgcaatagtagtctatcgtttcccttccaaacatcattctctccttgacataaacaacaaaaagaaaaaaatcttacagctctgttctttttctcatccatcaggattgccatcctctctcagctgccggtctgttttttgagggaacaatgtgttccttgaacctgaaaagcaaacaaagactggacacactggctcacacctgtaatcccagctactttggaggctgaggtgcaagaatcgcttgaacccaggaggtggagattgcggtgagccaagacagggccattgcactccagcctgggcaacagagtgagactctgtcta

SEQ ID NO: 239006 - DNA, 512 bp, Homo sapiens
ccatctaagtttcacttctcagggaccattctcagcagctcctgatgaggctggatgaaaagcattcttgagtctgttatttggaaggttaagatttgcacgctcactgcctggccatggaggttggggccggaggcaggggtgccttctaggatatgtgcaaacacaactaagatcccagctctgagtgtgggagaccccacatatagtctgctgttttctcagtgtgtcaggaatcacagcagcaagcccggtgtgctaggctgtccagacactttccagaaccactgagtgtctcatgatggcagccactacccgcatggagtaaaacggggttcagcttccagcttagcaagttttcgaaaactttttggtttctaaaatctttattgttgtttttgttgttttgtttttggcactgggggtgaatgggtctcccaaccaagagaacatcaagactggatgtgaatggacttcacgtggagcctgaactctcctccatcgccagcggc

SEQ ID NO: 239007 - DNA, 754 bp, Homo sapiens
ggaaacacagtagggctatcttatagtattattatttttctagatcttacagattcaaggttcacataaagctagtgtattttaggaagagctattgtaaaattataaaagagttccagccgggcgcggtagctcacgcctgtaatcccagcactttgggaggctgaggcaggtggatcatgaggtcaggagatccagaccatcctggctaaaacggtgaaaccctggctaaaacggtgaaaccctgtctctactaaaaatacaaaaaaaaaaaaaaaaaaattagccgggcatggtggcgggcacctgtagtcccagctactcgggaggctgaggcaggagaatggcgtgaacccgggaggcagagcttgcagtgagccaagatcgcgccactgcactccagcctgggcaacagagcaagacgctgtctcaaaaaaaggaaaaaaaaaaaaaagacttcctcccctcccgtatcaagttcattaaacatatttgtgagcttgatatttaaagagaggctgtgtgctggtgtgatgttagcagtcaccagggtggggctggtcacacatgggagcctgggtggagggttgtgcctggattttttatggtggcccccaaccttggatctctgagacctagatgagcagcactgcacccgtaccctgctgtatggctgtgtctgtgttttgcagaagcagattttataggtgtagctttgatgattgaaatatcacccgagggaagtggctacctg

SEQ ID NO: 239008 - DNA, 1001 bp, Homo sapiens
agcccgggtgacagaatgagactccatctcaaaaaaaaaaaaaaaaaaaaagacgagacacagacacatgtgcaggggagagcaccgtgtgagtgtgagggcaggggttggagtgatggctctgcaagcctaggaacagcaaggattctgacatcaccagagagggtcgtagaacagattctgtctcccagcttctagaagggaccagccctgctgacacctggattttaggcttcaagcctcccgaacagtgaggaaatacatttctattgttggggccatccggcttgtggcacttggttacagcagccctgggaacagagcaacagaaagaagtagcagtgagttatgagtttctgcctacactgagagacttcaggaataaaacctaatggaaggtacttaggaatatgcagtgggattgtgtccttttacagaggagggaacgatccagagaggtgctcacagccacgcagtgggggctggtgatagatttggatccagaactcaggtctcctgggcttagaacttctctccctcctaatgctgcctatgggaacatatttgaaacctaactgggttcacattaaagaaatgccataaagttagggggcagatggtttgggtttttttcctctccattttttgatggggaatgaagggatcacagatcttgacaacaaaatggaaagagtttatagggttccaggttggattgcagtggtgccatctcagctcactgcaacttccacctcctgggttcaagcaattctcccgcctcagcctcctgagtagctgggaatatgggcacatgccgccatgcctggctaatttctactaaaaatacaaaaattagccgggcgtggtggtacgtgcctgtagtcccagctactcgggaggctgaggcagaagaatctcttgaaccttgggggcggaggttgcactgaactgatatcatgctgctgcactccagcctgggtgacagagcgagatgctgtctc

SEQ ID NO: 239009 - DNA, 383 bp, Homo sapiens
cgatcatggctcactacagccttgacttcctgggctcaagcagtcctcccacctcatcctccccagtagctgggaccataggtccacaccattgtgcctggcttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaa

SEQ ID NO: 239010 - DNA, 147 bp, Homo sapiens
ccttcggtttgcactttgtgtctgaagatttatcctttcatgactgccttttttggcttcatttctgcttttgtaggagcaggtttagatgacaattgcaagaatctcctcttgggctcttccttcacttccccttctgctgagctg

SEQ ID NO: 239011 - DNA, 370 bp, Homo sapiens
ggactttagagggtcccctgctaggtctgccagctgcctctcccttgacttcatgtccctccttcagcggactgggactgagtccgctctcctcagctgcagccgctgatccacatcactgatgtccttgctctgagggccgtctccaccgccagctgccctttgatgccagagcccttttgtaaaggaccctgcaggagaaagatggaagactcagagcaactgaagggagtttcacgaaggactggttacaggtggagtgggcagggtacagtgacaccaacaagagaggtgacatgaccacacactggccaggcagagagttatcaccacccttaagcctaagggaacaagcaaagggaagcccata

SEQ ID NO: 239012 - DNA, 1204 bp, Homo sapiens
ttctgtcatatttcaaaatacacttaaaactcaaaggtcataaaggtttaccttgtgttttcttctaagagttacatactttagtccttacatttaagtcttttattaatttagaattaatttttgtgtatactgcaaggtaggggtctaacttctctcttgtgcactgacatccagctgttggagagactgttctttcctcccttgactagacttggacagcttgttgaacagtcattgaccatatatgtgagcactaatttgtaggatctcaaatctgttctattttattggtctaaaagtctattagtcttatgccagtaccacactctcttgattactgtagatttgtagtaggctgtgaaactgaaaaatgtgagttttctaatattctttttcaagactgttttgtctgtcagatcctttgaatttttgtatgaattgtagaatgagtttctttctttctgcagaaatgcctttgggattttgatggtactgcattgaatctgtagattactttagatggtattgtcatcttaacaatattgtcttacaacccatgaacacagaatgtctttccagttatttccactctctttcgtttttttcagcaaagttttgtgtataccaccatggttagatttatgcctgaataacttattctttgatgctattataaatggaatttttaaaatgttttcatagttctttacaactatatagaaatatagctcatttgcctatgtttgttttgcatcctgcctcttttattagttataatcggttttgtgttttatttggagctttatacacataagatcatgtgtagatataattttacttctgttttttatttctaatttagatgccttttatttctttgtcttgcctaattgctctggctaaaattgccagtggtacattgaacacaagtggcaaatgcaccatgcttgtcttgttctagatgttaggaaaacagctttcagtgtttcatcattgatcatgatattaactgttgggtttttgtacatcctattgtcatgttgcagatttcatcaatgttttctctgcatcaattgaaataatcacgtgcttattcattttactgttagagtatattacactgattgattttttatatgttgagccactcttgcattttggggataaatctcacagggtgatagtttacaatcctttgatt

SEQ ID NO: 239013 - DNA, 468 bp, Homo sapiens
gttttttcgaagtgtacttttaaacattgaatttagaaaaagatgattttgtgagcaaagccagttctacccccaaaacatttttatattcctgaactgacacggtaaagttagatttgcatgaggtacagaagctaaaaagttgcatttaaaattcagcagagtatatcgtgcagagagtcctggagtgggaattgggagtcctgccaggccacattactgaagccctttctagacctttgttttcttacgtataaatatggaggttgaatttagagatctttaaagttgccttcagccccaagtttcattatagtccctctgttattaaacattgattgatagccctgtactgtgaaggttacaaaggtaaagagagttcctgccctcccaaggcagggattatcctctaattgcaagggtaaaccaattaggcaaagagttgtactataagattgcacagggtgg

SEQ ID NO: 239014 - DNA, 421 bp, Homo sapiens
ccaaagatagctgttaatattttgatatgaagccctatatagatgtatttatatgaagtacatgtgtgcaggtttgttgggggcttttgtgtgtgtgtgtgtgtgtgtgtgtgtgtgtgtgtatgtgtgtttcttaacatgaaaggaggtcacactctaatactatgtaacaacttgccttttataccagcagtgttctggaagagcttttctttttacacatacagatcgatcgtatttctgttagccattctattgtttcttgctgcggtacataatgttggctggagtgaagagattggggttcagatcacaagtctgccacttatgagtcatgggatcttgggcaaattactttctctatgcttcattttctcttctgaaaaatgaattaatatgaataaaaatgaaccttatttta

SEQ ID NO: 239015 - DNA, 456 bp, Homo sapiens
ggggtggtcagctggggctacggctgtaccctgcgggactttcccggcgtctacacccacgtccagatctacgtgctctggatcctgcagcaagtcggggagttgccctgagcaggctgggctgggctcccacctgggtcggctgaggagggaccaggaccttcctcctcccagcgatctccgcttcggcctccgctgcaggccaccgtcttgagcccggcttctctggctcctcagcgcccaggacctccctgatgccggggtggggaaggggccggggaagggagggtgggggcctcgctgcgtctctgtctgattaaagagcaagagcagagtgtgtggcgtctctgtgggatggatttgcattccaagctgcagccaggtgcggtttgctcagccacctcctgttggaggcctccacattttggctatggtaataaagatgctgagaacatt

SEQ ID NO: 239016 - DNA, 231 bp, Homo sapiens
tggatagaaatcgggcacaatcatgcccacgcacgttgtgcaaactcaacaaatggtgacaggacctcagtgggtgctaagttgactgggcacatccgattcctcttcaaataaataaatattccatgtaaatgtctcttccagggaatcgtgtactcctgatgcctgaaaatcgttaagtgaagacttatcacattaccgatttgttcaaaaccacagcattcaaagaga

SEQ ID NO: 239017 - DNA, 228 bp, Homo sapiens
agagtaagtggtgtcaattagtgttctaatgattaaatattattgagttatttaatgtccaatggtgttttatccacaggttataatcgcatatgaagttgccttcattcttgtgaaactgtttggtttaaacttttgaatcagtgagagaatgtcaaagaggtacaataaaattatcacctgaaaattgtttctctttcaacagtaatttaatttcaaagttcattt

SEQ ID NO: 239018 - DNA, 447 bp, Homo sapiens
cagggccagctttctggcctggatgctggggctgttctgtccttggaccatccatgggacgtgatgttgaaccgtccccctaggacccactagctgctgtcagattttacagcctcccccatgcaaccacctggggtgttcgctgctcagaaactctcagaaagatcacacagggccaggtgcggtggctcgggcctgtaatcccagcactttgggaggcagaggtgggcagattgcttgaggccaggaattcaagtccagcctggccaacatgatgaaaccacgtctctactaaaaatacaaaaattagctgggcatggtggcgcatgtctgcattttttggaggctgaggcatgagaatcacttgaacacaggaggcagaggttgcaatgagccaagatcgcgccactgtactccagcctgggtggcagagcaagacccttcctc

SEQ ID NO: 239019 - DNA, 274 bp, Homo sapiens
tgcttcctgtgacaccatgtggaggagctgagatggagaagcagaaggacttctaattctggtttttgcatttctgacaatcaaccgatggctccacctggacctgccaaccccgccaagcagtcgtggacccagaagcagactccctggcctgccaaactatccttacaaaaccctagcctccaacttttcaggaagattgatttgagtaataactccatttaccacgtggcacggctggcctcaatgattaaactctattgcaatgctgtgg

SEQ ID NO: 239020 - DNA, 490 bp, Homo sapiens
gcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtcaacagca

SEQ ID NO: 239021 - DNA, 453 bp, Homo sapiens
tttcagcatttaaaggtagcatttagaatgcctgtggtttaatttctaaaatctaattagcttaccaccttaatcttaaataatttaaaaatatatttaagctactgatgttaaaaaatgtttttctttaagcaacttaaggaaaaaaccaccattgttagttgcttctgagagaggtgttgggagggttgaaattatacagtaaatttcaggaaagctgttcaattaatagagtgatcactacccaattgcttacatctggtgatttatagaggtttgtttttactgagggcccaggtcagctaagtcacgggtgcagccgctgtgtctgctttcctctgtttgaataagagctaagtgacatttgatactgatgtggtttttccaaagatcagaaacagaaaggagtgaaagaaaaagcagtcggtatttgacaaataaacactgtattta

SEQ ID NO: 239022 - DNA, 402 bp, Homo sapiens
actaaatcagcttccccaaaaatttggaggcggggtttttcaaggatagtttggggaaaggggagggtggctaggcaacgggtgcttgctgctgattggttgaggtgcaatcataggggtgtgggaaacggtcctgcttactgagtcacttctggctggggctgcggggagctctttttggtttcaggtagagccattgatcagacatgcaaaaacctgttatctgcaggagtcactggggaagtcgcatatcttgtgacctccagaagaatagctggcagttgtttatgtctaccccttagcagaattcaggttcctccatcctcctatcctcgtggaccctcattagctttacaaaggcagttgagttttacggaaggagtattatcatttaaattacaa

SEQ ID NO: 239023 - DNA, 407 bp, Homo sapiens
gtatttttagtgattccttatcctggttcatcagaatttgggaagcttttacaaaatacacattcctcgctgggcaggatggctcatgctgtaatcccagcacttgagatgccaaggcaggtagattgtcttgaactcctgatctcgtgatctgcccacctcagcctcccaaagtgtcttttattctttataagttgtctgtgttaacatcctgtatctgaacaggtccttggtaatatttcaaaaagtaacgttaaaaagagaaaatacagtgctacccagtattgctttttatttttggagaccagagactgttcatacttggaatgtgttatttgaagtgtttgtagatgccgttttgaagccacttttagcttatcacgtagtaacaaaatacaaaaattgtt

SEQ ID NO: 239024 - DNA, 357 bp, Homo sapiens
ggatccctttcgtcgaagaacaacggcaatttttgtatttttagtagagatgggatttcaccattttggccaggctggtcttgaactcctgatctcgtgatctgcccacctcagcctcccaaagtgtcttttattctttataagttgtctgtgttaacatcctgtatctgaacaggtccttggtaatatttcaaaaagtaacgttaaaaagagaaaatacagtgctacccagtattgctttttatttttggagaccagagactgttcatacttggaatgtgttatttgaagtgtttgtagatgccgttttgaagccacttttagcttatcacgtagtaacaaaatacaaaaattgtt

SEQ ID NO: 239025 - DNA, 383 bp, Homo sapiens
atgaacttctagttctgggcttgactgtatagaaaaatcttaagtcatctctttgacttcctaccaatcaaaaaattaacaggaaaaaattaaaatagctagcttgaataaatgaattcaagatagaaatacactaatttgtcatgaaagtgctgatgacagatgacttattcattttcctaccagttccttggtcataattggcattgttgataaaaataaaatatacaactgcactccagtctgggtgacagagtgagaccctgtctcaaaaaaagaatcaaataaaatagaattaaaaaacatacaaaaacttcattactgtatacactgaaggacaatgccatttttccctatatgagggtgcaatggaaaccataacc

SEQ ID NO: 239026 - DNA, 338 bp, Homo sapiens
gcctcacaatgaaaatttttaaacagtttacaccaatcaactcatttaggggctaaagccctccaagacttaatatggtcactgtttatcggtaaaggaatagcataaactttaagatccatctcacagccttgccccacctgctgccaaaccagtcctgaaggggcccacaaacttccccctctcctccaactcattcaaagattagggatcctaccaggagaagtctggcagctagattttacacacatgcctccatgcaagggacttaaatatttgataatctttgtagataccttcgccaggtggatagaagcctttcgcatcaaaactgaaca

SEQ ID NO: 239027 - DNA, 431 bp, Homo sapiens
atatgtttcatcatctgaaaaggtctattttaaattctaaatgtttgctaatttctggttaaggttgtcatggagttttctccttcttcatctaaatcatctggcagtgaagttattgccttaaatcaccatatctagctaacagtatagtgctggtataagtcatctcttacttagaaaaaaaaaaacgtgttaaaaatgttaactgcaaagcacaaagtggtaatgtcatactgcccctctattttggtgcacgataaacacaaaacagcaggtgttgattttctctgatattcgagattgacagcttgtctctttcttactccactgacccccattatgtttaatctacattcatccatgacacattgcaacctgctgattttatatgattttatagccactctgtatgtaaataaaatgagtacaaa

SEQ ID NO: 239028 - DNA, 667 bp, Homo sapiens
atgtaccagcatcttagatcaattctggcacattattttaaaagttttttgttcctgagttccttggtacctgatcattccaatattttctgccttacaaagtcacaggaaaacaggtttggagctgagtattttcaatcaccactgacttggtgacagacactaaactcatttcacttaggattataggttgaactcaaattgggatccctgaagagaaagaccagtcctttatccagtaccttaaggaaaacatttcttatttccattaacaaccagaaaaggaaagacagtgcaacagctggaagagcactgcaaatatcagggttacaaagagtaacccagaaacctttaaaataatttaaagtggtgataaaaccagtaacacactgcacttctattaatgcagtaatccttaacccttgaacctaacttgtacttacactaagaagtcagaagaactgtttttacttgatctaccaaggcaatttcccatagtttgattggaaatagtgctgatgattttctcatttaagttatctacaaagcactaaaaaaaagtgactctgctggaattatccttctaagaaaataagaaaaaaatagaaatttcttacaactaagaaatggatcaagataacattggtctgtgagatttaaatctatc

SEQ ID NO: 239029 - DNA, 972 bp, Homo sapiens
ctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagca

SEQ ID NO: 239030 - DNA, 799 bp, Homo sapiens
  misc_feature (799)..(799): n is a, c, g, or t
tacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcaaaaaaaaaaaaaaaaaaaaaaaaaaaacaaacaaaaaaaaaaatacaaaaaaaaaaaaaaaaaaaaacaaaaaaaaaagaaaaaaaaaaaaagaagaagaagaggagaaacagagagagagagcgaggaagaaagagaaagagaggaaaaagaaaaaaaagagagcagaagaaagcagacgggggcggaggagacagcaagaaggagaggagaggaggaggaagggcagaaccggagagaagaggggggacggaagaagaagagaagaagtgaggacggagcaggaagggaggggagccggacgacagagagaaaagagggaacgagagagagggcggacgaagggagacaagacggggaaggagagcgagcgacgggggn

SEQ ID NO: 239031 - DNA, 1015 bp, Homo sapiens
tacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagca

SEQ ID NO: 239032 - DNA, 595 bp, Homo sapiens
ctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctctccactcccgggagtggagagagaacggaaggggcacagtacttcatatgaaactcataaatac

SEQ ID NO: 239033 - DNA, 418 bp, Homo sapiens
tacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagca

SEQ ID NO: 239034 - DNA, 148 bp, Homo sapiens
ggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctccc

SEQ ID NO: 239035 - DNA, 353 bp, Homo sapiens
tacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagca

SEQ ID NO: 239036 - DNA, 1520 bp, Homo sapiens
tacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcggggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgta

SEQ ID NO: 239037 - DNA, 455 bp, Homo sapiens
gaggttgctgtgagccgaaattgcaccactgcactccagcctgggcaacacagtgagactccctctcaaaaaaaaaagagaaagttccactttattttgtctggttccctttatcctgccctcattgaatgaccgaatgcattaacttaggcacttaaaacgaaggataggctgggcgtggtggctcatgcctgtaataccagcactttgggaggcccaggtgggtggatcacttgaggccaggagttcaagaccagcctggccaacatggcaaaacccagtctctactaaaaatacaaaacattagctgggtgtggtggtgcgtgcctgtaatcccagctacttgggaggctgaggcaggagaattgcttgaacccagaaggcagaagttgcagtgagctgagatcatgccattgcactccagcctgggcaacagagtgagactctgtctcaaa

SEQ ID NO: 239038 - DNA, 222 bp, Homo sapiens
tggtgcaataatagactcccatgagaagttgaaaataggcaaactgcttacaaactacctttatcatacaccccgaggataattccaaggcaacattgaagtaatcaaagcgacatgacaccaccttgtatagatacagtttcacagtagaaagaaagttcgctgtagggaataggagttaaggagatgaatcttgagctggggcttgacgggagtgtggag

SEQ ID NO: 239039 - DNA, 1633 bp, Homo sapiens
actgggctgaggtggggagggtcccacagcagccttgttcaccagagagcctcagggctccagtggctactggtgctccaacaggaagggaagcagccacacctctgtgttccaaatcccccacaggaaactcttctccatggctgagtctgggccagaaagcccaagcacttgcaggtgagtctctgctaacctcccatgcctgacctcacactcagcacctggactctcatctcaggggcttctgaactgagggtgagaaaatcaagagggtctgtgacctgagctgggaatgaggagcgggggaggtctgtggaccccagcctgtggtttcttccagggaccctccccaaacccagcctctgggctgagccaggctctgtgattacctgggagagccccatgaccctctggtgccaggggaccctggatacccagggttactatctcaccaaggaaggaaaccccatgacctggtaccaacagagcccaccagagcccaggaacaagaccaacttcttcatcccatccatgagagagcaccatgcagggagataccactgtcactatctcagccctgcaggctggtcagagcgcagcgagcccctggagctggtggtgacaggcgtgtctaggaagccctccctcctgaccctgcagggccctgtcgtggcccctggggagaatctgaccctccagtgtggctctgatgtcggctatgacaaattcactctgtacaaggaggggggacatgacctcgtccagggctctggccggcagccccaggctgggctctcccaggccaacttcaccctgggccctgtgagggtctcccacgggggccagtacagatgctacggtgcacacaacctctcctccgagtggtcggcccccagtgaccccctgagcatcctgatcgcaggacagatccgtggcagaccctccctctcggtgcagccgggccccacggtggcctcaggagagaacgtgaccctgctgtgtcagtcacgggagcagttggacactttccttctgaccaaggagggggcagcccatcacccactgcgtctgagatcagagcaccaagctcagcagcaccaggctgaattccccatgagtcctgtgacctcagcccacgcggggacctacaggtgctacagctcacgcagattcttcccctacctgctgtctcaccccagtgaccccctggagctcgtggtctcaggagcagctgagaccctcagcccatcgcaaaacaagacagactccaagactgcctcacacccccaggattacacagtggagaatctcatccgcgtggctgtggctggcttggtcctggtggtcctcgggattctgctgctttaggattggcacagctagagaagtccccaagatgcagcaaggaggtaaatacatgagagaacaatgcacccttcagagtgccagagccttggcaatgagtctgatagtcctaggaggttctggaagaaagtctggaccatcattcgggaaaccgtctactgagaaagtcgagaaggggaggcttgggtcaggttcagggagatgtctgggtgcctgtagagaacgcttcctccattaaacttccattaaatggcagtgctttcagtcc

SEQ ID NO: 239040 - DNA, 1363 bp, Homo sapiens
atggtgtccatcctcactgttcttctgtgcctcaggctgagtctgggccagaaagcccaagcacttgcagggaccctccccaaacccagcctctgggctgagccaggctctgtgattacctgggagagccccatgaccctctggtgccaggggaccctggatacccagggttactatctcaccaaggaaggaaaccccatgacctggtaccaacagagcccaccagagcccaggaacaagaccaacttcttcatcccatccatgagagagcaccatgcagggagataccactgtcactatctcagccctgcaggctggtcagagcgcagcgagcccctggagctggtggtgacaggcgtgtctaggaagccctccctcctgaccctgcagggccctgtcgtggcccctggggagaatctgaccctccagtgtggctctgatgtcggctatgacaaattcactctgtacaaggaggggggacatgacctcgtccagggctctggccggcagccccaggctgggctctcccaggccaacttcaccctgggccctgtgagggtctcccacgggggccagtacagatgctacggtgcacacaacctctcctccgagtggtcggcccccagtgaccccctgagcatcctgatcgcaggacagatccgtggcagaccctccctctcggtgcagccgggccccacggtggcctcaggagagaacgtgaccctgctgtgtcagtcacgggagcagttggacactttccttctgaccaaggagggggcagcccatcacccactgcgtctgagatcagagcaccaagctcagcagcaccaggctgaattccccatgagtcctgtgacctcagcccacgcggggacctacaggtgctacagctcacgcagattcttcccctacctgctgtctcaccccagtgaccccctggagctcgtggtctcaggagcagctgagaccctcagcccatcgcaaaacaagacagactccaagactgcctcacacccccaggattacacagtggagaatctcatccgcgtggctgtggctggcttggtcctggtggtcctcgggattctgctgctttaggattggcacagctagagaagtccccaagatgcagcaaggaggtaaatacatgagagaacaatgcacccttcagagtgccagagccttggcaatgagtctgatagtcctaggaggttctggaagaaagtctggaccatcattcgggaaaccgtctactgagaaagtcgagaaggggaggcttgggtcaggttcagggagatgtctgggtgcctgtagagaacgcttcctccattaaacttccattaaatggcagtgctttcagtcc

SEQ ID NO: 239041 - DNA, 1956 bp, Homo sapiens
  misc_feature (150)..(150): n is a, c, g, or t
  misc_feature (1906)..(1906): n is a, c, g, or t
attgaatgtgttttatttagaccataacatttagtgccactttggatttccaattaggcttcaatcagatgccgagagtctgattcgttttgttgttttgatcaacacgaaagatggcaacatcagaggagccgtcatgaaaagttactnccatccactgatgactaggacggtttctgtagtgtgaagatgcaggttcagaggtgtcgagagcggcaccatgcatcaggaagaggggcagaggcaaaggggaagtcagtgaacccctggagacaagcgcaattggaagtcctggggtgcgtggccgggacttggcaaggtccctctgtatgtgggccagggctctgggtgcccctgagggaggggaaaggtgttggtctccaccccagcagatttctcatacaaatggttcaggcttgaacagctcctctcaggccttttatccagggacatctttgtgaacacagggttcccatgaagtgggaagctgaccaccactttttgatttctttagtgaaggcctctgaactcctcagccagaagtgaccagctgtactcatttacagaaatatgtggggggctttttctcaccacctgtgagttctggccagccactggcacatgctgtctgtcagataaggtttctcaatggggttgatcctagggacaaaatttggaatccaactttgaactgccagggagtttgttgcgggagggaggtggcaggatggcagaggggtgatgggagagtggccggggaggagtaggtaagagtctgcctgtgccaatcatcaagagtcactcaccacacatctgagtcaaggtcaactggagcctcattttccccattgataaaatgtgtttgaatgccccttgcggcaatgacattgggtgcattccttctagccatgaatgtgtatggaatggaggctgtgtgcacagcgctcggaggctgacctgggttcgagtatgcatgtgcttgtgagaacagaagttggtggggttggtgagtgagatgagagcaaacgttcctgtgtgttctgggggtgttagtgtctacactatgttagtgttagtgtcttcactatgttagtgttaggctctttcatatgccattgcatgtacccactgggggaaatgtgtgttcaagcccttctcctcccagctttacactgtttttagagcccagcttggctgcatttccagctggccctttgatctttctgtagcaggccagctcagggactcagcttttcagccgcaatctccacttcatagagtgcatgccttgtggttaagttccctgagcctttgccactgtgcctcaagttacctccctcacctcaccttgttccccccagttatgactggtccccaccttgcaaacaggttggggtttgaaactcccaccaggtgatgagaaggctgactgtgtcatcagctgttggtgacttagcaaacagtctgggttcagcctctgtccctcaactaatatttaattataagaaagaggtgggcagagatgcaagccaggtagaaggaagacaggagagggaagaatgaactgagatgaaaaaaatgttctagccacttagccattaaatagctcatcaaacagcctttgaggaccaactgtgctcacagcaaagagcttatccttgcactatcacacatacatatggaaaatagacaagtaagtagtgagttacaatacacactttgcgaggctgaggcgggtggatcacgaggtcaggagaccatcctggctaacacggtgaaaccccgtctctactaaaaatacaaaaaattagccaggcatggtggcggtcacctgtagtcccagctactcgggaggctgaggcaggagaatggtgtgaaccctggagatggagcttgcagggagccnagatcgctccactgcactccagcctgggggacagagagagactccatccc

SEQ ID NO: 239042 - DNA, 2672 bp, Homo sapiens
  misc_feature (1441)..(1441): n is a, c, g, or t
  misc_feature (2237)..(2237): n is a, c, g, or t
aataggaaacaggattgggcctgtttgataaaggatgtgcttgtgtgtgtgcatgtgcgtgtgtgtgtgtgtgtgtatgtgtgtgtgtattggaggtctttaggaggagagaagcgtggaaggacagcatcaacacctggcatgggagccaggctttggcactggtggtagtggggaggcaaggtgtgttatggggcatgcaagcacccttactccttgggacactcatcattccccagacattgcttgcctgtgacatctctgtggcaggggtgagacgtgatgctgacaggggcagtagagtaggggttaagagcaggacgtttgaggttgcacagacctggaatttcagcgtcaacttttactgtgcccttggatgagctactgatcctttctggggtgtttttttttattattattatactttaagttttagggtacatatgtacaacttgcaggtttgttacatatgtatacatgtgccatgtttgtgtgctgcacccattaactcgtcgtttaacattaggtatatctcttaatgctatccctccccactgcccccaccccacaacaggccccggtgtgtgatgttccccttcctgtgtccatgtgttctcattgttcaattcccacctatgagtgagaacatgcagtgtttggttttttgtccttgtgatagtttgctgagaatgatggtttccggcttcatccatgtccctacaaaggacatgaactcatcattttttatggctgcatagtattctatggtgtacatgtgccacattttcttaatccagtctatcattgatggacatttgggttggttccaggtctttgctattgtgaatagtgccacaataaacatacgtgtgcatgtgtctttatagcagcatgatttataatcctttgggtatatatccagtaatgggatggctgggtcaaatggtatttctagttctacatccatggggaatcgccacactgacttccacaatggttgaactagtttacagtcccaccaacagtgtaaaagtgttcctatttctccacatcctctccagcacctgttgctctgtcactcaggctggagtgcagtggtgtgatctctgctcactgcaacctctgcctcccaggttcaagcaattctcctgcttcagcctcctgagtagctgatactacaggaatgcaccaccatgcccggcaaatttttgtagttttagtagagatggggtttcaccttgttggccaggctggtctcaaacttctgacctcaggtgatccaccacctcggcctcccaaactgctgggattacaggcgtgaaccactgcacccagcctgctgatcctttctgaacactggaaaatggggataataccacccttaaagggttgtgtgagaataaaatacaatgatgtctgcaaggagcttagcacatggtangcatactcctaccctagggtaatcctccaccgcctggattgttctttctccaaatgtctgcagggctacttcctctctctgacttaagtctctgccattctaaaaagagcaaaccctccctagtcctgggcaattcctggtcctattctctgctttattttttcccatagtacttgtcaccatttaacatagcatatattttactaatttgttattcccccgactaggatgtaagtttcatgaaggcaggaatttttgtctatttattatatcctgaatgtctgatatgtaataagcatgccatagatatttgttgaatgattgactcacaaaatatatcataaattttaattatacatattagttgttggacacttttgccatgtcatagccttggaataattaagtctcatgaacctccttatccaagagtccaggtctcattatcataggggaccctcctttcttaagcattagagaccagacagaaggaaggtgggattcacacaaaaactttaatcctcagcagttctcaaccctggctgcatgttagaatcaccttggtggctttctgaaaatagcaatgattgaaccacttctagaaactctgatttaactgctctgggatgtggcttggacttaaaatttccttttaagctgccctgttgattctactgttgaggatcaataaactatgtgaactcgaagctactgaaggctagagaatgagggtcttgcacaacagcctgccattgaggttggaggagacattgttcccagaccaaactgagggtcnggctgcttattcttgcagcccaatatggagatgcagatgaactgggaaagaagagagttatttttgtaaccgggtacagggagaagacctggaaaaaatcgccagaccaactcaaaattacaaagttttccagagcttatataccttctaagctatatgtctatgtgtaagtgtgcaggcatctaaagatataagtgattaacttcttctaatctataactaaggtctgagtcctgaagacattcctctggaacctaagtaaatttacttaatctacatggatcccagtgctggggtgattacccttatcttgtctcctgctaaatcatggaggtttggggagttcagacctccaaaccttcagacctccaataaacttgtttgtggaggtctggagagtctcttcagacctccaataaaaatttgtttaatcct

SEQ ID NO: 239043 - DNA, 373 bp, Homo sapiens
tacttgaaaaaaactctttctagaaacatatttattaactattgaatagacttaatacagcaaagacaagtagagatgaccgatcatcaacagccagatttgggcagatttaagtgtcctggtcctaagacaatcttaatagctctgagatctttaaaagattaaagtttgtttttcaatatccttaggaagaaaagagagaaagaaaatcatcatggacaatagaggacacaacctaaatactatctggaagcagccttttgctactaactgttcaggaccgtaattaccctcctccatcggctatggcaaactggtaacacatttccgactacactttcatctgcgtggcaaccagatcaatgttctttac

SEQ ID NO: 239044 - DNA, 359 bp, Homo sapiens
ttttagttctgagcatcacatttatatacaacaacataaaaaggaagaaggctgggtagtctagtgactacttaaagggagaaaaatctttccagaaactttctggcagacatctgctcatatctcatcggctcaaactcattcacatgcctatcttaaaccaatcactgacaaaggaatgggatatccatggctggcttatataaatcaagagttactcctagagttctgtccccattttcccctcttagttaatctaatgtaactttacatatatgcaaattaaacacttttttttcactacaaagtctgtgggtttgtgtttggtttgtgcgtttgtgtgtgtgtgtgtgttgtgg

SEQ ID NO: 239045 - DNA, 425 bp, Homo sapiens
tgatttcatgcaagtactcaagccttgtgtaaaagcagaaagcatacagagatatgtaggtgtcgtgggctaaattgtgccctcccattaacgtgttgaagccctaacccccggtacctcagagtgtgactgcatttggagatatggtctttaaagaggtgattaaattataaggagggtgtgagagtggccttgatctaatctgactgatgtctttaaagaagatgacatttggacacagagagagataccagggatgtacaggcacagaggaaagaccatgtgaagacacaggcagaagacagccatctctaagtcaaggaaaggggcttcagaagaagccatccccatcaacaccttgatcttgtactcccagattccagaactatgagaaaataaatttctgttgtttaagccaaaaaaaa

SEQ ID NO: 239046 - DNA, 483 bp, Homo sapiens
ctgtcacttggagcccgctgtcaccgcctgggaacggggggtggggagcgctgggacgtggagtccgggatcccgaagaggaagcaagagcgagatggagagggggaaggggaggtgtggagagcgcgagggatggcaaggagaggagagggtcaggaggggccaggctcggacccaggcttccggattcccagccaccgggcccgggaagaggcgaacgctcggaggaccgcggccagggagaaagggagggaatccccggagaccgagggcgctcccggcaccccctcctgggcagccggtccccaaagggatcagagatgctcccgtttgatgtgtatgcgcggggagagggagggatgccgcggtccagactgacggcgggttcggggcttccagttcccgggatcccgggaggaaaaaggggaggcagcggggatggaactggggacccccgacgtctcagctcccaccctgcggccg

SEQ ID NO: 239047 - DNA, 358 bp, Homo sapiens
aaaaaaaaaaaaaaagaagaagaagaattctaaaattgttcagtgtcatgcttataatcctggcaatttgggaagccaagtggtgggaggatcgcttgagcccaggagtttgagaccatcctgggcaacatagcaagactctgtcgctgcaaaaaatacagaaatttttgtagcctgagtagcctaagtagctaagatgacaggtgcactgggcgtggtagagtgcccctgtaatcccagctactcaggctgggctgggaggctggcttgagcccaggaggtgaagcctagtgagctatgatcataactgcactctagcttgagtgacagagcgagatcctgtctcaaaaaataaaaa

SEQ ID NO: 239048 - DNA, 2063 bp, Homo sapiens
  misc_feature (1366)..(1366): n is a, c, g, or t
caaacatggcaaaaactatctgataacagccaggcatatagaaagcacaatctaatatatgagtctgaattttactgtgtcccttgctgaaaaaaattcagccattaaaataaccaaaaaattcataatcaagaaatatgtttctgtcatgaatagttgttttttactttagagtgtaaagcatgagatgattatttggagtggataattattaactaatactgacttggggtggattatttggggtggattattgttaactaatactgagttcttgctctgacaatcaagaatttcaaatacacattagcaccacagaaattaccaaagttgaggaaatatatgttacgtgaaatgtatctttgaaattttaataagtgtgtgaacttaacttccttacacatatttgctataattttgacctaagcatattttctactaaggcatgatgctgttaactgacatgatagtatactgtaaaacatggctgtataattagccaaatgtatgaaaaataaacactactttactgacaagtgtaattaaaggaaattggtaaattaagtacattgtaattatattgtaagtagttaatattaaaaatagtcattcttcagctgggcgtggtggctcacgcctgtaatcccagcactttgggaggccaaggcaggtggatcacgaggtaaggagatcgacaccatcctggctaacacggtgaaaccccgtgtctctactaaaaaaatagccgggcgtgatggagggcgcctgtagtcccagctactggggaggctgaggcaggagaatggcgtgaacccaggaggcggagcttgcagtgagaggagatctcgccactgcactccagcctgggcgacagagcgagactccgtctcaaaaaaaaaaaaaagaaagttataaaaggaacttaagtgctttctaacaaaatattattcagaatcacagtgtaaaaaacaaagacccattttattaacagacattttcaaataaattaatacaaacaaaaagcgtttcgaggcacacaacaatttttgatattagtttgtggatggctttggcattgttatactagcttatgaatgatttttgtcatgttatattagcttcattatctaacttttattgtattttgttgtagatacatagttgtgagaaaatcctaacccacacaaataggtcattggatattataaccatgttttcacagttcccatatagtctcaggttgaatttcaacaaaacagagatggcggtgaagctttattttgagataaaatctacattaaaacaaataaagaaacaaataacaacaaccaccacaatcccagcaggtattacaagttgtttccancacatttaattttggtctataaaacttggaatgtgcaatttattatatatcataattattccaaataattaagacatgaaaattgatataaaaagtgtgtggaatccttcaaacagatgaggaaaattttaaggtgtcatttgttagttctgtcaaaaatatgcattgagcacctgtgaatctgtgaaggttctagcagaaaacagatggtaaatgtgagattatttaactgaaaaataaatcagtgaagtgattatttaacaggtgtaaacagcgttaagaaaacaagtaggaatgtgagaaattctgagtttttaaggaccgtaaacagggaaaaccctttgctacccctaagtcggaagggacaaggggaagacaagtttgtgaaagcacagatgatagtgtgagctgtggaggtaggtccattatgaaactcgtagagttggaggaagcagagcaaagccagagggttgggaactgttgacacaacctctctcctcctgctttatgatcttctgccagggaattaattaccatcgccaactggaagcaaaggaatacaatgaaatctagagctgtcagccttctacacacacacaatagaacaggaaaaaagggggacagaaaagagaacaaaaatacagctacctatttactacattccagacattattccaagccctatagacgtagcagg

SEQ ID NO: 239049 - DNA, 647 bp, Homo sapiens
gccaccacagtcaggaaggggtaaggaaggattctccccttacatgtttagagggaccatggccctgccaatattaatccacttaagtttgtggtaatttcttatgaacagactgtgcaaggaaattaatacacagcctagttcttaaaactgtcaccagtggcaaatggagatggtatagtagcagaaggaaatgcagtggctggtataaagtattagatatttgaaaacattggaagaatcagtgcctataatgacaatggaatccaattctactgccttaacgtagtctgacactttagaaaataaaatgaaaacctgacagcaatttacaggccatgggaaatcaaatgtggagaagccagtgggccttcttgcagcatagaaagaggctctcctctcctaggtgaaggcagagaaagctgaccaccagtcttaggacctaattgtcagaacagcagggctccaaggaaagctaaactcccagccaagatagatctgctctggcaaggtcaggaccctggtgtgaaagaacagtactctgatactaggatggggacatccaggttgattccagagccttcctttcctcaatcttggaactcctaattctctaaaccctctgggcctgcagaggtgggccaccc

SEQ ID NO: 239050 - DNA, 460 bp, Homo sapiens
gaatctagttaagcttaaattgtttcaaactaaagcaggccatgagatgaacccttttcatcttcccagttctcaaacacactgagatcttccccacatttcactcctttctgtcagttgcttgaggtcatgtaaccagagtgagcccatttgccctggctgactgctgatctggccttggacacctgccctggcctcttctacccaagctgcaggtttggccctgtctctcccttactgcggtggtgaggggggtgcaggggggagttgacaaccttcttaaccacttcagtcacatgaaagaagcagacaagtgagctcgcatctgtgtactgaccttttaacagtgatgctgcccagtacactcagacccaatcagtgttctcatatctgccttcctccttcctgagaattaggagaaagaagagctcagccttgatttcttacctcaaaagacagc

SEQ ID NO: 239051 - DNA, 360 bp, Homo sapiens
ggataatccaggataatcccctatctcaagatccttaattttatcatatttgcaaatcttgccatgtaaggtaacacatacacaggttccagggatcaggacatggacatcttggggggtacaggtcaatattgtgtctgtcacagtacctgacatagtttcttgcacacaacaggtgcttatcaatttcagtaatgtgtggcgaatgcagtatatgtgagtgttaacatacactgatttggagcatcagccaatttttggctgatgcctcagacttaaatttcagaagccttatggcaaaaatcttaaggaaagctcaatttgagattcgtttacttttccatttaatttaaaaaaaaa

SEQ ID NO: 239052 - DNA, 635 bp, Homo sapiens
caccacacccagctaattatttatttttctagagacagggtctcactgtgttgcccagagggtctcgaactcctagcctcaagcagtccccttgcctcagcctcccaaagtgctgggactacaggcgtgaaccaccgcgcccggcctgatctcttatttttaaaatgtcagcatgaattcacctgaaaaccaaacacacaagaacactttgggacatgcattacacacctcccgaggtggctgtcattgtcctcacttgcagataacatcaggtgagatgaactcttacgtggtgctgatgtatcagaccaggattcactttgcagaaagacctaagacctgttacattttggcaatgtcgtaacccacttcctacagcctcatttgagagcttttgatttatgccacctcgtgccgaattcggcacgaggcccctcagtcccttcctacttcccaacaaggggctcactatcctcaaagaaggagctgttggggacccacgacgcagcccctgtactggaatacagcatattctcatctcttgccccgatgctgcctgtggggcgagtggagacctcccatcactgagacagatcacagaccacgagtgccttttcccggacctggacgttgct

SEQ ID NO: 239053 - DNA, 217 bp, Homo sapiens
gccacagccactacataaacaagtgggtatagctgtgttccaataaaacttaagtaacaaaaacaggttgtgggatggatttgacctgtgggctatagtttaccatgtgtttagaatatggactgtgttctggctgttacaggttcatgtgtgttacagggttgggtgtaggggactcattcatagtttttacattaatagcccctaaaaagctaaa

SEQ ID NO: 239054 - DNA, 371 bp, Homo sapiens
agcaaggaatcctgatagaagattgctaaattacatacaaaattggttaatattctaaagggcatttatttttaaaatcccataacccgggctggtcacagtggctcacacctgtaatcccagcactttgggagcccgaggtgggcagatcacctgaggtcaggagtttgagaccagtgtggccaacatgggaaaacctggtctctactaaaaatacaaaaagtagccaggtgtggtggcacgtgcctgtaatcccagctacttgggaggctgaggcacgagaatcacttgaatctgggaggctgaggtttcagcgcaccaaggtggcaccactgtactccagcctggacgacagagcaagacactatctc

SEQ ID NO: 239055 - DNA, 737 bp, Homo sapiens
acctcgctgaagactgcagaagcccttggtcagactactctcaaggttgaatctccctggcttgactgagattcagactttatggaacctgattcaacaactgatgagactggaattgaagcactactttaagatttattgtctcctcttctacaaggatatacattcaacaaggaaagagattctttgttcaccacttttcctccagcacatgtcatgtagtcaattaatattaattgataaaaggaataaattattgcattaggttttggtatcaagatgatgctggcctcacagaatgagttgaggagaagttccccctccataattttttggaagttactgttggaatggcaccagctcttcattgtacatctggtagaactcagctatgaatccatcaggtcctgggcttttttgaatgctgatcaacgtcaagaattcttccagtcatgtataatgaagacggcatttgattatcattctgaatgacttcaacctatcaggacaacttctcccagagactactttgttcaataatataaagcaccaccaccattattaagagtcaaaaagcactgaaccggagaaagcagttacatacaaattttgtcatttgatagaatcaaccaaatatataaacaagaatcctgacatcttaaagataaagaaatcagtaaacaaataaaagaagtaccaaagtaccactcatgatcataccattctctctgtccatt

SEQ ID NO: 239056 - DNA, 441 bp, Homo sapiens
aagtgcagaaagcaagttgataaggaacctgggtagtgctggcagtggggcacaactcaggacccccaggcaggactgactgctcctctgttggggctctagggttcctggatacggcacagaggccaaaggtgggggctctagagacacgaccagagagtcccctcttccacaggcaaagactaagggtgagagtatcaccagaagctgagaaggagtggtcaagtacacaaaagcactgttcctcccagatgagtgcaggaagggctgctgaccagaaggggaaggcactgtggagttttacttctgtgtccagccagctaagtactgtgatctgcctgaactcagtataggaaaagacacagatgcccccttaaataggcaagaggctgtgttaggacaaagaaaggaggaagatcacgaaccaagacatgaatttag

SEQ ID NO: 239057 - DNA, 621 bp, Homo sapiens
ttaaccatttatggcaactcagaaaactgcatctggtacttcttatatgtttcctctaaaatcaccacttctgccaaaaacatctataaagaaatctctcaaaaggtttgggtaacaaagcgtctgggaatgtatttggcctgtgttcaacaggacattatatgttttcttgtataaatcatgtcctggaaaacggaatgtctttatttaaaataaaaactttaccatccagcaccgtaaaggtagttccacgaaaaatattttaagcttcttttatatctgtagctttaaaacatgtttttatgcttcatattacagtaagttttactgggactcattttatacattcttctagattttcttttaaaaaatggtccaaggaaattttccattctcaactcttaggagacttttaaaagtagtcattcaaccttcttaaaaaaaaaatcagttatgctgccctttcagatacaggtataaactagcagacagaccaaaagatcttcctgatgttagaactaaatttgtattgcttatgaaaactcacttttctttgcacaccataaaattcaccacctttctgaatcatagttatcaaaataacaatatcttgtgcttttt

SEQ ID NO: 239058 - DNA, 485 bp, Homo sapiens
agtctgtttataataatcagaatcaaatgttgtttgtttcttctaaacgttaatggagaaaattgaaggtggtaaaatgtcatgtttattcaggctgggaactgtattcacagtagaagtttcagtggtcaacatatctatgactctttaggctgctgtagttttacagtcaattatttaaaagtgagtagttacatttataagagcctgagaatacttagactcagtcatttgttagtatttttaccaaaatctcttagtttcagacatgtcagaagcagctatatagcatatcttattctatgatatacatcaggctatctcaagttcctgtctcacagttaattcaaagaaggattaggatttctgtattttttctcatttgaatctttatgtgcatttggtttgtgtacatgctttttgtagtgtaagatatgaaattttatattttttcagaaaataaaaaccctttgaatacagttaaa

SEQ ID NO: 239059 - DNA, 275 bp, Homo sapiens
tctggcctcaagcaatcctcccatctgagccccacacataatatctaatatgattctttctcctacctttctttcaatgtgtgcactaatatttttctagaaggcttgagcatattaaaaaataacatttatattattttattcaagctatttagaataattgggagatttttctttatgattcaaacttaacatttgccaatatacaataatggagatttggcatggaatgattttgttattcatacattgagaaactaagagctctgcactta

SEQ ID NO: 239060 - DNA, 353 bp, Homo sapiens
tgggagagataggctgggtattcagagaaaaatacccctcattaaatgttaatgcaagaaacaggtggaaggccgagcatggtggctcaggcctgtaattcctacactttgggaggctgaggcaggtggatcacctgaggtcagcagtttgagatcagtctggcaaacatgatggaaccccatctctactaaaaatataaaaaattagctgggtggggtggcaggtgcctttaatcccagctatttaggaggctgagacaggagaatcacttgaacccaggaggtggaagttgtagtgagccaagatcgtgccactgcaccccaacctgggcaacaacagtgaaactccatct

SEQ ID NO: 239061 - DNA, 1122 bp, Homo sapiens
gaaagactttaaacaaaatatcaataccatgctcaccctttaaaaagtaatttctaaattatatatgcagtttatttagaagtataaagaaaaaagtaaaaactacctttaattttcgtacacagaaataattgcttttagtgatgggatgtattttgtgtgtgtaagtttaaagaattgtgattgtctgaatatattgtttatatgctgcattttcagattcccagtaattcttaacagattattctgcttgcatatcttttaatacatttccatgaatgtaccattatctatttaatgccttgttgttggacatgttcatttcttccagatttttgctattataggtagtattttgaataacaggccagtacacaagtctttgtgtaactctcaggctcattttataattagataggatatttctttcttattaagtttgtaccaaattacacttgccccaacacatatggtagtacccattccagttttgttgttactagtttcctgtatattatctctgcagatcagggtgttttttctgtaaagagctagatagtacatattttaggccttgccatacagtctcgtcataactattcaactctgctgctgtagggcgaaagcagccgtagacaactgggtatggctgtgtaccaataaaactttacttaccaaaacaggcagtggtggaacatagtggctcatgcttgtaatcccagcactctgagaggctaaggtggacagattgcttgaccccaggagttcaagaccagccggggcaacatagtgaaaccccacctctactacaaatacaaaaaaaaattagccaggcatgatggtgcatgcctgtattctcagctacttgggaggctgaggcaggagggaaaaaaaagaacaacaaacaacaggcagttggctagattctgtccacaagccatagtttgataaccccttcagtggatactagttattaaagcaaaacaaacaaaataagtcttaaggaggcccctaaagttgttgaagatttaagtcaaccgaatagtttataatcaaagatcaccagattgacaatgaagcaagctctatggctgagggttgaaacaataaaaaataaaaaaa

SEQ ID NO: 239062 - DNA, 349 bp, Homo sapiens
tatagaagtacaattgatttttaccatgttgctcttgtatcctaaaaccttgctaaactcacttatgagttctaatgactttttttaatagattcagtaagattttctgcatagatgatcatgttgtctgtaaataaagataatcttagttcttcctttttctttttcttgccttattactctgactagaactagtacaatgttgagtagaaacaaagagagcggaaattcttgctttttcttggtcttaggtggaaagctttcagtctttcaccattagctatgtcaatatgttctccatagatgttccatatcagattaaggaagttctttgctgttgttagtttgt

SEQ ID NO: 239063 - DNA, 194 bp, Homo sapiens
acccaacattttgtttctctgaatttgaggtccagggcctggaaatgggcactgccaccactcaaaatggcccgagcaggggcccacaggtggtggcatggccttcatggggagtggccatttcggtgagtagggaaggaggggtaggcttctaggtttcatctgcaaagatacttgttcctgaaagccacaaa

SEQ ID NO: 239064 - DNA, 385 bp, Homo sapiens
cttatgattgtgccactgcattccagcctgggctacagagtgacaacctgtctctaaaataaataaacaagtaaaaactgaaaacaaacaaataaaaaatacacttagtaaaagcatatttcttaaggatacactcagattgggtaggttaaatatggccaggtctgatattgttggataaagctgtatttatattgggccaaaacatctgaaaaactaaacatcctattttcattgatgtttcaggaaatatgctatcatgtctaataagccttacattgaaaataaaataaacttggtaattgtttgtttgttttaggcatgatattttaaaactgaagttgtcaaaaaggacagtagagctgggcacggtggctcatgcctg

SEQ ID NO: 239065 - DNA, 290 bp, Homo sapiens
tatttgcttaatagaaagtccccactgggggccgggcatggtattcttacgcctgtaatcccagcactttgggaggctgaggcgggtggatcacttgaggtcaggaatttgaggccagcctggccaacatggtgaaaccccacctctactaaaaatacaaaaattagctgggcatggtggcgcacacctgtaatcccagctacttgggaggctgaggcaggagaatggcttgaacccgggaggtggaggttgcagtaagctgagatcacgccattgcactccagcctgag

SEQ ID NO: 239066 - DNA, 381 bp, Homo sapiens
tagccatttagaaacaggcagaatggatcaagtttggaagaaatttatatcatagccatgagatgtacaaatataattgaatccatctcgtttccacaatgctgtatgtaccttaaatgaaatgcattactatttgagctagaagccccagttgtatctttttataggctgaaacacttaggataatcacaatgttgtgaatatttcaccactatacaatagtggaattgttcgatatcatgcataaaatcactgcaggaagggttaagcctgagagcctatcagctcccagtctgtggaatcattgtacattgtaaatattttgccgcatcacttggcatcagtggcctcacattttcatattggtttgaagctattttg

SEQ ID NO: 239067 - DNA, 590 bp, Homo sapiens
tcctatgtgttctcaacacatgtaaaggaagagtgaccagattgatcttaatcagaaatgtccagttacatgtcggccgacagcattgatttcacattttagtattctagttaaaatttgctaatgaatagctaatataatacctcgaactgtaggtggttcaggttacttgtttttgaccagccttgtttcttcagttactgtaggccttttgagacctgtctccatctcaaaaaaaaaaaaaaaccaaaaaaagaaaaagaaaagaaatagccaccttttacaaacccagttagtcatgagtggcatactgtcccaggagatgtacgtggaccttgagaggttgttagggatgaggtgctggttcgcccagattctttatgcatattatctaaccttcatatcaactcaataggatgatactataattatctccatgttacaaatgaggaaaccgaggcagggcattgcggctcggcctcccaaagtgctgagattacaggcatgagccaccgcgcccaaccgaatgtgatatttttatgaccatgagaaaagaagggctgcattctttggtgggtcagcaaaattaa

SEQ ID NO: 239068 - DNA, 304 bp, Homo sapiens
tcctatgtgttctcaacacatgtaaaggaagagtgaccagattgatcttaatcagaaatgtccagttacatgtcggccgacagcattgatttcacattttagtattctagttaaaatttgctaatgaatagctaatataatacctcgaactgtaggtggttcaggttacttgtttttgaccagccttgtttcttcagttactgtaggccttttgagacctgtctccatctagtattttactgagaaacaaattggtgtggcatttgctatgtaaattactcatctaggaagatcttcctgttcc

SEQ ID NO: 239069 - DNA, 649 bp, Homo sapiens
gtatgattagttctcttctattagtcaatataactgatttccaaggtatattttccatttagtggaatcctgagattgttggagccttcatatttttttccttcagtcatcttgccgattgacactaaaatgagcttaataagatttttatctattattggaggattccaggcctatttattttccctaggaaggctataatatttaacaaacaagtttattgaaatattttagaactttaaatcttttgaagttacccaaattggagggtcttacaactttgaattactttctaagacctctttccttccagtaatgagaaacatttattcaactttttaaaagacagaaatcatctttttaaaatgtactgttttctaattgtctgaaatgacaagagatcacttacccagcagtgcacaagacttccaaaatagctgagcagcgggtgaggggctagaaggcggggggtggtggtggtatctttttttaaaaaagtatgtttactagaaagggtataagatactttgcttttgttataggtgcacttgcacaaaactcattttaacctgtagtcacaatttcttctgtatgacccacccaaagtaaccaggctgcaaagcattataccacatataaaagcaacatt

SEQ ID NO: 239070 - DNA, 264 bp, Homo sapiens
tttttgtgtgtgtgtgctggggcctgtatcaggtgctagggacaccacagaagttaaaacagacctggttcttgccttcatagagctcacagcccagcgtcacccctttacaactctctttccaccccacgaccacgcatcgttggaatgcactccggttcatgtctgccttcgctgctggacgtttatgttgagcaggtaaggcctaggttccagcattcagtcatcaagtcttgttacagaaataaatgaatgaatggctga

SEQ ID NO: 239071 - DNA, 391 bp, Homo sapiens
gtaatcttccagagctccaaagccatgtctgtctgtgtgcgtatacccaactcacattatctctctctctttctttctctctctctctttctctctgacacacacacacacacacacacggaaacacaatatttttctcttttcttccttttcctctgttttctcttatgcctggagccatgatcaatgaagtcattaagggttgggagcaggcagtgagagcttcagcttagtagatagatgtccctccaccacccttgtggaaggtagctcagaatacacaggttccccctgtggtagctggagcctgcctgaacagcccccaggtagaagcttctgggggccagccttgtgccctccatagctcccagcatctgatgttgcactatta
